United States Patent 12,508,308 (INFLUENZA mRNA VACCINES) - sequence listing, part 37

SEQ ID NO: 141474 - RNA, 1410 nt, Artificial Sequence
  derived and/or modified sequence opt3 from neuraminidase__InfluenzaA__ADM13344
augaaccccaaucagaagaucauuauaaucggcagcgugugcaugaccauugggauggccaaccugauccuccaaauuggaaauaucauauccaucuggauucuucacucuauccagcuggguaaccagaaucagauugagacauguaaccaaucagucaucacuuacgaaaauaacacguggguuaaucagaccuaugugaacauaaguaauacaaacuucgcugcaggccagagcguaguguccgucaaauuggccggaaauucuucguuaugcccugugucagggugggcgauuuacagcaaggacaacaguaucagaauuggcuccaaaggugauguuuuugugaucagggagccauucaucucuuguagcccgcuggaaugccggaccuuuuuccuaacucagggggcucuccugaaugacaagcauuccaacggaacaauuaaagaucgcucacccuaucgaacccuuaugaguuguccuauaggcgaggucccaagccccuacaacucucguuuugaauccguggccuggucagcaagcgccugccacgacggcaucaauuggcugacuauugggaucaguggaccugauaacggugcuguagcaguuuugaaguauaauggcauaauuacagacaccaucaagucuuggagaaacaauauccucaggacgcaagaguccgagugugccugcgugaacgggagcuguuucacugucaugaccgauggaccaucggacggccaggcuucuuacaaaauuuuucggaucgaaaaggguaaaauugugaaguccguggagaugaaugcccccaacuaucauuacgaagagugcucauguuacccugauaguagcgagauaacaugcgucugccgcgacaauuggcacggguccaacagaccauggguuucuuucaaucagaaccuggaauaucagaucggauacauuuguagcggcaucuuuggcgauaauccgaggcccaacgacaaaacugggucaugcggaccugugaguuccaauggugcgaacggcguaaagggguucagcuuuaaguauggaaacggcguguggaucggucggaccaaaucuauuucaagucgcaauggguucgagaugauaugggauccaaacggcuggacaggaaccgacaauaacuuugcaaucaagcaagacauugucggcaucaaugaauggagcggguacuccggaucuuucgugcagcaucccgagcugacgggucucgauuguauucgaccuugcuucuggguugaauuaaucagaggcaggccaaaagagaacacuauauggacaucggggagcuccaucucauuuuguggagugaauagugacaccgucggcuggucuuggcccgauggugccgagcugccguucacuauugacaaguga

SEQ ID NO: 141475 - RNA, 1410 nt, Artificial Sequence; identical to SEQ ID NO: 140656
  derived and/or modified sequence opt3 from neuraminidase__InfluenzaA__ADM13354

SEQ ID NO: 141476 - RNA, 1410 nt, Artificial Sequence; identical to SEQ ID NO: 139931
  derived and/or modified sequence opt3 from neuraminidase__InfluenzaA__ADM13363

SEQ ID NO: 141477 - RNA, 1410 nt, Artificial Sequence
  derived and/or modified sequence opt3 from neuraminidase__InfluenzaA__ADM13464
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugaaauuguguauuugaacaauaccacaaucgagaaggaaauuugucccaaagucguggaguacaggaacuggaguaagccucagugccaaaucaccggguucgccccauuuagcaaagauaauuccauacgguuaucugcgggaggugacauuuggguuacucgcgagcccuaugugucgugugaucauggcaagugcuaccaguucgcucuggggcagggaacaacccuagacaacaagcacucaaaugauacgauccaugaccguauuccucaccgaacucuccugaugaacgaacuuggcgucccauuucaucuggguaccagacagguguguaucgccuggagcaguuccucuugccacgaugggaaagcaugguugcacguauguaucacaggaaaugacaagaacgccacugcuagcuucauuuaugauggcaggcucguugacuccauaggcucauggagucaaaauauccugcggacccaggagagcgaaugcguguguauuaacgggacaugcaccgucgugaugacggauggaucugcauccggucgcgccgacacuagaauccuguuuauagaggagggcaaaauugugcauaucucaccccucagcgggagugcucagcacgucgaagagugcucuuguuacccuagguauccaggaguucggugcaucugucgcgauaauuggaagggcuccaaccgaccggugguagacauuaacauggaagacuacagcaucgauucgucuuacgugugcuccgguuuagucggggacacacccagaaaugaugacaggucaaguaacagcaauugucggaacccuaauaacgagcguggaaaucagggcgugaaaggcugggccuucgauaacggggacgauguuuggaugggacgcaccauuuccaaggaccugagaucugguuaugaaacuuuuaaggugauaggcggguggagcacaccaaauucaaaaagucaaaucaacaggcaggucauuguggauuccgacaaucggagcggauacucuggcaucuucucaguagaggguaagaguugcaucaaccgauguuuuuauguugagcuuauucgcgggagagaacaggagaccagggugugguggacgagcaauuccauagucguguucugcggcaccucuggaacauacggcacugggucguggcccgauggagcgaacaucaauuuuaugccuauuuga

SEQ ID NO: 141478 - RNA, 1410 nt, Artificial Sequence
  derived and/or modified sequence opt3 from neuraminidase__InfluenzaA__ADM13465
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugaaauuguguauuugaacaauaccacaaucgagaaggaaauuugucccaaagucguggaguacaggaacuggaguaagccucagugccaaaucaccggguucgccccauuuagcaaagauaauuccauacgguuaucugcgggaggugacauuuggguuacucgcgagcccuaugugucgugugaucauggcaagugcuaccaguucgcucuggggcagggaacaacccuagacaacaagcacucaaaugauacgauccaugaccguauuccucaccgaacucuccugaugaacgaacuuggcgucccauuucaucuggguaccagacagguguguaucgccuggagcaguuccucuugccacgaugggaaagcaugguugcacguauguaucacaggagacgauaagaaugccacugcuagcuucauuuaugacggcaggcucguugauuccauaggcucauggagucaaaacauccugcggacccaggagagcgaaugcguguguauuaaugggacaugcaccgucgugaugacggacggaucugcauccggucgcgccgauacuagaauccuguuuauagaggagggcaaaauugugcauaucucaccccucagcgggagugcucagcacgucgaagagugcucuuguuacccuagguauccaggaguucggugcaucugucgcgacaacuggaagggcuccaaucgaccggugguagacauuaacauggaagauuacagcaucgacucgucuuacgugugcuccgguuuagucggggauacacccagaaacgacgauaggucaaguaauagcaacugucggaauccuaacaaugagcguggaaaccagggcgugaaaggcugggccuucgacaauggggaugacguuuggaugggacgcaccauuuccaaggaucugagaucugguuaugaaacuuuuaaggugauaggcggguggagcacaccaaacucaaaaagucaaaucaauaggcaggucauuguggacuccgauaaccggagcggauacucuggcaucuucucaguagaggguaagaguugcaucaaucgauguuuuuauguugagcuuaugcgcgggagaaaacaggaaaccagggugugguggacgagcaacuccauugucguguucugcggcaccucuggaacauacggcacugggucguggcccgacggagcgaauauaaacuuuaugccuaucuga

SEQ ID NO: 141479 - RNA, 1410 nt, Artificial Sequence; identical to SEQ ID NO: 136111
  derived and/or modified sequence opt3 from neuraminidase__InfluenzaA__ADM13466

SEQ ID NO: 141480 - RNA, 1410 nt, Artificial Sequence
  derived and/or modified sequence opt3 from neuraminidase__InfluenzaA__ADM13467
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugaaauuguguauuugaacaauaccacaaucgagaaggaaauuugucccaaagucguggaguacaggaacuggaguaagccucagugccaaaucaccggguucgccccauuuagcaaagauaauuccauacgguuaucuucgggaggugacauuuggguuacucgcgagcccuaugugucaugugaucauggcaagugcuaccaguucgcgcuggggcagggaacaacccuagacaacaagcacagcaaugauacgauccaugaccguauuccucaccgaacucuccugaugaacgaacuuggcgucccauuucaucuggguaccagacagguguguaucgcuuggaguuccucuagcugccacgaugggaaagccugguugcacguauguaucacaggagacgauaagaaugcaacugccuccuucauuuaugacggcaggcucguugauucaauaggcaguuggagccaaaacauccugcggacccaggagucugaaugcguguguauuaaugggacaugcaccgucgugaugacggacggauccgcuucaggucgcgcagauacuagaauccuguuuauagaggagggcaaaauugugcauaucagcccccucagugggucugcccagcacgucgaagagugcuccuguuacccuagguauccaggaguucggugcaucugucgcgacaacuggaagggcagcaaucgaccggugguagacauuaacauggaagauuacucgaucgacucuuccuacgugugcucagguuuagucggggauacacccagaaacgacgauaggaguagcaauuccaacugucggaauccuaacaaugagcguggaaaccagggcgugaaaggcugggcuuucgacaauggggaugacguuuggaugggacgcaccauuucuaaggaucugagaagcgguuaugaaacuuuuaaggugauaggcggguggucaacaccaaacaguaaaucccaaaucaauaggcaggucauuguggacagcgauaaccggucuggauacucaggcaucuucaguguagaggguaagagcugcaucaaucgauguuuuuauguugagcuuauucgcgggagaaaacaggaaaccagggugugguggacguccaacucuauagucguguucugcggcaccucgggaacauacggcacugggagcuggcccgacggagccaauaucaacuuuaugccuauuuga

SEQ ID NO: 141481 - RNA, 1410 nt, Artificial Sequence; identical to SEQ ID NO: 136111
  derived and/or modified sequence opt3 from neuraminidase__InfluenzaA__ADM13468

SEQ ID NO: 141482 - RNA, 1410 nt, Artificial Sequence
  derived and/or modified sequence opt3 from neuraminidase__InfluenzaA__ADM13469
augaaccccaaucagaagaucauuaccauaggcagcgugucccugacaaucgccacugcuugcuuccucaugcaaauugcaauccuugucacgaccguuacacugcacuuuaaacaguacgagugugacucuccugccucaaaccaggugaugccaugcgaaccgauuaucauagagagaaauaucacugaaauuguauauuugaacaauaccacaaucgagaaggaaauuugucccaaaguggucgaguacaggaacuggaguaagccucagugccaaaucaccggguucgcgccauuuagcaaagauaauuccauacgguuaucugcuggaggugacauuugggugacucgcgagcccuauguuucgugugaucauggcaagugcuaccaguucgcccuggggcagggaacaacccuagacaacaagcacucaaaugauacgauccaugacaggauuccucaccguacucuccugaugaacgaacuuggcgugccauuucaucuggguaccagacaggucuguaucgcauggagcaguuccucuugccacgaugggaaagccugguugcacguguguaucacaggagacgauaagaaugcuacugccagcuucauuuaugacggcaggcucguagauuccauaggcucauggagucaaaacauccugcggacccaggagagcgaaugcguuuguauuaaugggacaugcaccguggucaugacggacggaucugcauccggucgcgcugauacuagaauccuguuuauagaggagggcaaaauugugcauaucucaccccucagcgggagugcccagcacguggaagagugcucuuguuacccuagguauccaggaguccggugcaucugucgcgacaacuggaagggcuccaaucgaccgguuguggacauuaacauggaagauuacagcaucgacucgucuuacguaugcuccgguuuagugggggauacacccagaaacgacgauaggucaaguaauagcaacugucggaauccuaacaaugagcguggaaaccagggcgucaaaggcugggcguucgacaauggggaugacguguggaugggacgcaccauuuccaaggaucugagaucugguuaugaaacuuuuaagguuauaggcggguggagcacaccaaacucaaaaagucaaaucaaucgacaggugauugucgacuccgauaaccggagcggauacucuggcaucuucucaguggaggguaagaguugcaucaaucgauguuuuuauguagagcuuauucgcgggagaaaacaggaaaccaggguuugguggacgagcaacuccauaguggucuucugcggcaccucuggaacauacggcacugggucguggcccgacggagcaaauaucaacuuuaugccuauuuga

SEQ ID NO: 141483 - RNA, 1410 nt, Artificial Sequence
  derived and/or modified sequence opt3 from neuraminidase__InfluenzaA__ADM13470
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugaaauuguguauuugaacaauaccacaaucgagaaggaaauuugucccaaagucguggaguacaggaacuggaguaagccucagugccaaaucaccggguucgccccauuuagcaaagauaauuccauacgguuaucugcgggaggugacauuuggguuacucgcgagcccuaugugucgugugaucauggcaagugcuaccaguucgcucuggggcagggaacaacccuagacaacaagcacucaaaugauacgauccaugaccguauuccucaccgaacucuccugaugaacgaacuuggcgucccauuucaucuggguaccagacagguguguaucgccuggagcaguuccucuugccacgaugggaaagcaugguugcacguauguaucacaggagacgauaagaaugccacugcuagcuucauuuaugacggcaggcucguugauuccauaggcucauggagucaaaacauccugcggacccaggagagcgaaugcguguguauuaaugggacaugcaccgucgugaugacggacggaucugcauccggucgcgccgauacuagaauccuguuuauagaggagggcaaaauugugcauaucucaccccucagcgggagugcucagcacgucgaagagugcucuuguuacccuagguauccaggaguucggugcaucugucgcgacaacuggaagggcuccaaucgaccggugguagacauuaacauggaagauuacagcaucgacucgucuuacgugugcuccgguuuagucggggauacacccagaaacgacgauaggucaaguaauagcaacugucggaauccuaacaaugagcguggaaaccagggcgugaaaggcugggccuucgacaauggggaugacguuuggaugggacgcaccauuuccaaggaucugagaucugguuaugaaacuuuuaaggugauaggcggguggagcacaccaaacucaaaaagucaaaucaauaggcaggucauuaucgacuccgauaaccggagcggauacucuggcaucuucucaguggaggguaagaguugcauuaaucgauguuuuuauguagagcuuauacgcgggagaaaacaggaaaccaggguuugguggacgagcaacuccaucguggucuucugcggcaccucuggaacauacggcacugggucguggcccgacggagcgaauauuaacuuuaugccuaucuga

SEQ ID NO: 141484 - RNA, 1410 nt, Artificial Sequence
  derived and/or modified sequence opt3 from neuraminidase__InfluenzaA__ADM13471
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugaaauuguguauuugaacaauaccacaaucgagaaggaaauuugucccaaagucguggaguacaggaacuggaguaagccucagugccaaaucaccggguucgccccauuuagcaaagauaauuccauacggauuucugcgggaggugacaucuggguuacucgcgagcccuaugugucgugugaucauggcaagugcuaccaguucgcuuuagggcagggaacaacccuggacaacaagcacucaaaugauacgauucaugaccgaaucccucaccguacucuacucaugaacgaacugggcgucccauuucaucuugguaccagacagguguguaucgccuggagcaguuccucuugccacgaugggaaagcauggcugcacguauguauuacaggagacgauaagaaugccacugcuagcuucauauaugacggcagguugguugauuccaucggcucauggagucaaaacauucuccggacccaggagagcgaaugcguguguaucaaugggacaugcaccgucgugaugacggacggaucugcauccggucgcgccgauacuagaauacuguuuauugaggagggcaaaaucgugcauaucucaccccugagcgggagugcucagcacgucgaagagugcucuuguuacccuagguauccaggaguucggugcauuugucgcgacaacuggaagggcuccaaucgaccggugguagacaucaacauggaagauuacagcauugacucgucuuacgugugcuccggucucgucggggauacacccagaaacgacgauaggucaaguaauagcaacugucggaauccuaacaaugagcguggaaaccagggcgugaaaggcugggccuucgacaauggggaugacguuuggaugggacgcaccauauccaaggauuuaagaucugguuaugaaacuuuuaaggugaucggcggguggagcacaccaaacucaaaaagucaaauuaauaggcaggucaucguggacuccgauaaccggagcggauacucuggcaucuucucaguagaggguaagaguugcauuaaucgauguuuuuauguugagcugauacgcgggagaaaacaggaaaccagggugugguggacgagcaacuccaucgucguguucugcggcaccucuggaacauacggcacugggucguggcccgacggagcgaauauuaacuuuaugccuaucuga

SEQ ID NO: 141485 - RNA, 1410 nt, Artificial Sequence; identical to SEQ ID NO: 138524
  derived and/or modified sequence opt3 from neuraminidase__InfluenzaA__ADM13472

SEQ ID NO: 141486 - RNA, 1410 nt, Artificial Sequence; identical to SEQ ID NO: 136111
  derived and/or modified sequence opt3 from neuraminidase__InfluenzaA__ADM13473

SEQ ID NO: 141487 - RNA, 1410 nt, Artificial Sequence; identical to SEQ ID NO: 138519
  derived and/or modified sequence opt3 from neuraminidase__InfluenzaA__ADM13474

SEQ ID NO: 141488 - RNA, 1410 nt, Artificial Sequence
  derived and/or modified sequence opt3 from neuraminidase__InfluenzaA__ADM14469
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccaugagaauuggcucuaaaggugauguuuuugugaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggucccaucucccuacaacucccguuuugaaucaguggccuggagcgcaagugccugccacgacggcauuaauuggcuuacaauagggaucucuggaccugauaacggugcuguagcaguucugaaguauaauggcauuaucaccgacacgauaaaguccuggagaaacaauauuuugaggacucaagagagcgagugugccugcgugaacgggucguguuucaccgucaugacagauggaccaucugacggccaggcuuccuacaaaaucuuucggaucgaaaaggguaaaauugugaagucaguggagaugaaugcccccaacuaucauuacgaagagugcaguuguuacccugauagcuccgagaucacuugcgucugccgcgacaauuggcacgggucuaacagaccauggguuagcuucaaucagaaccucgaauaucagauuggauacauauguucaggcaucuuuggcgauaauccgaggcccaacgacaaaaccgggaguugcggaccuguguccagcaauggugcgaacggcguaaagggguucucuuuuaaguauggaaacggcguguggauuggucggacaaaaucaaucaguagccgcaccggguucgagaugaucugggauccaaauggcuggacgggaacugacaacaauuuuuccauuaagcaagacauagucggcaucaacgaauggucuggguacucggggagcuucgugcagcaucccgagcugacaggucuggauuguauucgaccuugcuucuggguugaacucaucagaggcaggccaaaagagaauaccauuuggacuuccgggucaaguaucucuuuuuguggagugaacagcgacacagucggcugguccuggcccgauggugcagaguuaccguucaccauagacaaguga

SEQ ID NO: 141489 - RNA, 1410 nt, Artificial Sequence; identical to SEQ ID NO: 138754
  derived and/or modified sequence opt3 from neuraminidase__InfluenzaA__ADM14479

SEQ ID NO: 141490 - RNA, 1410 nt, Artificial Sequence; identical to SEQ ID NO: 138754
  derived and/or modified sequence opt3 from neuraminidase__InfluenzaA__ADM14499

SEQ ID NO: 141491 - RNA, 1410 nt, Artificial Sequence; identical to SEQ ID NO: 140267
  derived and/or modified sequence opt3 from neuraminidase__InfluenzaA__ADM14518

SEQ ID NO: 141492 - RNA, 1410 nt, Artificial Sequence; identical to SEQ ID NO: 141092
  derived and/or modified sequence opt3 from neuraminidase__InfluenzaA__ADM14527

SEQ ID NO: 141493 - RNA, 1410 nt, Artificial Sequence; identical to SEQ ID NO: 140185
  derived and/or modified sequence opt3 from neuraminidase__InfluenzaA__ADM14537

SEQ ID NO: 141494 - RNA, 1410 nt, Artificial Sequence; identical to SEQ ID NO: 138754
  derived and/or modified sequence opt3 from neuraminidase__InfluenzaA__ADM14546

SEQ ID NO: 141495 - RNA, 1410 nt, Artificial Sequence
  derived and/or modified sequence opt3 from neuraminidase__InfluenzaA__ADM14555
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuucgguauggaaacggcguguggaucggucgcacaaagucaaucaguagccgaaauggguucgagaugauuugggauccaaacggcuggaccggaacggacaauaacuuuuccauaaaacaagacaucgucggcauuaaugaauggucuggguacucggggagcuucgugcagcaucccgagcugacuggucuggauuguaucagaccuugcuucuggguugaacucauuaggggccggccaaaggagaacacaaucuggaccuccgggucaaguauaucuuuuuguggagugaauagcgacacugucggcugguccuggcccgauggugcagaguuaccguucacaaucgacaaauga

SEQ ID NO: 141496 - RNA, 1410 nt, Artificial Sequence; identical to SEQ ID NO: 138754
  derived and/or modified sequence opt3 from neuraminidase__InfluenzaA__ADM14573

SEQ ID NO: 141497 - RNA, 1410 nt, Artificial Sequence; identical to SEQ ID NO: 138754
  derived and/or modified sequence opt3 from neuraminidase__InfluenzaA__ADM14582

SEQ ID NO: 141498 - RNA, 1410 nt, Artificial Sequence; identical to SEQ ID NO: 138754
  derived and/or modified sequence opt3 from neuraminidase__InfluenzaA__ADM14591

SEQ ID NO: 141499 - RNA, 1410 nt, Artificial Sequence
  derived and/or modified sequence opt3 from neuraminidase__InfluenzaA__ADM14601
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugaacgggugggcgauauacagcaaggacaauaguguuagaauuggcuccaaaggugauguguuugucaucagggagccauucauuucuuguagcccguuagaaugccggaccuuuuuccugacacagggggcucuacucaacgacaagcauuccaacggaaccaucaaagaucgcucacccuaucgaacucugaugaguuguccuaucggcgaggugccaagccccuacaauucucguuuugaauccguagccuggucagcaagcgccugccacgacggcauuaacuggcuuacaauagggaucaguggaccugauaauggugcuguugcagugcugaaguauaacggcauuaucaccgacacgauaaagucuuggagaaauaacauuuugaggacucaagaguccgagugugccugcgucaaugggagcuguuucaccgugaugacagauggaccaucggacggccaggcuucuuacaaaaucuuucggaucgaaaaggguaaaauugugaaguccgucgagaugaacgcccccaauuaucauuacgaagagugcucauguuacccugauaguagcgagaucacuugcguuugccgcgacaacuggcacggguccaauagaccaugggugucuuucaaccagaaucucgaauaucagauuggauacauauguagcggcaucuuuggcgauaacccgaggcccaaugacaaaaccgggucaugcggaccuguaaguuccaacggugcgaacggcgugaagggguucagcuuuaaguauggaaauggcgucuggauuggucggacaaaaucuaucucaagucgcaacggguucgagaugaucugggauccaaauggcuggaccggaacggacaacaauuuuagcauuaagcaagacauagugggcaucaacgaaugguccggguacucuggaucguucguucagcaucccgagcugacuggucuggauuguauucgaccuugcuucuggguggaacucaucagaggcaggccaaaagagaauacaauuuggaccagcggguccucaaucaguuuuuguggagucaacucugacacugugggcuggagcuggcccgauggugcagaguuaccguucacaauagacaaguga

SEQ ID NO: 141500 - RNA, 1410 nt, Artificial Sequence
  derived and/or modified sequence opt3 from neuraminidase__InfluenzaA__ADM14611
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacugucggggaauagcagcuugugcccugugaguggaugggccauauacuccaaggacaacucuauuagaaucggcagcaaaggugauguuuuugugauuagggagccauucaucuccuguucaccguuagaaugccggaccuuuuuccugacacagggggcgcuacucaaugacaagcauaguaacggaaccaucaaagaucgcagccccuaucgaacucugaugucuuguccuauuggcgaggucccaucccccuacaacucacguuuugaaagcguggcuuggagugccucugcaugccacgacggcauaaauuggcuuacaaucgggauuuccggaccugauaacggugccguagcuguucugaaguauaauggcaucauaaccgacacgauuaagagcuggagaaacaauaucuugaggacucaagagucggagugugcaugcgugaacgggucuuguuucaccgucaugacagauggaccauccgacggccaggccucauacaaaaucuuucggauugaaaaggguaaaaucgugaagaguguggagaugaaugcucccaacuaucauuacgaagagugcagcuguuacccugauuccucugagauuacuugcgucugccgcgacaauuggcacgggagcaacagaccauggguuucauucaaucagaaccucgaauaucagauaggauacaucuguaguggcauuuuuggcgauaauccgaggcccaacgacaaaaccggguccugcggaccugugagcucuaauggugccaacggcguaaagggguucucauuuaaguauggaaacggcguguggaucggucggacaaaaaguaucagcucccgcaauggguucgagaugauuugggauccaaacggcuggaccggaacggacaauaacuuuucuauaaagcaagacaucgucggcauuaaugaauggucgggguacagcggauccuucgugcagcaucccgagcugacuggucuggauuguauccgaccuugcuucuggguugaacucauuagaggcaggccaaaagagaacacaaucuggaccucagggaguucuauaucauuuuguggagucaauuccgacacugugggcuggucauggcccgauggugcggaguuaccguucacaaucgacaaguga

SEQ ID NO: 141501 - RNA, 1410 nt, Artificial Sequence; identical to SEQ ID NO: 138754
  derived and/or modified sequence opt3 from neuraminidase__InfluenzaA__ADM14620

SEQ ID NO: 141502 - RNA, 1410 nt, Artificial Sequence; identical to SEQ ID NO: 138754
  derived and/or modified sequence opt3 from neuraminidase__InfluenzaA__ADM14629

SEQ ID NO: 141503 - RNA, 1410 nt, Artificial Sequence; identical to SEQ ID NO: 138754
  derived and/or modified sequence opt3 from neuraminidase__InfluenzaA__ADM14639

SEQ ID NO: 141504 - RNA, 1410 nt, Artificial Sequence; identical to SEQ ID NO: 138754
  derived and/or modified sequence opt3 from neuraminidase__InfluenzaA__ADM14657

SEQ ID NO: 141505 - RNA, 1410 nt, Artificial Sequence; identical to SEQ ID NO: 138754
  derived and/or modified sequence opt3 from neuraminidase__InfluenzaA__ADM14666

SEQ ID NO: 141506 - RNA, 1410 nt, Artificial Sequence; identical to SEQ ID NO: 138754
  derived and/or modified sequence opt3 from neuraminidase__InfluenzaA__ADM14684

SEQ ID NO: 141507 - RNA, 1410 nt, Artificial Sequence
  derived and/or modified sequence opt3 from neuraminidase__InfluenzaA__ADM14693
augaaccccaaucagaagaugaucaccauuggcagcgugugcaugacaauagggauggccaaccugauccuccaaauuggaaauaucauuuccaucuggauaucucacucaauccagcuugguaaccagaaucagauugagacuuguaaccaaagugucaucacguacgaaaauaacaccuggguuaaucagacauaugugaacauuagcaauacuaacuucgcugcaggccaguccguagugucugucaaacuggccggaaauucgucauugugcccugugagcggaugggcgaucuacaguaaggacaacuccauaagaauuggcucuaaaggugauguuuuugugaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggucccaucucccuacaacucccguuuugaaucaguggccuggagcgcaagugccugccacgacggcauuaauuggcuuacaauagggaucucuggaccugauaacggugcuguagcaguucugaaguauaauggcauuaucaccgacacgauaaaguccuggagaaacaauauuuugaggacucaagagagcgagugugccugcgugaacgggucguguuucaccgucaugacagauggaccaucugacggccaggcuuccuacaaaaucuuucggaucgaaaaggguaaaauugugaagucaguggagaugaaugcccccaacuaucauuacgaagagugcaguuguuacccugauagcuccgagaucacuugcgucugccgcgacaauuggcacgggucuaacagaccauggguuagcuucaaucagaaccucgaauaucagauuggauacauauguucaggcaucuuuggcgauaauccgaggcccaacgacaaaaccgggaguugcggaccuguguccagcaauggugcgaacggcguaaagggguucucuuuuaaguauggaaacggcguguggauuggucggacaaaaucaaucaguagccgcaauggguucgagaugaucugggauccaaacggcuggaccggaacggacaauaacuuuuccauuaagcaagacauagucggcaucaaugaauggucuggguacucggggagcuucgugcagcaucccgagcugacuggucuggauuguauucgaccuugcuucuggguugaacucaucagaggcaggccaaaagagaacacaauuuggaccuccgggucaaguaucucuuuuuguggagugaauagcgacacugucggcugguccuggcccgauggugcagaguuaccguucacaauagacaaguga

SEQ ID NO: 141508 - RNA, 1410 nt, Artificial Sequence
  derived and/or modified sequence opt3 from neuraminidase__InfluenzaA__ADM14702
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguucccauuuagaaugccggaccuuuuuccugacacagggggcucuacucaaugacaagcacucaaacggaaccaucaaagaucgcaguccguaucgaacucugaugagcugucccauuggcgaggucccuucuccauacaacucccguuuugaaucaguggccuggagcgcaagugccugccaugacggcauaaauuggcuuacaaucgggauuucuggacccgauaacggugcuguagcaguucugaaguauaauggcaucauaaccgacacgauuaaguccuggagaaacaauaucuugaggacucaagagagcgagugugccugcgugaacgggucguguuucaccgucaugacagauggaccuucugacggccaggcuuccuacaaaaucuuucggauugaaaaggguaaaaucgugaagucaguggagaugaaugccccaaacuaucacuacgaagagugcaguuguuaccccgauagcuccgagauuacuugcgucugccgcgacaauuggcaugggucuaacagaccuuggguuagcuucaaucagaaccucgaauaucagauaggauacaucuguucaggcauuuuuggcgauaauccaaggccgaacgacaaaaccgggaguugcggacccguguccagcaauggugcgaacggcguaaagggguucucuuuuaaguauggaaacggcgcauggaucggucggacaaaaucaaccaguagccgcaauggguucgagaugaucugggauccuaacggcuggacgggaacugacaauaacuuuuccauuaagcaagacauagugggcaucaaugaauggucuggguacucggggagcuucguccagcacccagagcugacaggucuggauuguauucgacccugcuucuggguggaacucaucagaggcaggccuaaagagaacaccauuuggacuuccgggucaaguaucucuuuuuguggaguuaauagcgacacagugggcugguccuggccagauggugccgaguuacccuucaccauagacaaguga

SEQ ID NO: 141509 - RNA, 1410 nt, Artificial Sequence; identical to SEQ ID NO: 140656
  derived and/or modified sequence opt3 from neuraminidase__InfluenzaA__ADM14711

SEQ ID NO: 141510 - RNA, 1410 nt, Artificial Sequence
  derived and/or modified sequence opt3 from neuraminidase__InfluenzaA__ADM14720
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcguguuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacaauaacuuuuccauuaagcaagacauagugggcaucaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcagaguuaccguucacaauagacaaguga

SEQ ID NO: 141511 - RNA, 1410 nt, Artificial Sequence
  derived and/or modified sequence opt3 from neuraminidase__InfluenzaA__ADM14730
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaaguauuaucacguacgaaaauaacaccugggucaaucagacauauguuaacauaagcaauacuaacuucgcugcaggccaguccgugguaucugugaaacuggccgggaauagcucauugugcccugucagcggaugggcgguguacaguaaggacaacuccauuagaaucggcucuaaaggugauguuuuagugauuagggagccauuuaucagcuguuccccgcuggaaugccggaccuucuuucuaacacagggggcucuccugaaugacaagcauucaaacggaaccaucaaagaucgcagucccuaucgaacucuuaugagcuguccuauuggcgaggucccaucucccuacaacucccguuucgaaucaguggccuggagcgcaagugccugccacgacggcauaaauuggcugacaaucgggauuucuggaccugauaacggugcuguagcaguuuugaaguauaauggcaucauaaccgacacgauuaaguccuggagaaacaauauccucaggacucaagagagcgagugugccugcgugaacgggucguguuuuaccgucaugacagauggaccaucugacggccaggcuuccuacaaaaucuuccggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuuuaaucagaaccuggaauaucagauaggauacaucuguucaggcauuuucggcgauaauccgaggcccaacgacaaaaccgggaguugcggaccuguguccagcaauggugcgaacggcguaaagggguuuucuuucaaguauggaaacggcguguggaucggucggacaaaaucaaucaguagccgcuccggguuugagaugauuugggauccaaauggcuggaccggaacggacaacaauuucucuauaaagcaagacaucgucggcauuaacgaauggucgggguacagcggauccuuugugcagcaucccgagcugacuggucucgauuguauccgaccuugcuucuggguugaauuaauuagaggcaggccaaaagagaauacaaucuggaccucagggaguucuauaucguucuguggagugaacuccgacacugucggcuggucauggcccgauggugcagagcugccguuuacaaucgacaaguga

SEQ ID NO: 141512 - RNA, 1350 nt, Artificial Sequence
  derived and/or modified sequence opt3 from neuraminidase__InfluenzaA__ADM14748
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucuguaggaccuuuuucuuaacacagggcgcucugcuaaaugauaaacauucuaacgguaccauuaaggaccggagcccauaucgcacucucauguccugcccgaucggggagguucccucaccuuacaacagucgauuugaaagcguggccuggucugcauccgccugucacgauggaaucaauuggcugacaauuggcauaucaggcccagacaacggggcugucgcagugcuuaaauauaauggaaucauuaccgauacgaucaagagcuggcguaacaauauacugagaacucaagagagugaaugcgccuguguaaacgguucuugcuucaccguuaugacagacggccccuccgaugggcaggcuagcuacaagauuuuuaggaucgagaaaggaaagaucgugaaaucggucgagaugaaugccccuaacuaucauuacgaagaguguucuugcuacccagacuccucagaaauuacuugugugugccgggauaauuggcacggcaguaaccgccccugggugagcuucaaucagaacuuggaguaucagaucgguuacauuugcuccgggauauuuggagacaauccuagaccaaacgauaagaccggcucuuguggcccggucagcucaaauggggcgaacggaguuaaagguuucaguuuuaaguauggcaacgggguguggaucggaaggacaaaguccauuagcucucggaauggcuucgagaugaucugggaccccaacgguuggaccgggacggauaauaacuuuucaaucaaacaagacauuguaggcauaaaugaauggaguggauacagcggcuccuucgugcagcauccugagcucacugggcuggacugcauccgcccauguuuuugggucgaacugauucgaggaagacccaaggagaacacaaucuggaccucugguucgagcauuuccuucugcggcguuaauucagauacugugggguggaguuggccugacggagcagaacucccauucacaaucgauaaauga

SEQ ID NO: 141513 - RNA, 1410 nt, Artificial Sequence
  derived and/or modified sequence opt3 from neuraminidase__InfluenzaA__ADM14758
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagauuaaugcccccaacuaucauuacgaagagugcaguuguuacccugauagcuccgagauaacuugcgucugccgcgacaauuggcacgggucuaacagaccauggguuagcuucaaucagaaccucgaauaucagaucggauacauuuguucaggcaucuuuggcgauaauccgaggcccaacgacaaaaccgggaguugcggaccuguguccagcaauggugcgaacggcguaaagggguucucuuuuaaguauggaaacggcguguggaucggucggacaaaaucaauuaguagccgcaauggguucgagaugauaugggauccaaacggcuggaccggaacggacaauaacuuuuccaucaagcaagacauugucggcaucaaugaauggucuggguacucggggagcuucgugcagcaucccgagcugacuggucuggauuguauucgaccuugcuucuggguugaacucaucagaggcaggccaaaagagaacacaauauggaccuccgggucaaguaucucuuuuuguggagugaauagcgacacugucggcugguccuggcccgauggugcagaguuaccguucacaauugacaaguga

SEQ ID NO: 141514 - RNA, 1410 nt, Artificial Sequence; identical to SEQ ID NO: 141513
  derived and/or modified sequence opt3 from neuraminidase__InfluenzaA__ADM14767

SEQ ID NO: 141515 - RNA, 1410 nt, Artificial Sequence; identical to SEQ ID NO: 138754
  derived and/or modified sequence opt3 from neuraminidase__InfluenzaA__ADM14777

SEQ ID NO: 141516 - RNA, 1410 nt, Artificial Sequence; identical to SEQ ID NO: 138754
  derived and/or modified sequence opt3 from neuraminidase__InfluenzaA__ADM14814

SEQ ID NO: 141517 - RNA, 1410 nt, Artificial Sequence; identical to SEQ ID NO: 138754
  derived and/or modified sequence opt3 from neuraminidase__InfluenzaA__ADM14823

SEQ ID NO: 141518 - RNA, 1410 nt, Artificial Sequence; identical to SEQ ID NO: 140377
  derived and/or modified sequence opt3 from neuraminidase__InfluenzaA__ADM14841

SEQ ID NO: 141519 - RNA, 1410 nt, Artificial Sequence; identical to SEQ ID NO: 140377
  derived and/or modified sequence opt3 from neuraminidase__InfluenzaA__ADM14859

SEQ ID NO: 141520 - RNA, 1410 nt, Artificial Sequence; identical to SEQ ID NO: 139891
  derived and/or modified sequence opt3 from neuraminidase__InfluenzaA__ADM14868

SEQ ID NO: 141521 - RNA, 1410 nt, Artificial Sequence; identical to SEQ ID NO: 140377
  derived and/or modified sequence opt3 from neuraminidase__InfluenzaA__ADM14878

SEQ ID NO: 141522 - RNA, 1410 nt, Artificial Sequence; identical to SEQ ID NO: 138754
  derived and/or modified sequence opt3 from neuraminidase__InfluenzaA__ADM14887

SEQ ID NO: 141523 - RNA, 1410 nt, Artificial Sequence
  derived and/or modified sequence opt3 from neuraminidase__InfluenzaA__ADM14896
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuagugauuagggagccauuuaucagcuguuccccgcuggaaugccggaccuucuuucuaacacagggggcucuccugaaugacaagcauucaaacggaaccaucaaagaucgcagucccuaucgaacucuuaugagcuguccuauuggcgaggucccaucucccuacaacucccguuucgaaucaguggccuggagcgcaagugccugccacgacggcauaaauuggcugacaaucgggauuucuggaccugauaacggugcuguagcaguuuugaaguauaauggcaucauaaccgacacgauuaaguccuggagaaacaauauccucaggacucaagagagcgagugugccugcgugaacgggucguguuuuaccgucaugacagauggaccaucugacggccaggcuuccuacaaaaucuuccggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuuuaaucagaaccuggaauaucagauaggauacaucuguucaggcauuuucggcgauaauccgaggcccaacgacaaaaccgggaguugcggaccuguguccagcaauggugcgaacggcguaaagggguuuucuuucaaguauggaaacggcguguggaucggucggacaaaaucaaucaguagccgcaauggguuugagaugauuugggauccaaacggcuggaccggaacggacaauaacuucuccauaaagcaagacaucgucggcauuaaugaauggucuggguacucggggagcuuugugcagcaucccgagcugacuggucucgauuguauccgaccuugcuucuggguugaauuaauuagaggcaggccaaaagagaacacaaucuggaccuccgggucaaguauaucuuucuguggagugaauagcgacacugucggcugguccuggcccgauggugcagagcugccguuuacaaucgacaaguga

SEQ ID NO: 141524 - RNA, 1410 nt, Artificial Sequence; identical to SEQ ID NO: 138754
  derived and/or modified sequence opt3 from neuraminidase__InfluenzaA__ADM14905

SEQ ID NO: 141525 - RNA, 1410 nt, Artificial Sequence; identical to SEQ ID NO: 138754
  derived and/or modified sequence opt3 from neuraminidase__InfluenzaA__ADM14923

SEQ ID NO: 141526 - RNA, 1410 nt, Artificial Sequence; identical to SEQ ID NO: 140042
  derived and/or modified sequence opt3 from neuraminidase__InfluenzaA__ADM14932

SEQ ID NO: 141527 - RNA, 1410 nt, Artificial Sequence; identical to SEQ ID NO: 138754
  derived and/or modified sequence opt3 from neuraminidase__InfluenzaA__ADM14950

SEQ ID NO: 141528 - RNA, 1410 nt, Artificial Sequence; identical to SEQ ID NO: 139772
  derived and/or modified sequence opt3 from neuraminidase__InfluenzaA__ADM14959

SEQ ID NO: 141529 - RNA, 1410 nt, Artificial Sequence
  derived and/or modified sequence opt3 from neuraminidase__InfluenzaA__ADM14977
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugaacgggugggcgauauacagcaaggacaauaguguuagaauuggcuccaaaggugauguguuugucaucagggagccauucauuucuuguagcccguuagaaugccggaccuuuuuccugacacagggggcucuacucaacgacaagcauuccaacggaaccaucaaagaucgcucacccuaucgaacucugaugaguuguccuaucggcgaggugccaagccccuacaauucucguuuugaauccguagccuggucagcaagcgccugccacgacggcauuaacuggcuuacaauagggaucaguggaccugauaauggugcuguugcagugcugaaguauaacggcauuaucaccgacacgauaaagucuuggagaaauaacauuuugaggacucaagaguccgagugugccugcgucaaugggagcuguuucaccgugaugacagauggaccaucgaacggccaggcuucuuacaaaaucuuucggaucgaaaaggguaaaauugugaaguccgucgagaugaaugcccccaacuaucauuacgaagagugcucauguuacccugacaguagcgagaucacuugcguuugccgcgauaauuggcacggguccaacagaccaugggugucuuucaaucagaaccucgaauaucagauuggauacauauguagcggcaucuuuggcgacaauccgaggcccaacgauaaaaccgggucaugcggaccuguaaguuccaacggugcgaauggcgugaagggguucagcuuuaaguauggaaacggcgucuggauuggucggacaaaaucuaucucaagucgcaauggguucgagaugaucugggacccaaacggcuggaccggaacggauaauaacuuuagcauuaagcaagacauagugggcaucaaugaaugguccggguacucuggaucguucguucagcaucccgagcugacuggucuggacuguauucgaccuugcuucuggguggaacucaucagaggcaggccaaaagagaacacaauuuggaccagcggguccucaaucaguuuuuguggagucaauucugauacugugggcuggagcuggcccgacggugcagaguuaccguucacaauagauaaguga

SEQ ID NO: 141530 - RNA, 1410 nt, Artificial Sequence; identical to SEQ ID NO: 140377
  derived and/or modified sequence opt3 from neuraminidase__InfluenzaA__ADM14987

SEQ ID NO: 141531 - RNA, 1410 nt, Artificial Sequence; identical to SEQ ID NO: 139921
  derived and/or modified sequence opt3 from neuraminidase__InfluenzaA__ADM26787

SEQ ID NO: 141532 - RNA, 1410 nt, Artificial Sequence; identical to SEQ ID NO: 140500
  derived and/or modified sequence opt3 from neuraminidase__InfluenzaA__ADM26798

SEQ ID NO: 141533 - RNA, 1410 nt, Artificial Sequence
  derived and/or modified sequence opt3 from neuraminidase__InfluenzaA__ADM26809
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacugucaauaacgugcauucaaauaacaccguucgagaucguacaccauauagaacucuccugaugaaugaacuuggagugcccuuucaccugggcaccaagcaggucugcauugcuuggagcaguuccucuugucaugacgguaaagccugguugcacgugugcaucacaggggaugacaagaacgcaaccgccagcuucaucuacaauggaaggcucguagauuccguugugucauggaguaaagagauucugcggacgcaggaaagcgagugugucugcauaaacggcacuuguacaguggugaugaccgacggcucugcuuccgggaaggcagauacuaaaauccuguuuauugaggaaggaaagaucguccauacaucaacccucagcgguagugcccaacacguugaggaaugcucuugcuauccucgcuacccaggcgugagauguguaugcagggacaacuggaagggguccaaucggccgauaguggauauuaacaucaaagaccacagcaucgucucgucuuacguguguuccggauuaguuggcgacacgccccgcaagaaugauucaaguagcuccucucauugccuggacccuaacaaugaggaaggugggcacggagugaaaggcugggcuuucgaugacggcaacgaugucuggauggggcgaaccauuagcgagaagucaagacuuggauaugagacauuuaaagugaucgaagguuggaguaaucauaaguccaaauugcagauuaacaggcagguaauaguugaccggggcaaucguagcggguacucuggaaucuucucaguggagggcaagaguuguauuaaccgcugcuuuuaugucgaacugaucagagguaggaaggaggaaacugaggugcuauggaccagcaauuccaucgucguguucugugggacaucuggcacuuacggaaccggcucguggccagauggggccgaccucaaccugaugcccauuuga

SEQ ID NO: 141534 - RNA, 1410 nt, Artificial Sequence
  derived and/or modified sequence opt3 from neuraminidase__InfluenzaA__ADM26820
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuaaugagacaagcagauugggauaugagacuuuuaaggucaucgaagguuggucaaacccaaaaaguaagcugcagauuaauaggcaagugauaguagaccggggcaaccguuccggguacagcggaaucuucucuguugagggcaaaucauguauuaaucgcugcuuuuauguggaacuaaucagagguaggaaggaggaaaccgagguccucuggacaaguaacagcaucguggucuucugugggacuuccggcaccuacggaacaggcucuuggcccgauggggccgaccugaaucuuaugccuauuuga

SEQ ID NO: 141535 - RNA, 1350 nt, Artificial Sequence
  derived and/or modified sequence opt3 from neuraminidase__InfluenzaA__ADM31427
augaaccccaaucagaagaucauuaccauaggcagcgugugcaugaucauugggaucgucucccugaugcuccaaauuggaaacaugaucucuauauggguuucacacaguauccagacagguaaucagcaucaggccgagccuauuagaaacacuaauuuccuuacggaaaacgcuguggcaagcguaacccuggccggcaauuccucuuuguguccaaucagggggugggcggugcacucgaaagacaacucaauucggaucggaagcaagggcgaugucuuugugauacgcgagccguucauuaguugcucccauauggaaugucgaacauuuuucuuaacucaaggugcucugcuaaaugacaaacacucuaacgggaccguuaaggaucguagcccccauagaacacucauguccugcccugugggagaggccccaucacccuacaauaguagguuugaaagcgucgcauggucugccuccgcuugucacgacggcaucucauggcugaccauuggcaucagcgggccugauaacggagcaguggccguacuuaaauauaaugguaucauuacugacacaauaaagaguuggggcaacaauauccugcggacccaggagucugagugcgcuuguguuaacggguccugcuucacggugaugacugauggaccaagcaacggccaggccucguacaagauuuuuaaaaucgaaaaggguaaagucgugaagucuguggaguugaaugcgcccaacuaucacuacgaagaguguuccugcuauccugacucaggggagauaauuugugucugccgcgauaauuggcauggaaguaacagaccauggguuagcuucaaucagaaccucgaauaccaaaucggcuauaucugcuccggcguguuuggggacaauccgaggcccaacgauggaaccgguucuuguggcccuaugagcccaaauggggcauacggaauuaaaggcuucucauuuaaguacgguaacgggguauggaucggccggacaaagaguacuaauucccgcagcggauucgagaugauuugggaccccaacggcuggaccgggacagauucugaauuuucagugaaacaggacauagucgccaucaccgacuggaguggauauagcgguuccuucgugcagcacccugagcugacgggccuggauugcauucgaccauguuucuggguugaacucaucagagggaggcccaaggagucuacuaucuggacaucgggaagcuccauuucauuuugcggcgugaauagugacaccgucucuuggagcuggccggauggugcugaguuaccuuucacuauagacaaauga

SEQ ID NO: 141536 - RNA, 1410 nt, Artificial Sequence
  derived and/or modified sequence opt3 from neuraminidase__InfluenzaA__ADM31481
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaagggugcuguagcaguucugaaguauaacggcaucauaaccgacacgauuaaauccuggagaaauaacaucuugaggacucaagagagcgagugugccugcgugaaugggucguguuucaccgucaugacagauggaccaucugacggccaggcuuccuacaagaucuuucggauugaaaaagguaagaucgugaaaucaguggagaugaacgcccccaauuaucauuacgaagagugcaguuguuacccugauagcuccgagauuacuugcgucugccgcgacaacuggcacgggucuaauagaccauggguuagcuucaaccagaaucucgaauaucagauaggauacaucuguucaggcauuuuuggcgauaacccgaggcccaaugacaagaccgggaguugcggaccuguguccagcaacggugcgaauggcguaaagggguucucuuuuaaauauggaaacggcguguggaucggucggacaaagucaaucaguagccgcaacggguucgagaugauuugggauccaaauggcuggaccggaacggacaacaauuuuuccauaaaacaagacaucgucggcauuaacgaauggucuggguacucggggagcuucgugcagcaucccgagcugacuggucuggauuguauccgaccuugcuucuggguugaacucauuagaggcaggccaaaggagaauacaaucuggaccuccgggucaaguauaucuuuuuguggagugaacagcgacacugucggcugguccuggcccgauggugcagaguuaccguucacaaucgacaaauga

SEQ ID NO: 141537 - RNA, 1410 nt, Artificial Sequence; identical to SEQ ID NO: 139337
  derived and/or modified sequence opt3 from neuraminidase__InfluenzaA__ADM31491

SEQ ID NO: 141538 - RNA, 1410 nt, Artificial Sequence; identical to SEQ ID NO: 140959
  derived and/or modified sequence opt3 from neuraminidase__InfluenzaA__ADM31501

SEQ ID NO: 141539 - RNA, 1410 nt, Artificial Sequence; identical to SEQ ID NO: 138754
  derived and/or modified sequence opt3 from neuraminidase__InfluenzaA__ADM31511

SEQ ID NO: 141540 - RNA, 1410 nt, Artificial Sequence; identical to SEQ ID NO: 140955
  derived and/or modified sequence opt3 from neuraminidase__InfluenzaA__ADM31521

SEQ ID NO: 141541 - RNA, 1410 nt, Artificial Sequence; identical to SEQ ID NO: 138754
  derived and/or modified sequence opt3 from neuraminidase__InfluenzaA__ADM31531

SEQ ID NO: 141542 - RNA, 1410 nt, Artificial Sequence; identical to SEQ ID NO: 140042
  derived and/or modified sequence opt3 from neuraminidase__InfluenzaA__ADM31541

SEQ ID NO: 141543 - RNA, 1410 nt, Artificial Sequence; identical to SEQ ID NO: 138754
  derived and/or modified sequence opt3 from neuraminidase__InfluenzaA__ADM31551

SEQ ID NO: 141544 - RNA, 1410 nt, Artificial Sequence; identical to SEQ ID NO: 138754
  derived and/or modified sequence opt3 from neuraminidase__InfluenzaA__ADM31561

SEQ ID NO: 141545 - RNA, 1410 nt, Artificial Sequence; identical to SEQ ID NO: 138754
  derived and/or modified sequence opt3 from neuraminidase__InfluenzaA__ADM31571

SEQ ID NO: 141546 - RNA, 1410 nt, Artificial Sequence; identical to SEQ ID NO: 139931
  derived and/or modified sequence opt3 from neuraminidase__InfluenzaA__ADM31581

SEQ ID NO: 141547 - RNA, 1410 nt, Artificial Sequence; identical to SEQ ID NO: 138754
  derived and/or modified sequence opt3 from neuraminidase__InfluenzaA__ADM31601

SEQ ID NO: 141548 - RNA, 1410 nt, Artificial Sequence; identical to SEQ ID NO: 140042
  derived and/or modified sequence opt3 from neuraminidase__InfluenzaA__ADM31611

SEQ ID NO: 141549 - RNA, 1410 nt, Artificial Sequence
  derived and/or modified sequence opt3 from neuraminidase__InfluenzaA__ADM31621
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccucauuagaaugccggaccuuuuuccugacacagggggcucuacucaaugacaagcauaguaacggaaccaucaaagaucgcagcccguaucgaacucugaugucuugucccauuggcgaggucccuuccccauacaacucacguuuugaaagcguggccuggagugcaucugccugccacgacggcauaaauuggcuuacaaucgggauuuccggacccgauaacggugcuguagcaguucugaaguauaauggcaucauaaccgacacgauuaagagcuggagaaacaauaucuugaggacucaagagucggagugugccugcgugaacgggucuuguuucaccgucaugacagauggaccuuccgacggccaggcuucauacaaaaucuuucggauugaaaaggguaaaaucgugaagaguguggagaugaaugccccaaacuaucauuacgaagagugcagcuguuaccccgauuccucugagauuacuugcgucugccgcgacaauuggcacgggagcaacagaccuuggguuucauucaaucagaaccucgaauaucagauaggauacaucuguaguggcauuuuuggcgauaauccaaggccgaacgacaaaaccggguccugcggacccgugagcucuaauggugcgaacggcguaaagggguucucauuuaaguauggaaacggcguguggaucggucggacaaaaaguaucagcucccgcaauggguucgagaugauuugggauccuaacggcuggaccggaacggacaauaacuuuucuauaaagcaagacaucgucggcauuaaugaauggucgggguacagcggauccuucgugcagcauccagagcugacuggucuggauuguauccgacccugcuucuggguugaacucauuagaggcaggccuaaagagaacacaaucuggaccucagggaguucuauaucguuuuguggagucaauuccgacacugugggcuggucauggccagauggugcagaguuacccuucacaaucgacaaguga

SEQ ID NO: 141550 - RNA, 1410 nt, Artificial Sequence; identical to SEQ ID NO: 140042
  derived and/or modified sequence opt3 from neuraminidase__InfluenzaA__ADM31631

SEQ ID NO: 141551 - RNA, 1410 nt, Artificial Sequence; identical to SEQ ID NO: 139931
  derived and/or modified sequence opt3 from neuraminidase__InfluenzaA__ADM31641

SEQ ID NO: 141552 - RNA, 1410 nt, Artificial Sequence; identical to SEQ ID NO: 140216
  derived and/or modified sequence opt3 from neuraminidase__InfluenzaA__ADM31651

SEQ ID NO: 141553 - RNA, 1410 nt, Artificial Sequence; identical to SEQ ID NO: 139931
  derived and/or modified sequence opt3 from neuraminidase__InfluenzaA__ADM31661

SEQ ID NO: 141554 - RNA, 1410 nt, Artificial Sequence
  derived and/or modified sequence opt3 from neuraminidase__InfluenzaA__ADM31671
augaaccccaaucagaagaucauuaccauaggcagcgugugcaugacaaucgggauggccaaccugauucuccaaaucggaaauauuaucuccauauggaucucucacucaacucagcuugguaaccagaaucagauugagacguguaaccaaagugucaucaccuacgaaaauaacacauggguuaaucagacuuaugugaacauuagcaauaccaacuucgcugcaggccaguccguagugucugccaaacuggcgggaaauucgucauugugcccugucagcggaugggcuaucuacaguaaggacaacuccauaagaauuggcucuaaaggugauguguuuguuaucagggagccauucauuagcuguuccccguuagaaugccggacauuuuuccugacccagggggcccuacucaaugacaagcauucaaacggaacuaucaaagaucgcagucccuaucgaacacugaugagcuguccuaucggcgaggugccaucucccuacaacucccguuuugaaucagucgcauggagcgccagugcuugccacgacggcauuaauuggcuuaccauagggaucucuggaccugauaacggugcaguggccguacugaaguauaauggcauuaucacggacacuauaaaguccuggagaaacaauauuuugaggacccaagagagcgagugugcuugcguuaacgggucguguuucacagugaugacugauggaccaucugacggccaggccuccuacaaaaucuuucggaucgaaaaggguaaaauugucaagucaguggagaugaaugcgcccaacuaucauuacgaagagugcaguuguuacccugauagcuccgagauuaccugcgugugccgcgacaauuggcacgggucuaacagaccaugggucagcuucaaucagaaccucgaauaucagaucggauacauauguucaggcaucuuuggcgauaauccgaggcccaacgacaaaacagggaguugcggaccuguuuccagcaauggugcaaacggcgugaagggguucucuuuuaaguauggaaacggcguauggauuggucggaccaaaucaaucaguagccgcaauggguucgagaugaucugggauccaaacggcuggacgggaacugacaauaacuuuuccauuaagcaagacauagugggcaucaaugaauggucuggguacucggggagcuucguccagcaucccgagcugacaggucuggauuguauucgaccuugcuucuggguggaacucaucagaggcaggccaaaagagaacaccauuuggacuuccgggucaaguaucucuuuuuguggaguuaauagcgacacagugggcugguccuggcccgauggugccgaguuaccguucaccauagacaaguga

SEQ ID NO: 141555 - RNA, 1410 nt, Artificial Sequence; identical to SEQ ID NO: 140042
  derived and/or modified sequence opt3 from neuraminidase__InfluenzaA__ADM31681

SEQ ID NO: 141556 - RNA, 1410 nt, Artificial Sequence
  derived and/or modified sequence opt3 from neuraminidase__InfluenzaA__ADM31691
augaaccccaaucagaagauccugaccauuggcagcgugugcaugacaauagggauggccaaccucauccuucaaauuggaaauaucauuuccaucuggauaucucacucaauccagcuggguaaccagaaucagacugagacguguaaccaaagugucauuaccuacgaaaauaacacauggguuaaucagacuuaugugaacaucagcaauaccaacuucgcugcaggccaguccguagugucugucaaauuggccggaaauucgucauuaugcccugugagcggaugggcgauuuacaguaaggacaacuccaucagaauaggcucuaaaggugauguuuuugugauuagggagccauucaucagcuguuccccgcuggaaugccggacauuuuuccuaacccagggggcucuccugaaugacaagcauucaaacggaacuauuaaagaucgcagucccuaucgaacacuuaugagcuguccuaucggcgaggucccaucucccuacaacucccguuuugaaucaguggccuggagcgcaagugccugccacgacggcaucaauuggcugaccauugggauaucuggaccugauaacggugcuguagcaguuuugaaguauaauggcaucauuacggacacuaucaaguccuggagaaacaauauacucaggacccaagagagcgagugugccugcgugaacgggucguguuucacagucaugacugauggaccaucugacggccaggcuuccuacaaaauuuuucggaucgaaaaggguaaaaucgugaagucaguggagaugaaugcccccaacuaucauuacgaagagugcaguuguuacccugauagcuccgagauuaccugcgucugccgcgacaauuggcacgggucuaacagaccauggguuagcuucaaucagaaccuggaauaucagaucggauacauuuguucaggcauauuuggcgauaauccgaggcccaacgacaaaacagggaguugcggaccuguguccagcaauggugcgaacggcguaaagggguucucuuuuaaguauggaaacggcguguggaucggucggaccaaaucaauuaguagccgcaauggguucgagaugaucugggauccaaacggcuggacgggaacugacaauaacuuuuccaucaagcaagacauugucggcauaaaugaauggucuggguacucggggagcuucgugcagcaucccgagcugacaggucucgauuguauccgaccuugcuucuggguugaauuaauuagaggcaggccaaaagagaacaccaucuggacuuccgggucaaguauuucuuuuuguggagugaauagcgacacagucggcugguccuggcccgauggugcagagcugccguucaccaucgacaaguga

SEQ ID NO: 141557 - RNA, 1410 nt, Artificial Sequence; identical to SEQ ID NO: 138754
  derived and/or modified sequence opt3 from neuraminidase__InfluenzaA__ADM31701

SEQ ID NO: 141558 - RNA, 1410 nt, Artificial Sequence; identical to SEQ ID NO: 138754
  derived and/or modified sequence opt3 from neuraminidase__InfluenzaA__ADM31711

SEQ ID NO: 141559 - RNA, 1410 nt, Artificial Sequence; identical to SEQ ID NO: 140042
  derived and/or modified sequence opt3 from neuraminidase__InfluenzaA__ADM31721

SEQ ID NO: 141560 - RNA, 1410 nt, Artificial Sequence
  derived and/or modified sequence opt3 from neuraminidase__InfluenzaA__ADM31731
augaaccccaaucagaagaucauuauaaucggcagcgugugcaugaccauugggauggccaaccugauccuccaaauuggaaauaucauauccaucuggauuucucacucaauccagcuugguaaccagaaucagauugagacauguaaccaaagugucaucacuuacgaaaauaacacguggguuaaucagaccuaugugaacauaagcaauacaaacuucgcugcaggccaguccguagugucugucaaacuggccggaaauucgucauugugcccugugagcggaugggcgauuuacaguaaggacaacuccaucagaauuggcucuaaaggugauguuuuugugaucagggagccauucaucagcuguuccccguuagaaugccggaccuuuuuccugacucagggggcucuacucaaugacaagcauucaaacggaacaauuaaagaucgcagucccuaucgaacccugaugagcuguccuauaggcgaggucccaucucccuacaacucccguuuugaaucaguggccuggagcgcaagugccugccacgacggcaucaauuggcuuacuauugggaucucuggaccugauaacggugcuguagcaguucugaaguauaauggcauaauuacagacaccaucaaguccuggagaaacaauaucuugaggacgcaagagagcgagugugccugcgugaacgggucguguuucacugucaugaccgauggaccaucugacggccaggcuuccuacaaaauuuuucggaucgaaaagggucgcauugugaaaucaguggagaugaaugcccccaacuaucauuacgaagagugcaguuguuacccugauagcuccgagauaacaugcgucugcagagacaauuggcacgggucuaacaggccauggguuagcuucaaucagaaccucgaauaucagaucggauacauuuguucaggcaucuuuggcgauaauccgcggcccaacgacaagacugggaguugcggaccuguguccagcaauggugcgaacggcguaaaaggguucucuuuuaaguauggaaacggcguguggaucggucgcaccaagucaauuaguagccgaaauggguucgagaugauaugggauccaaacggcuggacaggaaccgacaauaacuuuuccaucaaacaagacauugucggcaucaaugaauggucuggguacucggggagcuucgugcagcaucccgagcugacgggucuggauuguauuagaccuugcuucuggguugaacucaucaggggccggccaaaggagaacacuauauggacauccgggucaaguaucucuuuuuguggagugaauagcgacaccgucggcugguccuggcccgauggugcagaguuaccguucacuauugacaaauga

SEQ ID NO: 141561 - RNA, 1410 nt, Artificial Sequence; identical to SEQ ID NO: 141129
  derived and/or modified sequence opt3 from neuraminidase__InfluenzaA__ADM31741

SEQ ID NO: 141562 - RNA, 1410 nt, Artificial Sequence; identical to SEQ ID NO: 138754
  derived and/or modified sequence opt3 from neuraminidase__InfluenzaA__ADM31751

SEQ ID NO: 141563 - RNA, 1410 nt, Artificial Sequence
  derived and/or modified sequence opt3 from neuraminidase__InfluenzaA__ADM31761
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucauaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaaguuuuccauaaaacaggacaucgucggcauuucugaauggucgggguacagcggauccuucgugcaacaccccgagcugacuggucuggauuguauccgaccuugcuucuggguugaacucauuagaggcaggccaaaggagaacacaaucuggaccucagggaguucuauaucguuuuguggagucaauuccgacacugugggcuggucauggcccgauggugcagaguuaccguucacaaucgacaaauga

SEQ ID NO: 141564 - RNA, 1410 nt, Artificial Sequence
  derived and/or modified sequence opt3 from neuraminidase__InfluenzaA__ADM31771
augaaccccaaucagaagauccugaccauuggcagcgugugcaugacaauagggauggccaaccucauccuucaaauuggaaauaucauuuccaucuggauaucucacucaauccagcuggguaaccagaaucagacugagacguguaaccaaagugucauuaucuacgaaaauaacaccuggguuaaucagacauaugugaacauuagcaauacuaacuucgcugcaggccaguccguagugucugucaaauuggccggaaauucgucauuaugcccugugagcggaugggcgaucuacaguaaggacaacuccauaagaauuggcucuaaaggugauguuuuugugaucagggagccauucauuagcuguuccccgcuggaaugccggaccuuuuuccuaacacagggggcucuccugaaugacaagcauucaaacggaaccaucaaagaucgcagucccuaucgaacucuuaugagcuguccuaucggcgaggucccaucucccuacaacucccguuuugaaucaguggccuggagcgcaagugccugccacgacggcauuaauuggcugacaauagggaucucuggaccugauaacggugcuguagcaguuuugaaguauaauggcauuaucaccgacacgauaaaguccuggagaaacaauauucucaggacucaagagagcgagugugccugcgugaacgggucguguuucaccgucaugacagauggaccaucugacggccaggcuuccuacaaaaucuuucggaucgaaaaggguaaaauugugaagucaguggagaugaaugcccccaacuaucauuacgaagagugcaguuguuacccugauagcuccgagaucacuugcgucugccgcgacaauuggcacgggucuaacagaccauggguuagcuucaaucagaaccuggaauaucagauuggauacauauguucaggcaucuuuggcgauaauccgaggcccaacgacaaaaccgggaguugcggaccuguguccagcaauggugcgaacggcguaaagggguucucuuuuaaguauggaaacggcguguggauuggucggacaaaaucaaucaguagccgcaauggguucgagaugaucugggauccaaacggcuggaccggaacggacaauaacuuuuccauuaagcaagacauagucggcaucaaugaauggucuggguacucggggagcuucgugcagcaucccgagcugacuggucucgauuguauucgaccuugcuucuggguugaauuaaucagaggcaggccaaaagagaacacaauuuggaccuccgggucaaguaucucuuuuuguggagugaauagcgacacugucggcugguccuggcccgauggugcagagcugccguucacaauagacaaguga

SEQ ID NO: 141565 - RNA, 1410 nt, Artificial Sequence
  derived and/or modified sequence opt3 from neuraminidase__InfluenzaA__ADM31801
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucaauaacacuaauuucgcugcaggccagagcguaguguccgucaaacuggccgggaacucuucguugugcccugugucaggaugggcgauauacagcaaggacaauaguauuagaaucggcuccaaaggugauguuuuugugauuagggagccauucaucucuuguagcccguuagaaugccggaccuuuuuccugacacagggggcucuacucaacgacaagcauuccaacggaaccaucaaagaucgcucacccuaucgaacucugaugaguuguccuauuggcgaggucccaagccccuacaauucucguuuugaauccguggccuggucagcaagcgccugccacgacggcauaaacuggcuuacaaucgggauuaguggaccugauaauggugcuguagcaguucugaaguauaacggcaucauaaccgacacgauuaagucuuggagaaauaacaucuugaggacucaagaguccgagugugccugcgugaaugggagcuguuucaccgucaugacagauggaccaucggacggccaggcuucuuacaaaaucuuucggauugaaaaggguaaaaucgugaaguccguggagaugaacgcccccaauuaucauuacgaagagugcucauguuacccugauaguagcgagauuacuugcgucugccgcgacaacuggcacggguccaauagaccauggguuucuuucaaccagaaucucgaauaucagauaggauacaucuguagcggcauuuuuggcgauaacccgaggcccaaugacaaaaccgggucaugcggaccugugaguuccaacggugcgaacggcguaaagggguucagcuuuaaguauggaaauggcguguggaucggucggacaaaaucuaucucaagucgcaacggguucgagaugauuugggauccaaauggcuggaccggaacggacaacaaguuuagcauaaaacaagacaucgucggcauuaaugaaugguccggguacucuggaucguucgugcagcaucccgagcugacuggucuggauuguauccgaccuugcuucuggguugaacucauuagaggcaggccaaaggagaacacaaucuggaccagcggguccucaauaaguuuuuguggagucaauucugacacugugggcuggagcuggcccgauggugcagaguuaccguucacaaucgacaaauga

SEQ ID NO: 141566 - RNA, 1410 nt, Artificial Sequence
  derived and/or modified sequence opt3 from neuraminidase__InfluenzaA__ADM31811
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaauuugccggaaauucgucacugugcccugugagcggaugggcgauauacaguaaggacaacuccauuagaaucggcucuaaaggugauguuuucgugauuagggagccauuuaucagcuguuccccguuggaaugccggaccuucuuuuuaacacagggggcucugcuaaaugacaagcauucaaacggaaccaucaaagaucgcagucccuaucgaacucucaugagcuguccuauuggcgaggucccaucucccuacaacucccguuucgaaucaguggccuggagcgcaagugccugccacgacggcauaaauuggcugacaaucgggauuucuggaccugauaacggugcuguagcaguucuuaaguauaauggcaucauaaccgacacgauuaaguccuggagaaacaauauccugaggacucaagagagcgagugugccugcgugaacgggucguguuuuaccgucaugacagauggaccaucugacggccaggcuuccuacaaaaucuuccggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuuuaaucagaacuuggaauaucagauaggauacaucuguucaggcauuuucggcgauaauccgaggcccaacgacaaaaccgggaguugcggaccuguguccagcaauggugcgaacggcguaaagggguuuucuuucaaguauggaaacggcguguggaucggucggacaaaaucaaucaguagccgcaauggguuugagaugauuugggauccaaacggcuggaccggaacggacaauaaguucuccauaaaacaagacaucgucggcauuaacgaauggucuggguacucggggagcuucgugcagcaucccgagcucacuggucuggauuguauccgaccuugcuuuuggguugaacugauuagaggcaggccaaaggagaauacaaucuggaccuccgggucaaguauaucuuucuguggagugaacagcgacacugucggcugguccuggcccgauggugcagagcucccguuuacaaucgacaaauga

SEQ ID NO: 141567 - RNA, 1410 nt, Artificial Sequence; identical to SEQ ID NO: 139931
  derived and/or modified sequence opt3 from neuraminidase__InfluenzaA__ADM31821

SEQ ID NO: 141568 - RNA, 1410 nt, Artificial Sequence; identical to SEQ ID NO: 138754
  derived and/or modified sequence opt3 from neuraminidase__InfluenzaA__ADM31831

SEQ ID NO: 141569 - RNA, 1410 nt, Artificial Sequence; identical to SEQ ID NO: 138754
  derived and/or modified sequence opt3 from neuraminidase__InfluenzaA__ADM31841

SEQ ID NO: 141570 - RNA, 1410 nt, Artificial Sequence
  derived and/or modified sequence opt3 from neuraminidase__InfluenzaA__ADM31851
augaaccccaaucagaagauccugaccauuggcagcgugugcaugacaauagggauggccaaccucauccuucaaauuggaaauaucauuuccaucuggauaucucacucaauccagcuggguaaccagaaucagacugagacguguaaccaaagugucauuaccuacgaaaauaacacauggguuaaucagacuuaugugaacaucagcaauaccaacuucgcugcaggccaguccguagugucugucaaauuggccggaaauucgucauuaugcccugugagcggaugggcgauuuacaguaaggacaacuccaucagaauaggcucuaaaggugauguuuuugugauuagggagccauucaucagcuguuccccgcuggaaugccggacauuuuuccuaacccagggggcucuccugaaugacaagcauucaaacggaacuauuaaagaucgcagucccuaucgaacacuuaugagcuguccuaucggcgaggucccaucucccuacaacucccguuuugaaucaguggccuggagcgcaagugccugccacgacggcaucaauuggcugaccauugggauaucuggaccugauaacggugcuguagcaguuuugaaguauaauggcaucauuacggacacuaucaaguccuggagaaacaauauacucaggacccaagagagcgagugugccugcgugaacgggucguguuucacagucaugacugauggaccaucugacggccaggcuuccuacaaaauuuuucggaucgaacgcgguaagaucgugaaaucaguggagaugaaugcccccaacuaucauuacgaagagugcaguuguuacccugauagcuccgagauuaccugcgucugcagagacaauuggcacgggucuaacaggccauggguuagcuucaaucagaaccuggaauaucagaucggauacauuuguucaggcauauuuggcgauaauccgcggcccaacgacaagacagggaguugcggaccuguguccagcaauggugcgaacggcguaaaaggguucucuuuuaaguauggaaacggcguguggaucggucgcaccaagucaauuaguagccgaaauggguucgagaugaucugggauccaaacggcuggacgggaacugacaauaacuuuuccaucaaacaagacauugucggcauaaaugaauggucuggguacucggggagcuucgugcagcaucccgagcugacaggucucgauuguaucagaccuugcuucuggguugaauuaauuaggggccggccaaaggagaacaccaucuggacuuccgggucaaguauuucuuuuuguggagugaauagcgacacagucggcugguccuggcccgauggugcagagcugccguucaccaucgacaaauga

SEQ ID NO: 141571 - RNA, 1410 nt, Artificial Sequence; identical to SEQ ID NO: 138754
  derived and/or modified sequence opt3 from neuraminidase__InfluenzaA__ADM31861

SEQ ID NO: 141572 - RNA, 1410 nt, Artificial Sequence; identical to SEQ ID NO: 138754
  derived and/or modified sequence opt3 from neuraminidase__InfluenzaA__ADM31871

SEQ ID NO: 141573 - RNA, 1410 nt, Artificial Sequence
  derived and/or modified sequence opt3 from neuraminidase__InfluenzaA__ADM31881
augaaccccaaucagaagaucauuaccauaggcagcgugugcaugacaaucgggauggccaaccugauucuccaaaucggaaauacuauuuccaucuggauaucucacucaauccagcuugguaaccagaaucagauugagacguguaaccaaagugucaucaccuacgaaaauaacacauggguuaaucagacuuaugugaacauuagcaauaccaacuucgcugcaggccaguccguagugucugucaaacuggccggaaauucgucauugugcccugugagcggaugggcgaucuacaguaaggacaacuccauaagaauuggcucuaaaggugauguuuuugugaucagggagccauucauuagcuguuccccguuagaaugccggacauuuuuccugacccagggggcucuacucaaugacaagcauucaaacggaacuaucaaagaucgcagucccuaucgaacacugaugagcuguccuaucggcgaggucccaucucccuacaacucccguuuugaaucaguggccuggagcgcaagugccugccacgacggcauuaauuggcuuaccauagggaucucuggaccugauaacggugcuguagcaguucugaaguauaauggcauuaucacggacacuauaaaguccuggagaaacaauauuuugaggacccaagagagcgagugugccugcgugaacgggucguguuucacagucaugacugauggaccaucugacggccaggcuuccuacaaaaucuuucggaucgaaaaggguaaaauugugaagucaguggagaugaaugcccccaacuaucauuacgaagagugcaguuguuacccugauagcuccgagauuaccugcgucugccgcgacaauuggcacgggucuaacagaccauggguuagcuucaaucagaaccucgaauaucagaucggauacauauguucaggcaucuuuggcgauaauccgaggcccaacgacaaaacagggaguugcggaccuguguccagcaauggugcgaacggcguaaagggguucucuuuuaaguauggaaacggcguguggauuggucggaccaaaucaaucaguagccgcaauggguucgagaugaucugggauccaaacggcuggacgggaacugacaauaacuuuuccauuaagcaagacauagucggcaucaaugaauggucuggguacucggggagcuucgugcagcaucccgagcugacaggucuggauuguauucgaccuugcuucuggguugaacucaucagaggcaggccaaaagagaacaccauuuggacuuccgggucaaguaucucuuuuuguggagugaauagcgacacagucggcugguccuggcccgauggugcagaguuaccguucaccauagacaaguga

SEQ ID NO: 141574 - RNA, 1410 nt, Artificial Sequence; identical to SEQ ID NO: 138754
  derived and/or modified sequence opt3 from neuraminidase__InfluenzaA__ADM31891

SEQ ID NO: 141575 - RNA, 1410 nt, Artificial Sequence; identical to SEQ ID NO: 138744
  derived and/or modified sequence opt3 from neuraminidase__InfluenzaA__ADM31901

SEQ ID NO: 141576 - RNA, 1410 nt, Artificial Sequence; identical to SEQ ID NO: 139977
  derived and/or modified sequence opt3 from neuraminidase__InfluenzaA__ADM31911

SEQ ID NO: 141577 - RNA, 1410 nt, Artificial Sequence; identical to SEQ ID NO: 139977
  derived and/or modified sequence opt3 from neuraminidase__InfluenzaA__ADM31921

SEQ ID NO: 141578 - RNA, 1410 nt, Artificial Sequence; identical to SEQ ID NO: 140435
  derived and/or modified sequence opt3 from neuraminidase__InfluenzaA__ADM31931

SEQ ID NO: 141579 - RNA, 1410 nt, Artificial Sequence; identical to SEQ ID NO: 138744
  derived and/or modified sequence opt3 from neuraminidase__InfluenzaA__ADM31941

SEQ ID NO: 141580 - RNA, 1410 nt, Artificial Sequence; identical to SEQ ID NO: 140435
  derived and/or modified sequence opt3 from neuraminidase__InfluenzaA__ADM31951

SEQ ID NO: 141581 - RNA, 1410 nt, Artificial Sequence
  derived and/or modified sequence opt3 from neuraminidase__InfluenzaA__ADM31961
augaaccccaaucagaagaucauuaccauaggcagcgugugcauggccaucgggauggcuaaccugauucuccaaaucggaaauauuaucuccauauggaucucucacucaauucagcuugguaaccagaaucagaucgagacauguaaccaaagugucauuacuuacgaaaauaacacguggguuaaucagaccuaugugaacaucagcaauacaaacuucgcagccggccaguccguagugucugucaaacuggcgggaaauucgucauugugcccugugagcggaugggcuauauacaguaaggacaacuccauuagaaucggcucuaaaggugauguuuuugugauuagggagccauucaucagcuguuccccguuagaaugccggaccuuuuuccugacucagggggcccuacucaaugacaagcauucaaacggaacaaucaaagaucgcagucccuaucgaacccugaugagcuguccuauuggcgaggucccaucucccuacaacucccguuuugaaucaguggcauggagcgccagugcuugccacgacggcauaaauuggcuuacuaucgggauuucuggaccugauaacggugcaguagccguucugaaguauaauggcaucauaacagacaccauuaaguccuggagaaacaauaucuugaggacgcaagagagcgagugugcuugcgugaacgggucguguuucacugucaugaccgauggaccaucugacggccaggccuccuacaaaaucuuucggauugaaaaggguaaaaucgugaagucaguggagaugaaugcgcccaacuaucauuacgaagagugcaguuguuacccugauagcuccgagauuacaugcgucugccgcgacaauuggcacgggucuaacagaccauggguuagcuucaaucagaaccucgaauaucagauaggauacaucuguucaggcauuuuuggcgauaauccgaggcccaacgacaaaacugggaguugcggaccuguguccagcaauggugcaaacggcguaaagggguucucuuuuaaguauggaaacggcguguggaucggucggaccaaaucaaucaguagccgcaauggguucgagaugauuugggauccaaacggcuggacaggaaccgacaauaacuuuuccauaaagcaagacaucgucggcauuaaugaauggucuggguacucggggagcuucgugcagcaucccgagcugacgggucuggauuguauccgaccuugcuucuggguugaacucauuagaggcaggccaaaagagaacacuaucuggacauccgggucaaguauaucuuuuuguggagugaauagcgacaccgucggcugguccuggcccgauggugccgaguuaccguucacuaucgacaaguga

SEQ ID NO: 141582 - RNA, 1410 nt, Artificial Sequence
  derived and/or modified sequence opt3 from neuraminidase__InfluenzaA__ADM31971
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucuaugaaacuggccggaaauucgucauugugcccugucagcggaugggcgauauacaguaaggacaacuccgugagaauuggcucuaaaggugauguuuuugugaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggucccaucucccuacaacucccguuuugaaucaguggccuggagcgcaagugccugccacgacggcauuaauuggcuuacaauagggaucucuggaccugauaacggugcuguagcaguucugaaguauaauggcgugauuaccgacacgaucaaguccuggagaaacaauauauugaggacucaagagagcgagugugccugcgucaacgggucguguuucaccgugaugacagauggaccaucuaauggccaggcuuccuacaaaauuuuucggaucgaaaaggguaaaaucgugaagucagucgagaugaacgcccccaauuaucauuacgaagagugcaguuguuacccugacagcuccgagauuacuugcguuugccgcgauaacuggcacgggucuaauagaccaugggugagcuucaaccagaaucucgaauaucagaucggauacauuuguucaggcauauuuggcgacaacccgaggcccaaugauaaaaccgggaguugcggaccuguauccagcaacggugcgaacggcgugaagggguucucuuuuaaguauggaaauggcgucuggaucggucggacaaaaucaauuaguagccgcaacggguucgagaugaucugggacccaaauggcuggaccggaacggauaacaauuuuuccaucaagcaagacauugugggcauaaacgaauggucuggguacucggggagcuucguucagcaucccgagcugacuggucuggacuguauccgaccuugcuucuggguggaacucauuagaggcaggccaaaagagaauacaaucuggaccuccgggucaaguauuucuuuuuguggagucaacagcgauacugugggcugguccuggcccgacggugcagaguuaccguucacaaucgauaaguga

SEQ ID NO: 141583 - RNA, 1410 nt, Artificial Sequence; identical to SEQ ID NO: 139977
  derived and/or modified sequence opt3 from neuraminidase__InfluenzaA__ADM31981

SEQ ID NO: 141584 - RNA, 1410 nt, Artificial Sequence; identical to SEQ ID NO: 138744
  derived and/or modified sequence opt3 from neuraminidase__InfluenzaA__ADM31991

SEQ ID NO: 141585 - RNA, 1410 nt, Artificial Sequence; identical to SEQ ID NO: 138744
  derived and/or modified sequence opt3 from neuraminidase__InfluenzaA__ADM32001

SEQ ID NO: 141586 - RNA, 1410 nt, Artificial Sequence; identical to SEQ ID NO: 138744
  derived and/or modified sequence opt3 from neuraminidase__InfluenzaA__ADM32011

SEQ ID NO: 141587 - RNA, 1410 nt, Artificial Sequence; identical to SEQ ID NO: 138754
  derived and/or modified sequence opt3 from neuraminidase__InfluenzaA__ADM32021

SEQ ID NO: 141588 - RNA, 1410 nt, Artificial Sequence; identical to SEQ ID NO: 139724
  derived and/or modified sequence opt3 from neuraminidase__InfluenzaA__ADM32031

SEQ ID NO: 141589 - RNA, 1410 nt, Artificial Sequence; identical to SEQ ID NO: 140478
  derived and/or modified sequence opt3 from neuraminidase__InfluenzaA__ADM32051

SEQ ID NO: 141590 - RNA, 1410 nt, Artificial Sequence; identical to SEQ ID NO: 138754
  derived and/or modified sequence opt3 from neuraminidase__InfluenzaA__ADM32061

SEQ ID NO: 141591 - RNA, 1410 nt, Artificial Sequence; identical to SEQ ID NO: 138754
  derived and/or modified sequence opt3 from neuraminidase__InfluenzaA__ADM32071

SEQ ID NO: 141592 - RNA, 1410 nt, Artificial Sequence; identical to SEQ ID NO: 138754
  derived and/or modified sequence opt3 from neuraminidase__InfluenzaA__ADM32081

SEQ ID NO: 141593 - RNA, 1410 nt, Artificial Sequence; identical to SEQ ID NO: 139977
  derived and/or modified sequence opt3 from neuraminidase__InfluenzaA__ADM32091

SEQ ID NO: 141594 - RNA, 1410 nt, Artificial Sequence; identical to SEQ ID NO: 138754
  derived and/or modified sequence opt3 from neuraminidase__InfluenzaA__ADM32101

SEQ ID NO: 141595 - RNA, 1410 nt, Artificial Sequence; identical to SEQ ID NO: 138754
  derived and/or modified sequence opt3 from neuraminidase__InfluenzaA__ADM32111

SEQ ID NO: 141596 - RNA, 1410 nt, Artificial Sequence; identical to SEQ ID NO: 140435
  derived and/or modified sequence opt3 from neuraminidase__InfluenzaA__ADM32554

SEQ ID NO: 141597 - RNA, 1410 nt, Artificial Sequence; identical to SEQ ID NO: 138744
  derived and/or modified sequence opt3 from neuraminidase__InfluenzaA__ADM32564

SEQ ID NO: 141598 - RNA, 1410 nt, Artificial Sequence; identical to SEQ ID NO: 139977
  derived and/or modified sequence opt3 from neuraminidase__InfluenzaA__ADM32574

SEQ ID NO: 141599 - RNA, 1410 nt, Artificial Sequence; identical to SEQ ID NO: 138754
  derived and/or modified sequence opt3 from neuraminidase__InfluenzaA__ADM32584

SEQ ID NO: 141600 - RNA, 1410 nt, Artificial Sequence; identical to SEQ ID NO: 140435
  derived and/or modified sequence opt3 from neuraminidase__InfluenzaA__ADM32594

SEQ ID NO: 141601 - RNA, 1410 nt, Artificial Sequence; identical to SEQ ID NO: 138754
  derived and/or modified sequence opt3 from neuraminidase__InfluenzaA__ADM32604

SEQ ID NO: 141602 - RNA, 1410 nt, Artificial Sequence; identical to SEQ ID NO: 138754
  derived and/or modified sequence opt3 from neuraminidase__InfluenzaA__ADM32614

SEQ ID NO: 141603 - RNA, 1410 nt, Artificial Sequence; identical to SEQ ID NO: 138754
  derived and/or modified sequence opt3 from neuraminidase__InfluenzaA__ADM32624

SEQ ID NO: 141604 - RNA, 1410 nt, Artificial Sequence; identical to SEQ ID NO: 140435
  derived and/or modified sequence opt3 from neuraminidase__InfluenzaA__ADM32634

SEQ ID NO: 141605 - RNA, 1410 nt, Artificial Sequence; identical to SEQ ID NO: 138754
  derived and/or modified sequence opt3 from neuraminidase__InfluenzaA__ADM32644

SEQ ID NO: 141606 - RNA, 1410 nt, Artificial Sequence; identical to SEQ ID NO: 138754
  derived and/or modified sequence opt3 from neuraminidase__InfluenzaA__ADM32664

SEQ ID NO: 141607 - RNA, 1410 nt, Artificial Sequence; identical to SEQ ID NO: 139977
  derived and/or modified sequence opt3 from neuraminidase__InfluenzaA__ADM32674

SEQ ID NO: 141608 - RNA, 1410 nt, Artificial Sequence; identical to SEQ ID NO: 138754
  derived and/or modified sequence opt3 from neuraminidase__InfluenzaA__ADM32684

SEQ ID NO: 141609 - RNA, 1410 nt, Artificial Sequence; identical to SEQ ID NO: 138744
  derived and/or modified sequence opt3 from neuraminidase__InfluenzaA__ADM32694

SEQ ID NO: 141610 - RNA, 1410 nt, Artificial Sequence; identical to SEQ ID NO: 138754
  derived and/or modified sequence opt3 from neuraminidase__InfluenzaA__ADM32704

SEQ ID NO: 141611 - RNA, 1410 nt, Artificial Sequence; identical to SEQ ID NO: 140478
  derived and/or modified sequence opt3 from neuraminidase__InfluenzaA__ADM32714

SEQ ID NO: 141612 - RNA, 1410 nt, Artificial Sequence; identical to SEQ ID NO: 140478
  derived and/or modified sequence opt3 from neuraminidase__InfluenzaA__ADM32724

SEQ ID NO: 141613 - RNA, 1410 nt, Artificial Sequence; identical to SEQ ID NO: 138754
  derived and/or modified sequence opt3 from neuraminidase__InfluenzaA__ADM32734

SEQ ID NO: 141614 - RNA, 1410 nt, Artificial Sequence; identical to SEQ ID NO: 139977
  derived and/or modified sequence opt3 from neuraminidase__InfluenzaA__ADM32744

SEQ ID NO: 141615 - RNA, 1410 nt, Artificial Sequence; identical to SEQ ID NO: 140478
  derived and/or modified sequence opt3 from neuraminidase__InfluenzaA__ADM32754

SEQ ID NO: 141616 - RNA, 1410 nt, Artificial Sequence; identical to SEQ ID NO: 139977
  derived and/or modified sequence opt3 from neuraminidase__InfluenzaA__ADM32764

SEQ ID NO: 141617 - RNA, 1410 nt, Artificial Sequence
  derived and/or modified sequence opt3 from neuraminidase__InfluenzaA__ADM32774
augaaccccaaucagaagaucauuauaaucggcagcgugugcaugaccauugggauggccaaccugauccuccaaauuggaaauaucauauccaucuggauuucucacucaauccagcuugguaaccagaaucagauugagacauguaaccaaagugucacuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucacaaucgacaaguga

SEQ ID NO: 141618 - RNA, 1410 nt, Artificial Sequence; identical to SEQ ID NO: 139724
  derived and/or modified sequence opt3 from neuraminidase__InfluenzaA__ADM32784

SEQ ID NO: 141619 - RNA, 1410 nt, Artificial Sequence; identical to SEQ ID NO: 139977
  derived and/or modified sequence opt3 from neuraminidase__InfluenzaA__ADM32794

SEQ ID NO: 141620 - RNA, 1410 nt, Artificial Sequence
  derived and/or modified sequence opt3 from neuraminidase__InfluenzaA__ADM32804
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacugguggggaauagcucauugugcccuguuagcggaugggccauauacaguaaggacaacuccgugagaauuggcucuaaaggugaugucuuugugaucagggagccauucauuagcuguuccccguuagaaugccggaccuuuuuccugacacagggggcgcuacucaaugacaagcauucaaacggaaccaucaaagaucgcagucccuaucgaacucugaugagcuguccuaucggcgagguaccaucucccuacaacucccguuuugaaucaguugcuuggagcgccagugcaugccacgacggcauuaauuggcuuacaauagggaucucuggaccugauaacggugccguggcuguccugaaguauaauggcauuaucaccgacacgauaaaguccuggagaaacaauauuuugaggacucaagagagcgagugugcaugcgugaacgggucguguuucaccgugaugacagauggaccaucuaauggccaggccuccuacaaaaucuuucggaucgaaaaggguaaaauugucaagucaguugagaugaacgcucccaauuaucauuacgaagagugcaguuguuacccugacagcuccgagaucacuugcgugugccgcgauaacuggcacgggucuaauagaccauggguaucguucaaccagaaucucgaauaucagauuggauacauauguucaggcaucuuuggcgacaacccgaggcccaaugauaaaaccgggaguugcggaccuguguccagcaacggugccaacggcgucaagggguucucuuuuaaguauggaaauggcguguggauuggucggacaaaaucaaucaguagccgcaacggguucgagaugaucugggacccaaauggcuggaccggaacggauaacaauuuuuccauuaagcaagacauaguugaaaucaacgaguggucuggcuacucggggagcuucgugcagcaucccgaacugacuggacuggacuguauucgaccuugcuucugggucgagcucaucagagguaggccaaaagagaauacaauuuggaccuccggcucaaguaucucuuuuuguggggugaacagcgauacuguaggaugguccuggcccgacggcgcggaauuaccguucacaauagauaaguga

SEQ ID NO: 141621 - RNA, 1410 nt, Artificial Sequence
  derived and/or modified sequence opt3 from neuraminidase__InfluenzaA__ADM32814
augaaccccaaucagaagaucauuaccauaggcagcgugugcaugacaaucgggauggccaaccugauucuccaaaucggaaauauuaucuccauauggaucucucacucaauucagcuugguaaccagaaucaggucgagacuuguaaccaaaguguuaucacguacgaaaauaacaccugggugaaucagacauauguaaacauuagcaauacuaacuucgcugcaggccaguccguggucucugugaaacuggccggaaauucgucauugugcccuguuagcggaugggcgaucuacaguaaggacaacuccauaagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucugacggccaggcuuccuacaaaaucuuucggaucgaaaaggguaaaauugugaagucagucgagaugaaugcccccaacuaucauuacgaagagugcaguuguuacccugauagcuccgagaucacuugcguuugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacaauaacuuuuccauuaagcaagacauagugggcaucaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcagaguuaccguucacaauagacaaguga

SEQ ID NO: 141622 - RNA, 1410 nt, Artificial Sequence; identical to SEQ ID NO: 138754
  derived and/or modified sequence opt3 from neuraminidase__InfluenzaA__ADM32824

SEQ ID NO: 141623 - RNA, 1410 nt, Artificial Sequence; identical to SEQ ID NO: 139977
  derived and/or modified sequence opt3 from neuraminidase__InfluenzaA__ADM32834

SEQ ID NO: 141624 - RNA, 1410 nt, Artificial Sequence; identical to SEQ ID NO: 138744
  derived and/or modified sequence opt3 from neuraminidase__InfluenzaA__ADM32844

SEQ ID NO: 141625 - RNA, 1410 nt, Artificial Sequence
  derived and/or modified sequence opt3 from neuraminidase__InfluenzaA__ADM32854
augaaccccaaucagaagaucauuaccauaggcagcgugugcacaacuaucgggauggccaaccugauucuccaaaucggaaauauuaucuccauauggaucucucacucaauucaguucgguaaccagaaucagaucgagacguguaaccaaagugucauuaccuacgaaaauaacacauggguuaaucagacuuaugugaacaucagcaauaccaacuuugcugcaggccaguccguagugucugucaaacuugugggaaauucgucacugugcccuguuagcggaugggccauauacaguaaggacaacuccgugagaauuggcucuaaaggugaugucuucgugaucagggagccauuuauuagcuguuccccguuggaaugccggacauucuuuuuaacccagggggcgcugcuaaaugacaagcauucaaacggaacuaucaaagaucgcagucccuaucgaacacucaugagcuguccuaucggcgagguaccaucucccuacaacucccguuucgaaucaguugcuuggagcgccagugcaugccacgacggcauuaauuggcugaccauagggaucucuggaccugauaacggugccguggcuguccuuaaguauaauggcauuaucacggacacuauaaaguccuggagaaacaauauucugaggacccaagagagcgagugugcaugcgugaacgggucguguuuuacagugaugacugauggaccaucuaauggccaggccuccuacaaaaucuuccggaucgaaaaggguaaaauugucaagucaguugagaugaacgcucccaauuaucauuacgaagagugcaguuguuacccugacagcuccgagauuaccugcgugugccgcgauaacuggcacgggucuaauagaccaugggugagcuuuaaccagaauuuggaauaucagaucggauacauauguucaggcaucuucggcgacaacccgaggcccaaugauaaaacagggaguugcggaccuguauccagcaacggugccaacggcgucaagggguuuucuuucaaguauggaaauggcguguggauuggucggaccaaaucaaucaguagccgcaacggguuugagaugaucugggacccaaauggcuggacgggaacugauaacaauuucuccauuaagcaagacauaguuggcaucaacgaauggucuggguacucggggagcuucgugcagcaucccgagcucacaggucuggacuguauucgaccuugcuuuugggucgaacugaucagaggcaggccaaaagagaauaccauuuggacuuccgggucaaguaucucuuucuguggagugaacagcgauacaguaggcugguccuggcccgacggugcggagcucccguuuaccauagauaaguga

SEQ ID NO: 141626 - RNA, 1410 nt, Artificial Sequence; identical to SEQ ID NO: 138744
  derived and/or modified sequence opt3 from neuraminidase__InfluenzaA__ADM32864

SEQ ID NO: 141627 - RNA, 1410 nt, Artificial Sequence; identical to SEQ ID NO: 138754
  derived and/or modified sequence opt3 from neuraminidase__InfluenzaA__ADM32874

SEQ ID NO: 141628 - RNA, 1410 nt, Artificial Sequence
  derived and/or modified sequence opt3 from neuraminidase__InfluenzaA__ADM32884
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcuguaggccaguccguggucucugugaaacuggcaggaaauucgucauugugcccuguuagcggaugggccauauacaguaaggacaacuccauuagaaucggcucuaaaggugauguguuugucauuagggagccauucaucagcuguuccccguuagaaugccggaccuuuuuccugacacagggggcgcuacucaaugacaagcauucaaacggaaccaucaaagaucgcagucccuaucgaacucugaugagcuguccuauuggcgaggugccaucucccuacaacucccguuuugaaucaguagcuuggagcgccagugcaugccacgacggcauaaauuggcuuacaaucgggauuucuggaccugauaacggugccguugcugugcugaaguauaauggcaucauaaccgacacgauuaaguccuggagaaacaauaucuugaggacucaagagagcgagugugcaugcgucaacgggucguguuucaccgugaugacagauggaccaucugacggccaggccuccuacaaaaucuuucggauugaaaaggguaaaaucgugaagucagucgagaugaaugcucccaacuaucauuacgaagagugcaguuguuacccugauagcuccgagauuacuugcguuugccgcgacaauuggcacgggucuaacagaccaugggugagcuucaaucagaaccucgaauaucagauaggauacaucuguucaggcauuuuuggcgauaauccgaggcccaacgacaaaaccgggaguugcggaccuguauccagcaauggugccaacggcgugaagggguucucuuuuaaguauggaaacggcgucuggaucggucggacaaaaucaaucaguagccgcaauggguucgagaugauuugggauccaaacggcuggaccggaacggacaauaaguuuuccauaaaacaagacaucgugggcauuaacgaauggucuggguacucggggagcuucguucagcaucccgagcugacuggucuggauuguauccgaccuugcuucuggguggaacucauuagaggcaggccaaaggagaauacaaucuggaccuccgggucaaguauaucuuuuuguggagucaacagcgacacugugggcugguccuggcccgauggugcggaguuaccguucacaaucgacaaauga

SEQ ID NO: 141629 - RNA, 1410 nt, Artificial Sequence; identical to SEQ ID NO: 138754
  derived and/or modified sequence opt3 from neuraminidase__InfluenzaA__ADM32921

SEQ ID NO: 141630 - RNA, 1410 nt, Artificial Sequence; identical to SEQ ID NO: 138754
  derived and/or modified sequence opt3 from neuraminidase__InfluenzaA__ADM32931

SEQ ID NO: 141631 - RNA, 1410 nt, Artificial Sequence
  derived and/or modified sequence opt3 from neuraminidase__InfluenzaA__ADM32941
augaaccccaaucagaagaucauuauaaucggcagcgugugcaugaccauugggauggccaaccugauccuccaaauuggaaauaucauauccaucuggauuucucacucaauccagcuugguaaccagaaucagauugagacauguaaccaaagugucaucacuuacgaaaauaacacguggguuaaucagaccuaugugaacauaagcaauacaaacuucgcugcaggccaguccguagugucugucaaacuggccggaaauucgucauugugcccugugagcgggugggcgauuuacaguaaggacaacuccaucagaauuggcucuaaaggugauguuuuugugaucagggagccauucaucagcuguuccccguuagaaugccggaccuuuuuccugacucagggggcucuacucaaugacaagcauucaaacggaacaauuaaagaucgcagucccuaucgaacccugaugagcuguccuauaggcgaggucccaucucccuacaacucccguuuugaaucaguggccuggagcgcaagugccugccacgacggcaucaauuggcuuacuauugggaucucuggaccugauaacggugcuguagcaguucugaaguauaauggcauaauuacagacaccaucaaguccuggagaaacaauaucuugaggacgcaagagagcgagugugccugcgugaacgggucguguuucacugucaugaccgauggaccaucugacggccaggcuuccuacaaaauuuuucggaucgaaaaggguaaaauugugaagucaguggagaugaaugcccccaacuaucauuacgaagagugcaguuguuacccugauagcuccgagauaacaugcgucugccgcgacaauuggcacgggucuaacagaccauggguuagcuucaaucagaaccucgaauaucagaucggauacauuuguucaggcaucuuuggcgauaauccgaggcccaacgacaaaacugggaguugcggaccuguguccagcaauggugcgaacggcguaaagggguucucuuuuaaguauggaaacggcguguggaucggucggaccaaaucaauuaauagucgcaacggguucgagaugauaugggauccaaauggcuggacaggaaccgacaacaauuuuagcaucaagcaagacauugucggcaucaacgaaugguccggguacucuggaucguucgugcagcaucccgagcugacgggucuggauuguauucgaccuugcuucuggguugaacucaucagaggcaggccaaaagagaauacuauauggacaagcggguccucaaucaguuuuuguggagugaacucugacaccgucggcuggagcuggcccgauggugcagaguuaccguucacuauugacaaguga

SEQ ID NO: 141632 - RNA, 1410 nt, Artificial Sequence; identical to SEQ ID NO: 138754
  derived and/or modified sequence opt3 from neuraminidase__InfluenzaA__ADM32951

SEQ ID NO: 141633 - RNA, 1410 nt, Artificial Sequence; identical to SEQ ID NO: 139337
  derived and/or modified sequence opt3 from neuraminidase__InfluenzaA__ADM32960

SEQ ID NO: 141634 - RNA, 1410 nt, Artificial Sequence; identical to SEQ ID NO: 138754
  derived and/or modified sequence opt3 from neuraminidase__InfluenzaA__ADM32969

SEQ ID NO: 141635 - RNA, 1410 nt, Artificial Sequence; identical to SEQ ID NO: 138754
  derived and/or modified sequence opt3 from neuraminidase__InfluenzaA__ADM32979

SEQ ID NO: 141636 - RNA, 1410 nt, Artificial Sequence; identical to SEQ ID NO: 140656
  derived and/or modified sequence opt3 from neuraminidase__InfluenzaA__ADM32988

SEQ ID NO: 141637 - RNA, 1410 nt, Artificial Sequence; identical to SEQ ID NO: 140656
  derived and/or modified sequence opt3 from neuraminidase__InfluenzaA__ADM32997

SEQ ID NO: 141638 - RNA, 1410 nt, Artificial Sequence; identical to SEQ ID NO: 138754
  derived and/or modified sequence opt3 from neuraminidase__InfluenzaA__ADM33006

SEQ ID NO: 141639 - RNA, 1410 nt, Artificial Sequence; identical to SEQ ID NO: 140656
  derived and/or modified sequence opt3 from neuraminidase__InfluenzaA__ADM33015

SEQ ID NO: 141640 - RNA, 1410 nt, Artificial Sequence
  derived and/or modified sequence opt3 from neuraminidase__InfluenzaA__ADM33025
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaagcaacaucuugaggacucaagagucggagugugccugcgugaaugggucuuguuucaccgucaugacagauggaccauccgacggccaggcuucauacaaaaucuuucggauugaaaaggguaaaaucgugaagaguguggagaugaacgcccccaauuaucauuacgaagagugcagcuguuacccugauuccucugagauuacuugcgucugccgcgacaacuggcacgggagcaauagaccauggguuucauucaaccagaaucucgaauaucagauaggauacaucuguaguggcauuuuuggcgauaacccgaggcccaaugacaaaaccggguccugcggaccugugagcucuaacggugcgaauggcguaaagggguucucauuuaaguauggaaacggcguguggaucggucggacaaaaaguaucagcucccgcaacggguucgagaugauuugggauccaaauggcuggaccggaacggacaacaauuuuucuauaaagcaagacaucgucggcauuaacgaauggucgggguacagcggauccuucgugcagcaucccgagcugacuggucuggauuguauccgaccuugcuucuggguugaacucauuagaggcaggccaaaagagaauacaaucuggaccucagggaguucuauaucguuuuguggagugaacuccgacacugucggcuggucauggcccgauggugcagaguuaccguucacaaucgacaaguga

SEQ ID NO: 141641 - RNA, 1410 nt, Artificial Sequence; identical to SEQ ID NO: 138754
  derived and/or modified sequence opt3 from neuraminidase__InfluenzaA__ADM33042

SEQ ID NO: 141642 - RNA, 1410 nt, Artificial Sequence; identical to SEQ ID NO: 138754
  derived and/or modified sequence opt3 from neuraminidase__InfluenzaA__ADM33062

SEQ ID NO: 141643 - RNA, 1410 nt, Artificial Sequence
  derived and/or modified sequence opt3 from neuraminidase__InfluenzaA__ADM33071
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccaaaauuacuugcgucugccgcgacaauuggcacgggucuaacagaccauggguuagcuucaaucagaaccucgaguaucagauaggauacaucuguucaggcauuuuuggcgauaauccgaggcccaacgacaagaccgggaguugcggaccuguguccagcaauggugcgaacggcguaaagggguucucuuuuaaauauggaaacggcguguggaucggucggacaaagucaaucaguagccgcaauggguucgaaaugauuugggauccaaacggcuggaccggaacggacaauaacuuuuccauaaaacaagacaucgucggcauuaaugaguggucuggguacucggggagcuucgugcagcaucccgaacugacuggucuggauuguauccgaccuugcuucuggguugagcucauuagaggcaggccaaaggaaaacacaaucuggaccuccgggucaaguauaucuuuuuguggagugaauggcgacacugucgguuggagcuggcccgauggggcagaguuaccguucacaaucgacaaauga

SEQ ID NO: 141644 - RNA, 1410 nt, Artificial Sequence; identical to SEQ ID NO: 138754
  derived and/or modified sequence opt3 from neuraminidase__InfluenzaA__ADM33081

SEQ ID NO: 141645 - RNA, 1410 nt, Artificial Sequence; identical to SEQ ID NO: 139827
  derived and/or modified sequence opt3 from neuraminidase__InfluenzaA__ADM33091

SEQ ID NO: 141646 - RNA, 1410 nt, Artificial Sequence; identical to SEQ ID NO: 139827
  derived and/or modified sequence opt3 from neuraminidase__InfluenzaA__ADM33101

SEQ ID NO: 141647 - RNA, 1410 nt, Artificial Sequence; identical to SEQ ID NO: 139827
  derived and/or modified sequence opt3 from neuraminidase__InfluenzaA__ADM33111

SEQ ID NO: 141648 - RNA, 1410 nt, Artificial Sequence; identical to SEQ ID NO: 138754
  derived and/or modified sequence opt3 from neuraminidase__InfluenzaA__ADM33121

SEQ ID NO: 141649 - RNA, 1410 nt, Artificial Sequence; identical to SEQ ID NO: 138754
  derived and/or modified sequence opt3 from neuraminidase__InfluenzaA__ADM33130

SEQ ID NO: 141650 - RNA, 1410 nt, Artificial Sequence; identical to SEQ ID NO: 138754
  derived and/or modified sequence opt3 from neuraminidase__InfluenzaA__ADM33139

SEQ ID NO: 141651 - RNA, 1410 nt, Artificial Sequence; identical to SEQ ID NO: 138754
  derived and/or modified sequence opt3 from neuraminidase__InfluenzaA__ADM33149

SEQ ID NO: 141652 - RNA, 1410 nt, Artificial Sequence; identical to SEQ ID NO: 138754
  derived and/or modified sequence opt3 from neuraminidase__InfluenzaA__ADM33159

SEQ ID NO: 141653 - RNA, 1410 nt, Artificial Sequence; identical to SEQ ID NO: 138754
  derived and/or modified sequence opt3 from neuraminidase__InfluenzaA__ADM33169

SEQ ID NO: 141654 - RNA, 1410 nt, Artificial Sequence; identical to SEQ ID NO: 138754
  derived and/or modified sequence opt3 from neuraminidase__InfluenzaA__ADM33179

SEQ ID NO: 141655 - RNA, 1410 nt, Artificial Sequence; identical to SEQ ID NO: 138754
  derived and/or modified sequence opt3 from neuraminidase__InfluenzaA__ADM33188

SEQ ID NO: 141656 - RNA, 1410 nt, Artificial Sequence; identical to SEQ ID NO: 138754
  derived and/or modified sequence opt3 from neuraminidase__InfluenzaA__ADM33197

SEQ ID NO: 141657 - RNA, 1410 nt, Artificial Sequence; identical to SEQ ID NO: 138754
  derived and/or modified sequence opt3 from neuraminidase__InfluenzaA__ADM33206

SEQ ID NO: 141658 - RNA, 1410 nt, Artificial Sequence; identical to SEQ ID NO: 138754
  derived and/or modified sequence opt3 from neuraminidase__InfluenzaA__ADM33215

SEQ ID NO: 141659 - RNA, 1410 nt, Artificial Sequence; identical to SEQ ID NO: 138754
  derived and/or modified sequence opt3 from neuraminidase__InfluenzaA__ADM33224

SEQ ID NO: 141660 - RNA, 1410 nt, Artificial Sequence; identical to SEQ ID NO: 138754
  derived and/or modified sequence opt3 from neuraminidase__InfluenzaA__ADM33234

SEQ ID NO: 141661 - RNA, 1410 nt, Artificial Sequence; identical to SEQ ID NO: 139178
  derived and/or modified sequence opt3 from neuraminidase__InfluenzaA__ADM33243

SEQ ID NO: 141662 - RNA, 1410 nt, Artificial Sequence; identical to SEQ ID NO: 138754
  derived and/or modified sequence opt3 from neuraminidase__InfluenzaA__ADM33253

SEQ ID NO: 141663 - RNA, 1410 nt, Artificial Sequence; identical to SEQ ID NO: 139178
  derived and/or modified sequence opt3 from neuraminidase__InfluenzaA__ADM33262

SEQ ID NO: 141664 - RNA, 1410 nt, Artificial Sequence; identical to SEQ ID NO: 138784
  derived and/or modified sequence opt3 from neuraminidase__InfluenzaA__ADM33272

SEQ ID NO: 141665 - RNA, 1410 nt, Artificial Sequence; identical to SEQ ID NO: 138784
  derived and/or modified sequence opt3 from neuraminidase__InfluenzaA__ADM33282

SEQ ID NO: 141666 - RNA, 1410 nt, Artificial Sequence; identical to SEQ ID NO: 138754
  derived and/or modified sequence opt3 from neuraminidase__InfluenzaA__ADM33292

SEQ ID NO: 141667 - RNA, 1410 nt, Artificial Sequence; identical to SEQ ID NO: 138754
  derived and/or modified sequence opt3 from neuraminidase__InfluenzaA__ADM33302

SEQ ID NO: 141668 - RNA, 1410 nt, Artificial Sequence; identical to SEQ ID NO: 138744
  derived and/or modified sequence opt3 from neuraminidase__InfluenzaA__ADM33312

SEQ ID NO: 141669 - RNA, 1410 nt, Artificial Sequence; identical to SEQ ID NO: 138784
  derived and/or modified sequence opt3 from neuraminidase__InfluenzaA__ADM33322

SEQ ID NO: 141670 - RNA, 1410 nt, Artificial Sequence; identical to SEQ ID NO: 138784
  derived and/or modified sequence opt3 from neuraminidase__InfluenzaA__ADM33332

SEQ ID NO: 141671 - RNA, 1410 nt, Artificial Sequence; identical to SEQ ID NO: 138784
  derived and/or modified sequence opt3 from neuraminidase__InfluenzaA__ADM33342

SEQ ID NO: 141672 - RNA, 1410 nt, Artificial Sequence
  derived and/or modified sequence opt3 from neuraminidase__InfluenzaA__ADM33367
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucguuacguacgaaaauaacaccugggugaaucagacauauguaaacauuagcaauacuaacuucgcugcaggccaguccguggucucugugaaacuggccggaaauucgucauugugcccuguugggggcugggcgaucuacagcaaggacaacagugugagaauagguuccaaaggggaugucuuugugauuagggagccauucaucucuuguagcccguuagaaugccggaccuuuuuccugacacagggagcucuacucaaugacaagcauuccaacggcaccauuaaagaucgcucacccuaucgaacucugaugaguuguccuaucggcgagguaccaagccccuacaacucucguuuugaauccguugccuggucagcaagcgccugccacgacgggaucaauuggcuuacaauuggaauaagugguccugauaacggcgcuguggcaguccugaaguauaaugggaucauuaccgacacgaucaagucuuggagaaacaauauauugaggacucaagaguccgagugugccugcgugaacggaagcuguuucaccgugaugacagauggcccaucgaauggucaggcuucuuacaaaauuuuucggaucgaaaaggggaaaaucgucaaguccguugagaugaacgcccccaauuaucauuacgaagagugcucauguuacccugacaguagcgagauuacuugcgugugccgcgauaacuggcacggauccaauagaccauggguaucuuucaaccagaaucucgaauaucagaucggcuacauuuguagcggcauauuuggggacaacccgaggcccaaugauaaaaccggaucaugcgguccugugaguuccaacggcgcgaacggggucaagggauucagcuuuaaguauggcaaugguguguggaucgggcggacaaaaucuauuucaagucgcaacggcuucgagaugaucugggacccaaauggauggaccggcacggauaacaauuuuagcaucaagcaagacauuguugggauaaacgaaugguccggauacucugguucguucgugcagcaucccgagcugacuggccuggacuguauccgaccuugcuucugggucgaacucauuagagggaggccaaaagagaauacaaucuggaccagcggauccucaauuaguuuuuguggcgugaacucugauacuguagguuggagcuggcccgacggggcagaguuaccguucacaaucgauaaguga

SEQ ID NO: 141673 - RNA, 1410 nt, Artificial Sequence; identical to SEQ ID NO: 138784
  derived and/or modified sequence opt3 from neuraminidase__InfluenzaA__ADM33377

SEQ ID NO: 141674 - RNA, 1410 nt, Artificial Sequence; identical to SEQ ID NO: 138784
  derived and/or modified sequence opt3 from neuraminidase__InfluenzaA__ADM33387

SEQ ID NO: 141675 - RNA, 1410 nt, Artificial Sequence; identical to SEQ ID NO: 138754
  derived and/or modified sequence opt3 from neuraminidase__InfluenzaA__ADM33397

SEQ ID NO: 141676 - RNA, 1410 nt, Artificial Sequence; identical to SEQ ID NO: 138754
  derived and/or modified sequence opt3 from neuraminidase__InfluenzaA__ADM33407

SEQ ID NO: 141677 - RNA, 1410 nt, Artificial Sequence; identical to SEQ ID NO: 138784
  derived and/or modified sequence opt3 from neuraminidase__InfluenzaA__ADM33417

SEQ ID NO: 141678 - RNA, 1410 nt, Artificial Sequence; identical to SEQ ID NO: 138754
  derived and/or modified sequence opt3 from neuraminidase__InfluenzaA__ADM33427

SEQ ID NO: 141679 - RNA, 1410 nt, Artificial Sequence
  derived and/or modified sequence opt3 from neuraminidase__InfluenzaA__ADM33437
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucugccuacaacucccguuuugaaucaguggcauggagcgccagugcuugccacgacggcauaaauuggcuuacaaucgggauuucuggacccgauaacggugcaguagccguucugaaguauaauggcaucauaaccgacacgauuaaguccuggagaaacaauaucuugaggacucaagagagcgagugugcuugcgugaacgggucguguuucaccgucaugacagauggaccuucugacggccaggccuccuacaaaaucuuucggauugaaaaggguaaaaucgugaagucaguggagaugaaugcgccaaacuaucauuacgaagagugcaguuguuaccccgauagcuccgagauuacuugcgucugccgcgacaauuggcacgggucuaacagaccuuggguuagcuucaaucagaaccucgaauaucagauaggauacaucuguucaggcauuuuuggcgauaauccaaggccgaacgacaaaaccgggaguugcggacccguguccagcaauggugcaaacggcguaaagggguucucuuuuaaguauggaaacggcguguggaucggucggacaaaaucaaucaguagccgcaauggguucgagaugauuugggauccuaacggcuggaccggaacggacaauaacuuuuccauaaagcaagacaucgucggcauuaaugaauggucuggguacucggggagcuucgugcagcauccagagcugacuggucuggauuguauccgacccugcuucuggguugaacucauuagaggcaggccuaaagagaacacaaucuggaccuccgggucaaguauaucuuuuuguggagugaauagcgacacugucggcugguccuggccagauggugccgaguuacccuucacaaucgacaaguga

SEQ ID NO: 141680 - RNA, 1410 nt, Artificial Sequence; identical to SEQ ID NO: 139108
  derived and/or modified sequence opt3 from neuraminidase__InfluenzaA__ADM33443

SEQ ID NO: 141681 - RNA, 1410 nt, Artificial Sequence; identical to SEQ ID NO: 138754
  derived and/or modified sequence opt3 from neuraminidase__InfluenzaA__ADM52446

SEQ ID NO: 141682 - RNA, 1410 nt, Artificial Sequence; identical to SEQ ID NO: 138754
  derived and/or modified sequence opt3 from neuraminidase__InfluenzaA__ADM52456

SEQ ID NO: 141683 - RNA, 1410 nt, Artificial Sequence; identical to SEQ ID NO: 140959
  derived and/or modified sequence opt3 from neuraminidase__InfluenzaA__ADM52466

SEQ ID NO: 141684 - RNA, 1410 nt, Artificial Sequence; identical to SEQ ID NO: 138754
  derived and/or modified sequence opt3 from neuraminidase__InfluenzaA__ADM52486

SEQ ID NO: 141685 - RNA, 1410 nt, Artificial Sequence; identical to SEQ ID NO: 138744
  derived and/or modified sequence opt3 from neuraminidase__InfluenzaA__ADM52496

SEQ ID NO: 141686 - RNA, 1410 nt, Artificial Sequence; identical to SEQ ID NO: 138754
  derived and/or modified sequence opt3 from neuraminidase__InfluenzaA__ADM52506

SEQ ID NO: 141687 - RNA, 1410 nt, Artificial Sequence; identical to SEQ ID NO: 138744
  derived and/or modified sequence opt3 from neuraminidase__InfluenzaA__ADM52516

SEQ ID NO: 141688 - RNA, 1410 nt, Artificial Sequence; identical to SEQ ID NO: 138744
  derived and/or modified sequence opt3 from neuraminidase__InfluenzaA__ADM52527

SEQ ID NO: 141689 - RNA, 1410 nt, Artificial Sequence; identical to SEQ ID NO: 139977
  derived and/or modified sequence opt3 from neuraminidase__InfluenzaA__ADM52537

SEQ ID NO: 141690 - RNA, 1410 nt, Artificial Sequence; identical to SEQ ID NO: 140478
  derived and/or modified sequence opt3 from neuraminidase__InfluenzaA__ADM52547

SEQ ID NO: 141691 - RNA, 1410 nt, Artificial Sequence; identical to SEQ ID NO: 138744
  derived and/or modified sequence opt3 from neuraminidase__InfluenzaA__ADM52557

SEQ ID NO: 141692 - RNA, 1410 nt, Artificial Sequence; identical to SEQ ID NO: 138744
  derived and/or modified sequence opt3 from neuraminidase__InfluenzaA__ADM52567

SEQ ID NO: 141693 - RNA, 1410 nt, Artificial Sequence; identical to SEQ ID NO: 138744
  derived and/or modified sequence opt3 from neuraminidase__InfluenzaA__ADM52577

SEQ ID NO: 141694 - RNA, 1410 nt, Artificial Sequence; identical to SEQ ID NO: 138754
  derived and/or modified sequence opt3 from neuraminidase__InfluenzaA__ADM52587

SEQ ID NO: 141695 - RNA, 1410 nt, Artificial Sequence; identical to SEQ ID NO: 138754
  derived and/or modified sequence opt3 from neuraminidase__InfluenzaA__ADM52597

SEQ ID NO: 141696 - RNA, 1410 nt, Artificial Sequence; identical to SEQ ID NO: 138744
  derived and/or modified sequence opt3 from neuraminidase__InfluenzaA__ADM52607

SEQ ID NO: 141697 - RNA, 1410 nt, Artificial Sequence; identical to SEQ ID NO: 138744
  derived and/or modified sequence opt3 from neuraminidase__InfluenzaA__ADM52617

SEQ ID NO: 141698 - RNA, 1410 nt, Artificial Sequence; identical to SEQ ID NO: 140435
  derived and/or modified sequence opt3 from neuraminidase__InfluenzaA__ADM52627

SEQ ID NO: 141699 - RNA, 1410 nt, Artificial Sequence; identical to SEQ ID NO: 139977
  derived and/or modified sequence opt3 from neuraminidase__InfluenzaA__ADM52637

SEQ ID NO: 141700 - RNA, 1410 nt, Artificial Sequence; identical to SEQ ID NO: 139977
  derived and/or modified sequence opt3 from neuraminidase__InfluenzaA__ADM52647

SEQ ID NO: 141701 - RNA, 1410 nt, Artificial Sequence; identical to SEQ ID NO: 138744
  derived and/or modified sequence opt3 from neuraminidase__InfluenzaA__ADM52657

SEQ ID NO: 141702 - RNA, 1410 nt, Artificial Sequence; identical to SEQ ID NO: 139977
  derived and/or modified sequence opt3 from neuraminidase__InfluenzaA__ADM52667

SEQ ID NO: 141703 - RNA, 1410 nt, Artificial Sequence; identical to SEQ ID NO: 138744
  derived and/or modified sequence opt3 from neuraminidase__InfluenzaA__ADM52687

SEQ ID NO: 141704 - RNA, 1410 nt, Artificial Sequence; identical to SEQ ID NO: 138744
  derived and/or modified sequence opt3 from neuraminidase__InfluenzaA__ADM52697

SEQ ID NO: 141705 - RNA, 1410 nt, Artificial Sequence; identical to SEQ ID NO: 140435
  derived and/or modified sequence opt3 from neuraminidase__InfluenzaA__ADM52707

SEQ ID NO: 141706 - RNA, 1410 nt, Artificial Sequence
  derived and/or modified sequence opt3 from neuraminidase__InfluenzaA__ADM52717
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccgccguaucugugaaacuggucggaaauucgucauugugcccugugagcggaugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucuaauggccaggcuuccuacaaaaucuuucggaucgaaaaggguaaaauugugaagucagucgagaugaacgcccccaauuaucauuacgaagagugcaguuguuacccugacagcuccgagaucacuugcguuugccgcgauaacuggcacgggucuaauagaccaugggugagcuucaaccagaaucucgaauaucagauuggauacauauguucaggcaucuuuggcgacaacccgaggcccaaugauaaaaccgggaguugcggaccuguauccagcaacggugcgaacggcgugaagggguucucuuuuaaguauggaaauggcgucuggauuggucggacaaaaucaaucaguagccgcaacggguucgagaugaucugggacccaaauggcuggaccggaacggauaacaauuuuuccauuaagcaagacauagugggcaucaacgaauggucuggguacucggggagcuucguucagcaucccgagcugacuggucuggacuguauucgaccuugcuucuggguggaacucaucagaggcaggccaaaagagaauacaauuuggaccuccgggucaaguaucucuuuuuguggagucaacagcgauacugugggcugguccuggcccgacggugcagaguuaccguucacaauagauaaguga

SEQ ID NO: 141707 - RNA, 1410 nt, Artificial Sequence
  derived and/or modified sequence opt3 from neuraminidase__InfluenzaA__ADM86402
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagccucugugaaacuggcgggaaauucgucauugugcccugucagcggaugggcuauauacaguaaggacaacuccgugagaauuggcucuaaaggugauguuuuugugaucagggagccauucauuagcuguuccccguuagaaugccggaccuuuuuccugacacagggggcccuacucaaugacaagcauucaaacggaaccgucaaagaucgcagucccuaucgaacucugaugagcuguccuaucggcgaggugccaucucccuacaacucccguuuugaaucaguagcauggagcgccagugcuugccacgacggcaucaauuggcuuacaauugggauaucuggaccugauaacggugcaguugccgugcugaaguauaauggcaucauuaccgacacgaucaaguccuggagaaacaauauauugaggacucaagagagcgagugugcuugcgucaacgggucguguuucaccgugaugacagauggaccaucugacggccaggccuccuacaaaauuuuucggaucgaaaaggguaaaaucgugaagucagucgagaugaaugcgcccaacuaucauuacgaagagugcaguuguuacccugauagcuccgagauuacuugcguuugccgcgacaauuggcacgggucuaacagaccaugggugagcuucaaucagaaccucgaauaucagaucggauacauuuguucaggcauauuuggcgauaauccgaggcccaacgacaaaaccgggaguugcggaccuguauccagcaauggugcaaacggcgugaagggguucucuuuuaaguauggaaacggcgucuggaucggucggacaaaaucaauuaguagccgcaauggguucgagaugaucugggauccaaacggcuggaccggaacggacaauaacuuuuccaucaagcaagacauugugggcauaaaugaauggucuggguacucggggagcuucguucagcaucccgagcugacuggucuggauuguauccgaccuugcuucuggguggaacucauuagaggcaggccaaaagagaacacaaucuggaccuccgggucaaguauuucuuuuuguggagucaauagcgacacugugggcugguccuggcccgauggugccgaguuaccguucacaaucgacaaguga

SEQ ID NO: 141708 - RNA, 1410 nt, Artificial Sequence; identical to SEQ ID NO: 138754
  derived and/or modified sequence opt3 from neuraminidase__InfluenzaA__ADM86412

SEQ ID NO: 141709 - RNA, 1410 nt, Artificial Sequence
  derived and/or modified sequence opt3 from neuraminidase__InfluenzaA__ADM86422
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucguagcuggccaguccguggucucugugaaacuggcaggaaauucgucauugugcccuguuagcggaugggccauauacaguaaggacaacuccauuagaaucggcucuaaaggugauguguuugucauuagggagccauucaucagcuguuccccguuagaaugccggaccuuuuuccugacacagggggcgcuacucaaugacaagcauucaaacggaaccaucaaagaucgcagucccuaucgaacucugaugagcuguccuauuggcgaggugccaucucccuacaacucccguuuugaaucaguagcuuggagcgccagugcaugccacgacggcauaaauuggcuuacaaucgggauuucuggaccugauaacggugccguugcugugcugaaguauaauggcaucauaaccgacacgauuaaguccuggagaaacaauaucuugaggacucaagagagcgagugugcaugcgucaacgggucguguuucaccgugaugacagauggaccaucugacggccaggccuccuacaaaaucuuucggauugaaaaggguaaaguggucaagucaguugagaugaaugcucccaacuaucauuacgaagagugcaguuguuacccugauagcuccgagaucacuugcgugugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugccaacggcgucaagggguucucuuuuaaguauggaaacggcguguggauuggucggacaaaaucaaucaguagccgcaauggguucgagaugaucugggauccaaacggcuggaccggaacggacaauaacuuuuccauuaagcaagacauaguuggcaucaaugaauggucuggguacucggggagcuucgugcagcaucccgagcugacuggucuggauuguauucgaccuugcuucugggucgaacucaucagaggcaggccaaaagagaacacaauuuggaccuccgggucaaguaucucuuuuuguggagugaauagcgacacuguaggcugguccuggcccgauggugcggaguuaccguucacaauagacaaguga

SEQ ID NO: 141710 - RNA, 1410 nt, Artificial Sequence; identical to SEQ ID NO: 139608
  derived and/or modified sequence opt3 from neuraminidase__InfluenzaA__ADM86432

SEQ ID NO: 141711 - RNA, 1410 nt, Artificial Sequence
  derived and/or modified sequence opt3 from neuraminidase__InfluenzaA__ADM86443
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugugugcgucaacgggucguguuucaccgugaugacagauggaccaucugacggccaggccuccuacaaaaucuuucggauugaaaaggguaaaaucgugaagucagucgagaugaaugcucccaacuaucauuacgaagagugcaguuguuacccugauagcuccgagauuacuugcguuugccgcgacaauuggcacgggucuaacagaccaugggugagcuucaaucagaaccucgaauaucagauaggauacaucuguucaggcauuuuuggcgauaauccgaggcccaacgacaaaaccgggaguugcggaccuguauccagcaauggugccaacggcgugaagggguucucuuuuaaguauggaaacggcgucuggaucggucggacaaaaucaaucaguagccgcaauggguucgagaugauuugggauccaaacggcuggaccggaacggacaauaacuuuuccauaaagcaagacaucgugggcaugaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcggaguuaccguucacaauagacaaguga

SEQ ID NO: 141712 - RNA, 1410 nt, Artificial Sequence; identical to SEQ ID NO: 139337
  derived and/or modified sequence opt3 from neuraminidase__InfluenzaA__ADM86453

SEQ ID NO: 141713 - RNA, 1350 nt, Artificial Sequence
  derived and/or modified sequence opt3 from neuraminidase__InfluenzaA__ADM95377
augaaccccaaucagaagaucauuaccauaggcagcaucugcauggugacagggauugucucccugaugcuccaaguuggaucuaugaucucaauuugggugagucacagcauccauacugguaaccagcaccaggccgagccuauauccaauacgaacuuccuuaccgaaaaagcuguagcaucugugaagcuggccggcaauucgucauuguguccaaucaacgggugggcggucuacagcaaagacaauaguauuagaaucggauccaagggcgauguguuuguuauuagggagccguucaucucuugcagccauuuagaaugucggacauuuuuccugacucagggugcucuacucaacgacaaacacuccaaugggaccgugaaggaucgcucaccccaucgaacacugaugaguugcccuaugggagaggccccaagccccuauaacucucguuuugaauccgucgcauggucagccagcgcuugucacgacggcaccaguuggcuuacuauaggcauuucugggccugauaauggagcaguggccguacugaaguacaacgguaucauuacagacaccaucaaauccuggagaaauaacaucuugaggacgcaagagagcgagugcgcuuguguuaauggcucgugcuucacugugaugaccgaugggccaucuaacggacaggccucccacaagauuuuuaaaauggaaaagggcaaagucauaaagucaguggagcucgacgcgcccaacuaucauuacgaagaguguaguugcuauccugaugccggugagaucacaugugugugccgggacaauuggcacgggagcaaccgcccaugggucuccuucaaucagaaccuggaauaccagauuggauauaucugcucuggcguuuuuggcgauaauccgagacccaacgacgggacuggaagcugugguccugugucaaguaauggcgcauacgggguaaagggauucuccuuuaaauacggcaacgguguguggauagggaggaccaagagcacaaauucucggucaggcuucgagaugauuugggauccaaacggauggaccgaaacggacagucgcuuuagcgucaaacaagacaucguggcuaucacugauugguccggcuauucugggucguucguucagcaucccgagcugacaggacucgacugcauucgaccuuguuucuggguggaauuaaucagagguaggccaaaggagagcaccauuuggacuuccggcucaaguauaucuuuuugcggggucaauagcgauacagugggaugguccuggcccgacggcgccgagcugccguucaccaucgauaaauga

SEQ ID NO: 141714 - RNA, 1410 nt, Artificial Sequence; identical to SEQ ID NO: 138754
  derived and/or modified sequence opt3 from neuraminidase__InfluenzaA__ADM95650

SEQ ID NO: 141715 - RNA, 1410 nt, Artificial Sequence; identical to SEQ ID NO: 138754
  derived and/or modified sequence opt3 from neuraminidase__InfluenzaA__ADM95651

SEQ ID NO: 141716 - RNA, 1410 nt, Artificial Sequence
  derived and/or modified sequence opt3 from neuraminidase__InfluenzaA__ADM95652
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaauuugccggaaauucgucacugugcccugugagcgggugggcgauauacaguaaggacaacuccauuagaaucggcucuaaaggugauguuuucgugauuagggagccauuuaucagcuguuccccguuggaaugccggaccuucuuuuuaacacagggggcucugcuaaaugacaagcauucaaacggaaccaucaaagaucgcagucccuaucgaacucucaugagcuguccuauuggcgaggucccaucucccuacaacucccguuucgaaucaguggccuggagcgcaagugccugccacgacggcauaaauuggcugacaaucgggauuucuggaccugauaacggugcuguagcaguucuuaaguauaauggcaucauaaccgacacgauuaaguccuggagaaacaauauccugaggacucaagagagcgagugugccugcgugaacgggucguguuuuaccgucaugacagauggaccaucugacggccaggcuuccuacaaaaucuuccggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuuuaaucagaacuuggaauaucagauaggauacaucuguucaggcauuuucggcgauaauccgaggcccaacgacaaaaccgggaauugcggaccugugaguuccaacggugcgaacggcguaaagggguuuagcuucaaguauggaaauggcguguggaucggucggacaaaaucuaucucaagucgcaacggguuugagaugauuugggauccaaauggcuggaccggaacggacaacaauuucagcauaaagcaagacaucgucggcauuaacgaaugguccggguacucuggaucguucgugcagcaucccgagcucacuggucuggauuguauccgaccuugcuuuuggguugaacugauuagaggcaggccaaaagagaauacaaucuggaccagcggguccucaauaaguuucuguggagugaacucugacacugucggcuggagcuggcccgauggugcagagcucccguuuacaaucgacaaguga

SEQ ID NO: 141717 - RNA, 1410 nt, Artificial Sequence
  derived and/or modified sequence opt3 from neuraminidase__InfluenzaA__ADM95654
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgccauggguucgagaugauuugggauccaaauggcuggaccggaacggacaacaauuuuuccauaaagcaagacaucgucggcacuaacgaauggucuggguacucggggagcuucgugcagcaccccgagcugacaggucuggauuguauucgaccuugcuucuggguugaacucaucagaggcaggccaaaagagaauaccauuuggacuuccgggucaaguaucucuuuuuguggagugaacagcgacacagucggcugguccuggcccgauggugcagaguuaccguucaccauagacaaguga

SEQ ID NO: 141718 - RNA, 1410 nt, Artificial Sequence
  derived and/or modified sequence opt3 from neuraminidase__InfluenzaA__ADM95655
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccagugacaaaaccggguccugcggaccugugagcucuaacggugcgaauggcguaaagggguucucauuuaaguauggaaacggcguguggaucggucggacaaaaaguaucagcucccgcaacggguucgagaugauuugggauccaaauggcuggaccggaacggacaacgacuuuucuauaaagcaagauaucgucggcauuaaugaauggucgggguacagcggauccuucgugcagcaucccgagcugacuggucuggacuguauccgaccuugcuucuggguugaacucauuagaggcaggccaaaagagaacacaaucuggaccucagggaguucuauaucguuuuguggagucaauuccgauacugugggcuggucauggcccgacggugcagaguuaccguucacaaucgauaaguga

SEQ ID NO: 141719 - RNA, 1410 nt, Artificial Sequence; identical to SEQ ID NO: 140366
  derived and/or modified sequence opt3 from neuraminidase__InfluenzaA__ADM95656

SEQ ID NO: 141720 - RNA, 1410 nt, Artificial Sequence; identical to SEQ ID NO: 139931
  derived and/or modified sequence opt3 from neuraminidase__InfluenzaA__ADM95658

SEQ ID NO: 141721 - RNA, 1410 nt, Artificial Sequence
  derived and/or modified sequence opt3 from neuraminidase__InfluenzaA__ADM95659
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcuccggguucgagaugauuugggauccaaauggcuggaccggaacggacaacaauuuuucuauaaagcaagacaucauuggcacuaacgaauggucgggguacagcggauccuucguccagcaucccgagcugacaggucuggauuguauccgaccuugcuucuggguggaacucauuagaggcaggccaaaagagaauaccaucuggacuucagggaguucuauaucguuuuguggaguuaacuccgacacagugggcuggucauggcccgauggugcagaguuaccguucaccaucgacaaguga

SEQ ID NO: 141722 - RNA, 1410 nt, Artificial Sequence; identical to SEQ ID NO: 138754
  derived and/or modified sequence opt3 from neuraminidase__InfluenzaA__ADM95660

SEQ ID NO: 141723 - RNA, 1410 nt, Artificial Sequence
  derived and/or modified sequence opt3 from neuraminidase__InfluenzaA__ADM95661
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcacuaaugaauggucuggguacucggggagcuucgugcagcaucccgagcugacaggucuggauuguauucgaccuugcuucuggguugaacucaucagaggcaggccaaaagagaacaccauuuggacuuccgggucaaucauaaguuuuuguggagucaauucugacacagugggcuggagcuggcccgauggugcagaguuaccguucaccaucgacaaguga

SEQ ID NO: 141724 - RNA, 1410 nt, Artificial Sequence; identical to SEQ ID NO: 140366
  derived and/or modified sequence opt3 from neuraminidase__InfluenzaA__ADM95662

SEQ ID NO: 141725 - RNA, 1410 nt, Artificial Sequence
  derived and/or modified sequence opt3 from neuraminidase__InfluenzaA__ADM95663
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugaacgggugggcgauauacagcaaggacaauaguauuagaaucggcuccaaaggugauguuuuugugauuagggagccauucaucucuuguagcccguuagaaugccggaccuuuuuccugacacagggggcucuacucaacgacaagcauuccaacggaaccaucaaagaucgcucacccuaucgaacucugaugaguuguccuauuggcgaggucccaagccccuacaauucucguuuugaauccguggccuggucagcaagcgccugccacgacggcauaaacuggcuuacaaucgggauuaguggaccugauaauggugcuguagcaguucugaaguauaacggcaucauaaccgacacgauuaagucuuggagaaauaacaucuugaggacucaagaguccgagugugccugcgugaaugggagcuguuucaccgucaugacagauggaccaucggacggccaggcuucuuacaaaaucuuucggauugaaaaggguaaaaucgugaaguccauugagaugaacgcccccaauuaucauuacgaagagugcucauguuacccugauaguagcgagauaacuugcgugugccgcgacaacuggcacggguccaauagaccaugggucucuuucaaccagaaucucgaauaucagaucggauacauuuguagcggcaucuuuggcgauaacccgaggcccaaugacaaaaccgggucaugcggaccuguuaguuccaacggugcgaacggcgugaagggguucagcuuuaaguauggaaauggcguauggaucggucggacaaaaucuauuucaagucgcaacggguucgagaugauaugggauccaaauggcuggaccggaacggacaacaauuuuagcaucaagcaagacauugugggcacuaacgaaugguccggguacucuggaucguucguccagcaucccgagcugacaggucuggauuguauccgaccuugcuucuggguggaacucauuagaggcaggccaaaagagaauaccaucuggacuagcggguccauaaucucauuuuguggaguuaacagugacacagugggcuggucuuggcccgauggugcagaguuaccguucaccauugacaaguga

SEQ ID NO: 141726 - RNA, 1410 nt, Artificial Sequence; identical to SEQ ID NO: 140366
  derived and/or modified sequence opt3 from neuraminidase__InfluenzaA__ADM95664

SEQ ID NO: 141727 - RNA, 1410 nt, Artificial Sequence; identical to SEQ ID NO: 140366
  derived and/or modified sequence opt3 from neuraminidase__InfluenzaA__ADM95665

SEQ ID NO: 141728 - RNA, 1410 nt, Artificial Sequence
  derived and/or modified sequence opt3 from neuraminidase__InfluenzaA__ADM95666
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugaacgggugggcgauauacagcaaggacaauaguauuagaaucggcuccaaaggugauguuuuugugauuagggagccauucaucucuuguagcccguuagaaugccggaccuuuuuccugacacagggggcucuacucaacgacaagcauuccaacggaaccaucaaagaucgcucacccuaucgaacucugaugaguuguccuauuggcgaggucccaagccccuacaauucucguuuugaauccguggccuggucagcaagcgccugccacgacggcauaaacuggcuuacaaucgggauuaguggaccugauaauggugcuguagcaguucugaaguauaacggcaucauaaccgacacgauuaagucuuggagaaauaacaucuugaggacucaagaguccgagugugccugcgugaaugggagcuguuucaccgucaugacagauggaccaucggacggccaggcuucuuacaaaaucuuuaagauugaaaaagguaagaucgugaaauccguggagaugaacgcccccaauuaucauuacgaagagugcucauguuacccugauaguagcgagauuacuugcgucugccgggacaacuggcacggguccaaucgcccauggguuucuuucaaccagaaucucgaauaucagauaggauacaucuguagcggcauuuuuggcgauaacccgagacccaaugacaagaccgggucaugcggaccugugaguuucaacggugcgaacggcguaaagggguuuuccuucaaauauggaaauggcguguggaucgguaggacaaagagcaucucuucacggaacggguuugagaugauuugggauccaaauggcuggaccggaacggacaacaauuucaguauaaaacaagacaucgucggcacuaacgaauggagcggguacuccggaucuuucgugcagcaucccgagcugacaggucuggauuguauucgcccuugcuuuuggguugaacucauccgaggcagaccaaaggagaauaccauuuggacuucggggagcaucauauccuucuguggagugaacucagacacagucggcuggaguuggcccgauggugcagaguuaccguuuaccaucgacaaauga

SEQ ID NO: 141729 - RNA, 1410 nt, Artificial Sequence; identical to SEQ ID NO: 140366
  derived and/or modified sequence opt3 from neuraminidase__InfluenzaA__ADM95667

SEQ ID NO: 141730 - RNA, 1410 nt, Artificial Sequence; identical to SEQ ID NO: 140366
  derived and/or modified sequence opt3 from neuraminidase__InfluenzaA__ADM95668

SEQ ID NO: 141731 - RNA, 1410 nt, Artificial Sequence; identical to SEQ ID NO: 138754
  derived and/or modified sequence opt3 from neuraminidase__InfluenzaA__ADM95669

SEQ ID NO: 141732 - RNA, 1410 nt, Artificial Sequence; identical to SEQ ID NO: 138754
  derived and/or modified sequence opt3 from neuraminidase__InfluenzaA__ADM95670

SEQ ID NO: 141733 - RNA, 1410 nt, Artificial Sequence
  derived and/or modified sequence opt3 from neuraminidase__InfluenzaA__ADM95672
augaaccccaaucagaagaucauuaccauaggcagcgugugcaugacaaucgggauggccaaccugauucuccaaaucggaaauauuaucuccauauggaucucucacacuauucagcuugguaaccagaaucagaucgagacguguaaccaaucagucauuaccuacgaaaauaacacauggguuaaucagacuuaugugaacaucaguaauaccaacuucgcugcaggccagagcguaguguccgucaaacuggccggaaauucuucguugugcccugugucagggugggcgauauacagcaaggacaacaguauuagaaucggcuccaaaggugauguuuuugugauuagggagccauucaucucuuguagcccguuagaaugccggacauuuuuccugacccagggggcucuacucaaugacaagcauuccaacggaacuaucaaagaucgcucacccuaucgaacacugaugaguuguccuauuggcgaggucccaagccccuacaacucucguuuugaauccguggccuggucagcaagcgccugccacgacggcauaaauuggcuuaccaucgggauuaguggaccugauaacggugcuguagcaguucugaaguauaauggcaucauaacggacacuauuaagucuuggagaaacaauaucuugaggacccaagaguccgagugugccugcgugaacgggagcuguuucacagucaugacugauggaccaucggacggccaggcuucuuacaaaaucuuucggauugaaaaggguaaaaucgugaaguccguggagaugaaugcccccaacuaucauuacgaagagugcucauguuacccugauaguagcgagauuaccugcgucugccgcgacaauuggcacggguccaacagaccauggguuucuuucaaucagaaccucgaauaucagauaggauacaucuguagcggcauuuuuggcgauaauccgaggcccaacgacaaaacagggucaugcggaccugugaguuccaauggugcgaacggcguaaagggguucagcuuuaaguauggaaacggcguguggaucggucggaccaaaucuaucucaagucgcaauggguucgagaugauuugggauccaaacggcuggacgggaacugacaauaacuuuagcauaaagcaagacaucgucggcacaaaugaaugguccggguacucuggaucguucgugcagcaucccgagcugaccggucuggauuguauucgaccuugcuucuggguugaacucaucagaggcaggccaaaagagaacacuauuuggacaagcggguccucaaucaguuuuuguggagucaauucugacaccgugggcuggagcuggcccgauggugcagaguuaccguucacgauagacaaguga

SEQ ID NO: 141734 - RNA, 1410 nt, Artificial Sequence; identical to SEQ ID NO: 138754
  derived and/or modified sequence opt3 from neuraminidase__InfluenzaA__ADM95673

SEQ ID NO: 141735 - RNA, 1410 nt, Artificial Sequence; identical to SEQ ID NO: 140366
  derived and/or modified sequence opt3 from neuraminidase__InfluenzaA__ADM95674

SEQ ID NO: 141736 - RNA, 1410 nt, Artificial Sequence; identical to SEQ ID NO: 138754
  derived and/or modified sequence opt3 from neuraminidase__InfluenzaA__ADM95675

SEQ ID NO: 141737 - RNA, 1410 nt, Artificial Sequence
  derived and/or modified sequence opt3 from neuraminidase__InfluenzaA__ADM95677
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugaacgggugggcgauauacagcaaggacaauaguauuagaaucggcuccaaaggugauguuuuugugauuagggagccauucaucucuuguagcccguuagaaugccggaccuuuuuccugacacagggggcucuacucaacgacaagcauuccaacggaaccaucaaagaucgcucacccuaucgaacucugaugaguuguccuauuggcgaggucccaagccccuacaauucucguuuugaauccguggccuggucagcaagcgccugccacgacggcauaaacuggcuuacaaucgggauuaguggaccugauaauggugcuguagcaguucugaaguauaacggcaucauaaccgacacgauuaagucuuggagaaauaacaucuugaggacucaagaguccgagugugccugcgugaaugggagcuguuucaccgucaugacagauggaccaucggacggccaggcuucuuacaaaaucuuucggauugaaaaggguaaaaucgugaaguccguggagaugaacgcccccaauuaucauuacgaagagugcucauguuacccugauaguagcgagauuacuugcgucugccgcgacaacuggcacggguccaauagaccauggguuucuuucaaccagaaucucgaauaucagauaggauacaucuguagcggcauuuuuggcgauaacccgaggcccaaugacaaaaccgggucaugcggaccugugaguuccaacggugcgaacggcguaaagggguucagcuuuaaguauggaaauggcguguggaucggucggacaaaaucuaucucaagucgcaacggguucgagaugauuugggauccaaauggcuggaccggaacggacaacaauuuuagcauaaagcaagacaucgucggcacuaacgaaugguccggguacucuggaucguucgugcagcaucccgagcugacaggucuggauuguauucgaccuugcuucuggguugaacucaucagaggcaggccaaaagagaauaccauuuggacuagcggguccaucauaucauuuuguggagugaacagugacacagucggcuggucuuggcccgauggugcagaguuaccguucaccaucgacaaguga

SEQ ID NO: 141738 - RNA, 1410 nt, Artificial Sequence
  derived and/or modified sequence opt3 from neuraminidase__InfluenzaA__ADM95678
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaauuugccggaaauucgucacugugcccugugagcggaugggcgauauacaguaaggacaacuccauuagaaucggcucuaaaggugauguuuucgugauuagggagccauuuaucagcuguuccccguuggaaugccggaccuucuuuuuaacacagggggcucugcuaaaugacaagcauucaaacggaaccaucaaagaucgcagucccuaucgaacucucaugagcuguccuauuggcgaggucccaucucccuacaacucccguuucgaaucaguggccuggagcgcaagugccugccacgacggcauaaauuggcugacaaucgggauuucuggaccugauaacggugcuguagcaguucuuaaguauaauggcaucauaaccgacacgauuaaguccuggagaaacaauauccugaggacucaagagagcgagugugccugcgugaacgggucguguuuuaccgucaugacagauggaccaucugacggccaggcuuccuacaaaaucuuccggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuuuaaucagaacuuggaauaucagauaggauacaucuguucaggcauuuucggcgauaauccgaggcccaacgacaaaaccgggaguugcggaccuguguccagcaauggugcgaacggcguaaagggguuuucuuucaaguauggaaacggcguguggaucggucggacaaaaucaaucaguagccgcaauggguuugagaugauuugggauccaaacggcuggaccggaacggacaauaacuucuccauaaagcaagacaucgucggcauuaaugaauggucuggguacucggggagcuucgugcagcaucccgagcucacuggucuggauuguauccgaccuugcuuuuggguugaacugauuagaggcaggccaaaagagaacacaaucuggaccuccgggucaaguauaucuuucuguggagugaauagcgacacugucggcugguccuggcccgauggugcagagcucccguuuacaaucgacaaguga

SEQ ID NO: 141739 - RNA, 1410 nt, Artificial Sequence; identical to SEQ ID NO: 141737
  derived and/or modified sequence opt3 from neuraminidase__InfluenzaA__ADM95679

SEQ ID NO: 141740 - RNA, 1410 nt, Artificial Sequence; identical to SEQ ID NO: 141737
  derived and/or modified sequence opt3 from neuraminidase__InfluenzaA__ADM95680

SEQ ID NO: 141741 - RNA, 1410 nt, Artificial Sequence; identical to SEQ ID NO: 138754
  derived and/or modified sequence opt3 from neuraminidase__InfluenzaA__ADM95681

SEQ ID NO: 141742 - RNA, 1410 nt, Artificial Sequence
  derived and/or modified sequence opt3 from neuraminidase__InfluenzaA__ADM95682
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagauuuguaaccaaagugucaucacuuacgaaaauaacacguggguuaaucagaccuaugugaacauaagcaauacaaacuucgcugcaggccaguccguagugucugucaaacuggccggaaauucgucauugugcccugugagcggaugggcgauuuacaguaaggacaacuccaucagaauuggcucuaaaggugauguuuuugugaucagggagccauucaucagcuguuccccguuagaaugccggaccuuuuuccugacucagggggcucuacucaaugacaagcauucaaacggaacaauuaaagaucgcagucccuaucgaacccugaugagcuguccuauaggcgaggucccaucucccuacaacucccguuuugaaucaguggccuggagcgcaagugccugccacgacggcaucaauuggcuuacuauugggaucucuggaccugauaacggugcuguagcaguucugaaguauaauggcauaauuacagacaccaucaaguccuggagaaacaauaucuugaggacgcaagagagcgagugugccugcgugaacgggucguguuucacugucaugaccgauggaccaucugacggccaggcuuccuacaaaauuuuucggaucgaaaaggguaaaauugugaagucaguggagaugaaugcccccaacuaucauuacgaagagugcaguuguuacccugauagcuccgagauaacaugcgucugccgcgacaauuggcacgggucuaacagaccauggguuagcuucaaucagaaccucgaauaucagaucggauacauuuguucaggcaucuuuggcgauaauccgaggcccaacgacaaaacugggaguugcggaccuguguccagcaauggugcgaacggcguaaagggguucucuuuuaaguauggaaacggcguguggaucggucggaccaaaucaauuaguagccgcaauggguucgagaugauaugggauccaaacggcuggacaggaaccgacaauaacuuuuccaucaagcaagacauugucggcacgaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucacaaucgacaaguga

SEQ ID NO: 141743 - RNA, 1410 nt, Artificial Sequence
  derived and/or modified sequence opt3 from neuraminidase__InfluenzaA__ADM95683
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguaugucuuuuuguggagugaauagcgacacugucggcugguccuggcccgauggugcagaguuaccguucacaauagacaaguga

SEQ ID NO: 141744 - RNA, 1410 nt, Artificial Sequence; identical to SEQ ID NO: 138754
  derived and/or modified sequence opt3 from neuraminidase__InfluenzaA__ADM95684

SEQ ID NO: 141745 - RNA, 1410 nt, Artificial Sequence
  derived and/or modified sequence opt3 from neuraminidase__InfluenzaA__ADM95685
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgccauggguucgagaugauuugggauccaaauggcuggaccggaacggacaacaauuuuuccauaaagcaagacaucgucggcacuaacgaauggucuggguacucggggagcuucgugcagcaccccgagcugacaggucuggauuguauucgaccuugcuucuggguugaacucaucagaggcaggccaaaagagaauaccguguggacuuccgggucaaguauuucuuuuuguggagucaacagcgacacagugggcugguccuggcccgauggugcagaguuaccguucaccaucgacaaguga

SEQ ID NO: 141746 - RNA, 1410 nt, Artificial Sequence
  derived and/or modified sequence opt3 from neuraminidase__InfluenzaA__ADM95686
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaaugacuuuuccauaaagcaagauaucgucggcauuaacgaauggucuggguacucggggagcuucgugcagcaucccgagcugacuggucuggacuguauccgaccuugcuucuggguugaacucauuagaggcaggccaaaagagaauacaaucuggaccuccgggucaaguauaucuuuuuguggagugaacagcgauacugucggcugguccuggcccgacggugcagaguuaccguucacaaucgauaaguga

SEQ ID NO: 141747 - RNA, 1410 nt, Artificial Sequence; identical to SEQ ID NO: 138754
  derived and/or modified sequence opt3 from neuraminidase__InfluenzaA__ADM95687

SEQ ID NO: 141748 - RNA, 1410 nt, Artificial Sequence
  derived and/or modified sequence opt3 from neuraminidase__InfluenzaA__ADM95688
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcacuaaugaauggucuggguacucggggagcuucgugcagcaucccgagcugacacgacuggauuguauuagaccuugcuucuggguugaacucaucaggggucggccaaaagagaacaccauuuggacuuccggcucaaucauaaguuuuuguggggucaauucugacacagugggauggagcuggcccgauggcgcagaguuaccguucaccaucgacaaguga

SEQ ID NO: 141749 - RNA, 1410 nt, Artificial Sequence; identical to SEQ ID NO: 141746
  derived and/or modified sequence opt3 from neuraminidase__InfluenzaA__ADM95689

SEQ ID NO: 141750 - RNA, 1410 nt, Artificial Sequence
  derived and/or modified sequence opt3 from neuraminidase__InfluenzaA__ADM95690
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucauuggcacuaaugaauggucuggguacucggggagcuucguccagcaucccgagcugacaggucuggauuguauccgaccuugcuucuggguggaacucauuagaggcaggccaaaagagaacaccaucuggacuuccgggucaaguauaucuuuuuguggaguuaauagcgacacagugggcugguccuggcccgauggugcagaguuaccguucaccaucgacaaguga

SEQ ID NO: 141751 - RNA, 1410 nt, Artificial Sequence; identical to SEQ ID NO: 138754
  derived and/or modified sequence opt3 from neuraminidase__InfluenzaA__ADM95691

SEQ ID NO: 141752 - RNA, 1410 nt, Artificial Sequence
  derived and/or modified sequence opt3 from neuraminidase__InfluenzaA__ADM95692
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucauaaauacuaacuucgcugcaggccagagcguaguguccgucaaacuggccggaaauucuucguugugcccugugucagggugggcgauuuacagcaaggacaacaguaucagaauuggcuccaaaggugauguuuuugugaucagggagccauucaucucuuguagcccguuagaaugccggaccuuuuuccugacacagggggcucuacucaaugacaagcauuccaacggaaccauuaaagaucgcucacccuaucgaacucugaugaguuguccuauaggcgaggucccaagccccuacaacucucguuuugaauccguggccuggucagcaagcgccugccacgacggcaucaauuggcuuacaauugggaucaguggaccugauaacggugcuguagcaguucugaaguauaauggcauaauuaccgacacgaucaagucuuggagaaacaauaucuugaggacucaagaguccgagugugccugcgugaacgggagcuguuucaccgucaugacagauggaccaucggacggccaggcuucuuacaaaauuuuucggaucgaaaaggguaaaauugugaaguccguggagaugaaugcccccaacuaucauuacgaagagugcucauguuacccugauaguagcgagauaacuugcgucugccgcgacaauuggcacggguccaacagaccauggguuucuuucaaucagaaccucgaauaucagaucggauacauuuguagcggcaucuuuggcgauaauccgaggcccaacgacaaaaccgggucaugcggaccugugaguuccaauggugcgaacggcguaaagggguucagcuuuaaguauggaaacggcguguggaucggucggacaaaaucuauuucaagucgcaauggguucgagaugauaugggauccaaacggcuggaccggaacggacaauaacuuuagcaucaagcaagacauugucggcaucaaugaaugguccggguacucuggaucguucgugcagcaucccgagcugacuggucuggauuguauucgaccuugcuucuggguugaacucaucagaggcaggccaaaagagaacacaauauggaccagcggguccucaaucaguuuuuguggagucaauucugacacugugggcuggagcuggcccgauggugcagaguuaccguucacaauugacaaguga

SEQ ID NO: 141753 - RNA, 1410 nt, Artificial Sequence; identical to SEQ ID NO: 138754
  derived and/or modified sequence opt3 from neuraminidase__InfluenzaA__ADM95693

SEQ ID NO: 141754 - RNA, 1410 nt, Artificial Sequence; identical to SEQ ID NO: 138754
  derived and/or modified sequence opt3 from neuraminidase__InfluenzaA__ADM95694

SEQ ID NO: 141755 - RNA, 1410 nt, Artificial Sequence; identical to SEQ ID NO: 138754
  derived and/or modified sequence opt3 from neuraminidase__InfluenzaA__ADM95695

SEQ ID NO: 141756 - RNA, 1410 nt, Artificial Sequence; identical to SEQ ID NO: 141746
  derived and/or modified sequence opt3 from neuraminidase__InfluenzaA__ADM95696

SEQ ID NO: 141757 - RNA, 1410 nt, Artificial Sequence; identical to SEQ ID NO: 140366
  derived and/or modified sequence opt3 from neuraminidase__InfluenzaA__ADM95697

SEQ ID NO: 141758 - RNA, 1413 nt, Artificial Sequence
  derived and/or modified sequence opt3 from neuraminidase__InfluenzaA__ADM95698
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacaauaccugggugaaccauacauaugucaauaucaacaauacuaacguuguggcagaagaggacaaaaccucuguaacacuugccggaaauucgucacuguguagcauuagugggugggcgaucuacaccaaggauaacuccaucaggauuggcucuaaaggugacguguucgucauacgggaaccuuuuaucagcugcucccacuuggagugucgcacuuucuuuuuaacacaaggggcucugcuaaaugauaagcauucaaacggaaccgugaaagaccgaaguccauaucgugcccucaugagcugcccgcugggcgaagcacccucuccuuacaacuccaaguucgagucaguugccuggagcgcuagugcaugucacgauggcaugggguggcuuacgauuggaaucucugguccagacaauggcgccguggcuguccugaaguauaacgggauaauuacuggaaccaucaaauccuggaagaaacagaucuugagaacacaggagagcgaaugcguguguaugaauggcucgugcuuuacuauuaugaccgauggucccucuaacaaggccgcguccuacaaaaucuucaagauugagaaggggaaaguaacaaagucaauagaacucaaugcaccuaacuuucauuaugaggaguguaguugcuacccagacaccggaaucguuaugugugugugcagggauaauuggcacggcagcaaccggcccugggucuccuucaaucagaaccuggacuaccaaauuggcuauaucugcucugggguguuuggagauaauccucgcccagaagacggugagggcagcuguaacccggugacggucgauggggccaauggaguuaaaggcuucucauacaaguaugacaacgguguguggaucgggagaacuaaaaguaauaggcugcggaagggcuuugaaaugauuugggaccccaacggauggacaaacaccgauuccgacuucagcguaaaacaggauguggucgcuauaacugacuggucuggcuacucagggaguuuugugcagcacccugagcucacaggauuagauugcauccgcccauguuucuggguugaacuggugcgaggucagcccagagagaauaccacgauuuggaccagcggcuccucuaucucguucugcggggucaacagcgacacagccaauugguccuggccugauggagcagagcuuccauuuacuauugacaaguga

SEQ ID NO: 141759 - RNA, 1413 nt, Artificial Sequence
  derived and/or modified sequence opt3 from neuraminidase__InfluenzaA__ADM95699
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacaauaccugggugaaccauacauaugucaauaucaacaauacuaacguuguggcagaagaggacaaaaccucuguaacacuugccggaaauucgucacuguguagcauuagugggugggcgaucuacaccaaggauaacuccaucaggauuggcucuaaaggugacguguucgucauacgggaaccuuuuaucagcugcucccacuuggagugucgcacuuucuuuuuaacacaaggggcucugcuaaaugauaagcauucaaacggaaccgugaaagaccgaaguccauaucgugcccucaugagcugcccgcugggcgaagcacccucuccuuacaacuccaaguucgagucaguugccuggagcgcuagugcaugucacgauggcaugggguggcuuacgauuggaaucucugguccagacaauggcgccguggcuguccugaaguauaacgggauaauuacuggaaccaucaaauccuggaagaaacagaucuugagaacacaggagagcgaaugcguguguaugaauggcucgugcuuuacuauuaugaccgauggucccucuaacaaggccgcguccuacaaaaucuucaagauugagaaggggaaaguaacaaagucaauagaacucaaugcaccuaacuuuuauuacgaggaguguaguugcuacccagacaccggaaucguuaugugugugugcagggauaauuggcauggcagcaaccggcccugggucuccuucaaucagaaccuggacuaucaaauuggcuacaucugcucugggguguuuggagauaauccucgcccagaagacggugagggcagcuguaacccggugacggucgauggggccaauggaguuaaaggcuucucauauaaguacgacaacgguguguggaucgggagaacuaaaaguaauaggcugcggaagggcuuugaaaugauuugggaccccaacggauggacaaacaccgauuccgacuucagcguaaaacaggauguggucgcuauaacugacuggucuggcuauucagggaguuuugugcagcacccugagcucacaggauuagauugcauccgcccauguuucuggguugaacuggugcgaggucuucccagagagaauaccacgauuuggaccagcggcuccucuaucucguucugcggggucaacagcgacacagccaauugguccuggccugauggagcagaguugccauuuacuauugacaaguga

SEQ ID NO: 141760 - RNA, 1413 nt, Artificial Sequence
  derived and/or modified sequence opt3 from neuraminidase__InfluenzaA__ADM95701
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacaauaccugggugaaccauacauaugucaauaucaacaauacuaacguuguggcagaagaggacaaaaccucuguaacacuugccggaaauucgucacuguguagcauuagugggugggcgaucuacaccaaggauaacuccaucaggauuggcucuaaaggugacguguucgucauacgggaaccuuuuaucagcugcucccacuuggagugucgcacuuucuuuuuaacacaaggggcucugcuaaaugauaagcauucaaacggaaccgugaaagaccgaaguccauaucgugcccucaugagcugcccgcugggcgaagcacccucuccuuacaacuccaaguucgagucaguugccuggagcgcuagugcaugucacgauggcaugggguggcuuacgauuggaaucucugguccagacaauggcgccguggcuguccugaaguauaacgggauaauuacuggaaccaucaaauccuggaagaaacagaucuugagaacacaggagagcgaaugcguguguaugaauggcucgugcuuuacuauuaugaccgauggucccucuaacaaggccgcguccuacaaaaucuucaagauugagaaggggaaaguaacaaagucaauagaacucaaugcaccuaacuuucauuaugaggaguguaguugcuacccagacaccggaaucguuaugugugugugcagggauaauuggcacggcagcaaccggcccugggucuccuucaaucagaaccuggacuaccaaauuggcuauaucugcucugggguguuuggagauaauccucgcccagaagacggugagggcagcuguaacccggugacggucgauggggccaauggaguuaaaggcuucucauacaaguaugacaacgguguguggaucgggagaacuaaaaguaauaggcugcggaagggcuuugaaaugauuugggaccccaacggauggacaaacaccgauuccgacuucagcguaaaacaggauguggucgcuauaacugacuggucuggcuacucagggaguuuugugcagcacccugagcucacaggauuagauugcauccgcccauguuucuggguugaacuggugcgaggucuucccagagagaauaccacgauuuggaccagcggcuccucuaucucguucugcggggucaacagcgacacagccaauugguccuggccugauggagcagaguugccauuuacuauugacaaguga

SEQ ID NO: 141761 - RNA, 1413 nt, Artificial Sequence
  derived and/or modified sequence opt3 from neuraminidase__InfluenzaA__ADM95702
augaaccccaaucagaagaucauuaccauaggcagcaucuccauugccaucgggauuaucucucugaugcuccaaauaggaaacaucauuucaaucugggcuagucacagcauucagacagguagacagaauaacacuggcaucugcaaucagaggauaauuacguacgagaacuccaccugggugaaucauacauaugucaacaucaauaacacuaaaguuguggcaggggaagacaagaccucuguaacacuugccggaaauucgucacuguguagcauuaguggcugggcgaucuacaccaaagauaacuccauccggauugguucuaagggggacguguucgucauacgcgagccuuuuaucagcugcucccacuuggaaugucgaacuuucuuuuuaacacaaggagcucugcuaaaugauaaacauucaaacggcaccgugaaggaccguaguccauauagagcccucaugagcugcccgcugggcgaggcacccucuccuuacaauuccaaguucgaaucaguugccuggagcgcuagugcaugucacgaugggaugggauggcuuacgauugguaucucuggcccagacaacggggccguggcuguccugaaauauaacggaauaauuacuggcaccaucaaguccuggaaaaagcagaucuugaggacacaggagagcgagugcguguguaugaaugguucgugcuuuacuauuaugaccgaugggcccucuaacaaagccgcguccuacaagaucuucaagauugaaaaaggaaagguaacaaaaucaauagagcucaaugcaccuaacuuuuauuacgaagaguguaguugcuacccagacaccggcaucguuaugugugugugccgggauaauuggcauggcagcaaccgccccugggucuccuucaaucagaaccuggacuaucaaauuggguacaucugcucuggaguguuuggugauaauccuagaccagaggacggcgaagggagcuguaacccggugacggucgauggagccaauggcguuaaggguuucucauauaaauacgggaacggcguguggaucggaaggacuaagaguaaucggcugcgcaaaggcuuugagguaauuugggaccccaacggguggacaaauaccgacuccgauuucagcgugaagcaggacgucguggcuauaacugauuggucuggauauucagguaguuuuguucagcacccugaacucacaggcuuagacugcauccgaccauguuucuggguggagcuggucagagggcuucccagggaaaacaccacgauuuggaccagcggauccucuaucucguucugcggcgugaacagcgauacagccaauugguccuggccugacggugcagaguugccauuuacuauugauaaguga

SEQ ID NO: 141762 - RNA, 1413 nt, Artificial Sequence
  derived and/or modified sequence opt3 from neuraminidase__InfluenzaA__ADM95704
augaaccccaaucagaagaucauuaccauaggcagcaucuccauugccaucgggauuaucucucugaugcuccaaauaggaaacaucgugucaauuugggcuagucacagcauccagacagguucccagaauaacacuggcauuugcaaucagagaaucauaacguacgagaacaauaccugggucaaccauacauauguuaauauuaacaauacuaacgugguagcagaagaggacaaaaccucugugacacuugccggaaauucgucacuguguagcaucagugggugggcgauuuacaccaaggauaacuccaucaggaucggcucuaaaggugacgucuucgugauucgggaaccuuuuauaagcugcucccacuuggagugucgcacuuucuuuuuaacacaaggggcucugcuaaaugauaagcauucaaacggaaccguuaaagaccgaaguccauaucgugcccucaugagcugcccgcugggcgaagcacccucuccuuacaacuccaaguucgagucaguggccuggagcgcuagugcaugucacgauggcaugggguggcuuacgaucggaauuucugguccagacaauggcgccgucgcugugcugaaguauaacgggaucauaacuggaaccauuaaauccuggaagaaacagaucuugagaacacaggagagcgaaugcguauguaugaauggcucgugcuuuacuaucaugaccgauggucccucuaacagggccgcguccuacaagauuuucaaaaucgagaaggggaagguuacaaaaucaauugaacucaaugcaccuaacuuucauuaugaggaguguaguugcuacccagacaccggaauagugaugugugucugccgggauaauuggcacggcagcaaccgccccuggguguccuucaaucagaaccuggacuaccaaaucggcuauauuugcucugggguguuuggagauaauccuagaccagaagacggugagggcagcuguaacccggucacgguugauggggccaauggagugaagggcuucucauacaaauaugacaacgguguauggaucgggaggacuaagaguaaucggcugcgcaaaggcuuugaaaugaucugggaccccaacggauggacaaacaccgauuccgacuucagcgugaagcaggaugucguggcuauuacugacuggucuggcuacucagggaguuuuguucagcacccugagcucacaggauuagauugcauacgaccauguuucuggguggaacuggucagaggucuucccagggagaauaccacgaucuggaccagcggcuccucuauuucguucugcggggugaacagcgacacagccaauugguccuggccugauggagcagaguugccauuuacuaucgacaaauga

SEQ ID NO: 141763 - RNA, 1413 nt, Artificial Sequence
  derived and/or modified sequence opt3 from neuraminidase__InfluenzaA__ADM95705
augaaccccaaucagaagaucauuaccauaggcagcaucuccauugccaucgggauuaucucucugaugcuccaaauaggaaacaucauuucaaucugggcuagucacagcauucagacagguagacagaauaacacuggcaucugcaaucagaggauaauuacguacgagaacuccaccugggugaaucauacauaugucaacaucaauaacacuaaaguuguggcaggggaagacaagaccucuguaacacuugccggaaauucgucacuguguagcauuaguggcugggcgaucuacaccaaagauaacuccauccggauugguucuaagggggacguguucgucauacgcgagccuuuuaucagcugcucccacuuggaaugucgaacuuucuuuuuaacacaaggagcucugcuaaaugauaaacauucaaacggcaccgugaaggaccguaguccauauagagcccucaugagcugcccgcugggcgaggcacccucuccuuacaauuccaaguucgaaucaguugccuggagcgcuagugcaugucacgaugggaugggauggcuuacgauugguaucucuggcccagacaacggggccguggcuguccugaaauauaacggaauaauuacuggcaccaucaaguccuggaaaaagcagaucuugaggacacaggagagcgagugcguguguaugaaugguucgugcuuuacuauuaugaccgaugggcccucuaacaaagccgcguccuacaagaucuucaagauugaaaaaggaaagguaacaaaaucaauagagcucaaugcaccuaacuuuuauuacgaagaguguaguugcuacccagacaccggcaucguuaugugugugugccgggauaauuggcauggcagcaaccgccccugggucuccuucaaucagaaccuggacuaucaaauuggguacaucugcucuggaguguuuggugauaauccuagaccagaggacggcgaagggagcuguaacccggugacggucgauggagccaauggcguuaaggguuucucauauaaauacgggaacggcguguggaucggaaggacuaagaguaaucggcugcgcaaaggcuuugagaugauuugggaccccaacggguggacaaauaccgacuccgauuucagcguaaagcaggacguggucgcuauaacugauuggucuggauauucagguaguuuugugcagcacccugaacucacaggcuuagacugcauccgaccauguuucuggguugagcuggugagagggcuucccagggaaaacaccacgauuuggaccagcggauccucuaucucguucugcggcgucaacagcgauacagccaauugguccuggccugacggugcagaguugccauuuacuauugauaaguga

SEQ ID NO: 141764 - RNA, 1413 nt, Artificial Sequence; identical to SEQ ID NO: 141763
  derived and/or modified sequence opt3 from neuraminidase__InfluenzaA__ADM95706

SEQ ID NO: 141765 - RNA, 1413 nt, Artificial Sequence; identical to SEQ ID NO: 141763
  derived and/or modified sequence opt3 from neuraminidase__InfluenzaA__ADM95707

SEQ ID NO: 141766 - RNA, 1413 nt, Artificial Sequence; identical to SEQ ID NO: 139477
  derived and/or modified sequence opt3 from neuraminidase__InfluenzaA__ADM95708

SEQ ID NO: 141767 - RNA, 1410 nt, Artificial Sequence
  derived and/or modified sequence opt3 from neuraminidase__InfluenzaA__ADM95710
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacaauaucgugagcucguacgucuguucuggacuggugggcgacacgccccgcaagaacgauuccucaaguagcucccauugccuugacccuaauaacgaggaaggugggcacggaguuaaaggcugggcuuucgaugacggcaaugauguguggauggggcgaaccauuucugaaaagagcagauugggauaugagacauuuaaagucaucgaggguuggucaaacccaaagaguaaacugcagauuaauaggcaagugauaguagaccggggcaaccguuccggguacagcggaaucuucucuguugagggcaagucauguauuaaucgcugcuuuuauguggaacuaaucagagguaggaaggaggaaacugauguccucuggaccaguaacagcaucguggucuucugugggacauccggcacuuacggaaccggcucuuggcccgacggggccgauauuaaucugaugccuauauga

SEQ ID NO: 141768 - RNA, 1410 nt, Artificial Sequence; identical to SEQ ID NO: 138615
  derived and/or modified sequence opt3 from neuraminidase__InfluenzaA__ADM95711

SEQ ID NO: 141769 - RNA, 1410 nt, Artificial Sequence; identical to SEQ ID NO: 138615
  derived and/or modified sequence opt3 from neuraminidase__InfluenzaA__ADM95712

SEQ ID NO: 141770 - RNA, 1410 nt, Artificial Sequence; identical to SEQ ID NO: 138615
  derived and/or modified sequence opt3 from neuraminidase__InfluenzaA__ADM95713

SEQ ID NO: 141771 - RNA, 1410 nt, Artificial Sequence
  derived and/or modified sequence opt3 from neuraminidase__InfluenzaA__ADM95714
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaagucaagauugggauaugagacauuuaaagucaucgaagguuggaguaauccaaaguccaaacugcagauuaacaggcaagugauaguagaccggggcaaucguagcggguacucuggaaucuucucaguugagggcaagaguuguauuaaccgcugcuuuuauguggaacuaaucagagguaggaaggaggaaacugauguccucuggaccagcaauuccaucguggucuucugugggacaucuggcacuuacggaaccggcucguggcccgacggggccgauauuaaccugaugccuauauga

SEQ ID NO: 141772 - RNA, 1410 nt, Artificial Sequence; identical to SEQ ID NO: 138615
  derived and/or modified sequence opt3 from neuraminidase__InfluenzaA__ADM95715

SEQ ID NO: 141773 - RNA, 1410 nt, Artificial Sequence; identical to SEQ ID NO: 141771
  derived and/or modified sequence opt3 from neuraminidase__InfluenzaA__ADM95716

SEQ ID NO: 141774 - RNA, 1410 nt, Artificial Sequence; identical to SEQ ID NO: 141771
  derived and/or modified sequence opt3 from neuraminidase__InfluenzaA__ADM95717

SEQ ID NO: 141775 - RNA, 1410 nt, Artificial Sequence; identical to SEQ ID NO: 138615
  derived and/or modified sequence opt3 from neuraminidase__InfluenzaA__ADM95718

SEQ ID NO: 141776 - RNA, 1410 nt, Artificial Sequence
  derived and/or modified sequence opt3 from neuraminidase__InfluenzaA__ADM95719
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaagucaagaaguggauaugagacauuuaaagucaucgaagguugguccaauccaaagagcaaauugcagauuaacaggcaagugauaguagaccggggcaaucguucuggguacucaggaaucuucaguguugagggcaagagcuguauuaaccgcugcuuuuauguggaacugaucagagguaggaaggaggaaacugagguccuauggaccuccaauucuaucguggucuucugugggacaucgggcacuuacggaaccggcagcuggcccgauggggccgacauuaaccucaugccuauauga

SEQ ID NO: 141777 - RNA, 1410 nt, Artificial Sequence; identical to SEQ ID NO: 138615
  derived and/or modified sequence opt3 from neuraminidase__InfluenzaA__ADM95720

SEQ ID NO: 141778 - RNA, 1410 nt, Artificial Sequence; identical to SEQ ID NO: 138615
  derived and/or modified sequence opt3 from neuraminidase__InfluenzaA__ADM95721

SEQ ID NO: 141779 - RNA, 1410 nt, Artificial Sequence; identical to SEQ ID NO: 138615
  derived and/or modified sequence opt3 from neuraminidase__InfluenzaA__ADM95723

SEQ ID NO: 141780 - RNA, 1410 nt, Artificial Sequence
  derived and/or modified sequence opt3 from neuraminidase__InfluenzaA__ADM95724
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaagucaagauugggauaugagacauuuaaagucaucgaagguuggaguaauccaaacuccaagcugcagauuaauaggcaagugauaguagaccggggcaaccguagcggguacucuggaaucuucucaguugagggcaaaaguuguauuaaucgcugcuuuuauguggaacuaaucagagguaggaaggaggaaacugagguccucuggaccagcaacuccaucguggucuucugugggacaucuggcacuuacggaaccggcucguggcccgauggggccgacauuaaucugaugccuauauga

SEQ ID NO: 141781 - RNA, 1410 nt, Artificial Sequence
  derived and/or modified sequence opt3 from neuraminidase__InfluenzaA__ADM95725
augaaccccaaucagaagaucauuaccauaggcagcgugucccugacaaucucuacuauuugcuucuuuaugcaaaucgccauucucaucacgaccgucacacuucacuucaaacaguacgaguuuaacccuccaccgaauaaccagguuaugcugugugaacccacuauaaucgagagaaauauuaccgaaaucguguauuugacaaacaccacuauugagaaggaaguaugcccuaaauuagcugaguacaggaauuggucaaagccacagugugacaucacaggguucgcacccuuuaguaaagauaacagcauacggcuguccgccggaggugacauuugggugacccgcgagccuuaugucucuugcgauccagacaaguguuaccaauucgcgcuaggccaggggacgacucucaauaacgugcauucgaauaacaccguucgagaucguacacccuauagaacucugcuuaugaaugaacugggagugccuuuucacuugggcaccaagcaggucugcaucgcuuggucaagcaguuccugucaugacgguaaagccuggcuccacgugugcauuacaggggaugacaagaacgcaaccgccucuuucaucuacaauggaaggcugguagauagcguuguguccuggucaaaagagauccugcggacgcaggaaagugagugugucugcauuaacggcacuuguacaguggugauaaccgacggcagcgcuucugggaaggcagauacuaaaauccucuuuauugaggaaggaaagaucguccauacauccaccuuaucagguagcgcccaacacguugaggaaugcaguugcuauccacgcuacccgggcgugagauguguaugcagggacaacuggaaggggucuaaucggcccauaguggauauuaacaucaaagaccacuccaucgucagcucguacguguguucuggacugguuggcgacacgccucgcaagaaugauuccucaaguagcucccauugccuugacccaaacaaugaggaaggugggcacggagugaaaggcugggcuuucgaugacggcaacgaugucuggauggggcgaaccauuucugaaaagagcagauugggauaugagacauuuaaagugaucgaggguuggucaaaucccaagaguaaacugcagauuaacaggcagguaauaguugaccggggcaaucguuccggguacagcggaaucuucucuguggagggcaagucauguauuaaccgcugcuuuuaugucgaacuaaucagagguaggaaggaggaaacugaugugcucuggaccaguaauagcaucgucguguucugugggacauccggcacuuacggaaccggcucuuggccugacggggccgauauuaaccugaugccaauauga

SEQ ID NO: 141782 - RNA, 1410 nt, Artificial Sequence
  derived and/or modified sequence opt3 from neuraminidase__InfluenzaA__ADM95726
augaaccccaaucagaagaucauuaccauaggcagcgugucccugacaaucucuacuauuugcuucuuuaugcaaaucgccauucucaucacggcugucacccuucacuucaaacaguacgaguuuaacucaccuccaaauaaccagguuaugcugugugaaccgacaauaaucgagagaaauauuacugaaaucguguauuugaccaacacaaccauugagaaggaaaucugccccaaauuagcagaguacaggaauuggaguaagccucagugugacauaacuggguucgccccauuuagcaaagauaacuccauucggcugucugcgggaggugacaucuggguaacacgcgagcccuaugugucgugcgauccugacaaguguuaccaauucgcucuaggccaggggaccacgcucaauaacguccauucaaauaacacugugcgagaucguaccccauauagaacacugcuuaugaaugaacugggaguucccuuucacuugggcacuaaacaggugugcauugccuggagcaguuccucuugucaugacgguaaggcauggcuccacgucugcaucaccggggaugacaagaacgccacagcuagcuucaucuacaauggaaggcugguggauuccguaguuucauggaguaaagagauucugcggacccaggaaagcgagugugugugcauaaacggcacguguacugucgugaugacagacggcucugcauccgggaaggccgauaccaaaauccucuuuauugaggaaggaaagaucgugcauacuucaacauuaagcgguagugcucaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacccccaggaagaaugauucaaguagcuccucucauugccuugacccuaacaaugaggaaggugggcacggaguuaaaggcugggccuucgaugacggcaacgauguguggauggggcgaacgauuagcgagaagucaagauugggauaugagaccuuuaaagucaucgaagguuggaguaauccaaaguccaaacugcagauuaaccgccaggugauaguagaccggggcaaucguagcggguacucuggaaucuucucaguugagggcaagaguuguauuaaccgcugcuuuuauguggaacuaaucagagguaggaaggaggaaacagauguccucuggacuagcaauuccaucguggucuucugugggaccucuggcacauacggaacuggcucguggcccgacggggcggauauuaaccugaugccuauauga

SEQ ID NO: 141783 - RNA, 1410 nt, Artificial Sequence; identical to SEQ ID NO: 138615
  derived and/or modified sequence opt3 from neuraminidase__InfluenzaA__ADM95727

SEQ ID NO: 141784 - RNA, 1410 nt, Artificial Sequence
  derived and/or modified sequence opt3 from neuraminidase__InfluenzaA__ADM95728
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccgaguuagcugaguacaggaauuggaguaaaccucagugugacauaacaggguucgcaccauuuagcaaggauaacuccauucggcugucugccggaggugacaucuggguaacccgcgaacccuaugugucgugcgauccugacaaauguuaccaauucgcgcuaggccaggggacgacucucaauaacguccauucaaauaacaccgugcgagaucguacaccauauagaacucugcuuaugaaugagcugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaggaaauucugcggacgcaggagagcgagugugugugcauaaacggcacuuguacagucgugaugaccgacggcucugcuuccgggaaagcagauacuaagauccucuuuauugaagagggaaaaaucgugcauacaucaaccuuaagcgguagugcccaacacgucgaagagugcucuugcuauccucgcuacccaggcguuagaugugugugcagggacaacuggaagggguccaaucggccgauaguagauauuaacaucaaggaccacagcaucgugucgucuuacgucuguuccggacuggugggcgacacgccccgcaaaaaugauucaaguagcuccucucauugccuugacccuaacaaugaagagggugggcacggaguuaagggcugggcuuucgaugacggcaacgauguguggauggggcgaaccauuagcgagaaaucaagauugggauaugaaacauuuaaggucaucgaggguuggaguaauccaaaauccaagcugcagauuaacaggcaagugauaguagaccggggcaaucguagcggguacucuggaaucuucucaguugaaggcaaaaguuguauuaaccgcugcuuuuauguggagcuaaucagagguaggaaggaagagacugagguccucuggaccagcaauuccaucguggucuucugugggacaucuggcacuuacggaaccggcucguggcccgauggggccgacauuaaccugaugccuauauga

SEQ ID NO: 141785 - RNA, 1410 nt, Artificial Sequence
  derived and/or modified sequence opt3 from neuraminidase__InfluenzaA__ADM95729
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagccgaucccauugccuugacccuaacaaugaggaaggugggcacggaguuaaaggcugggcuuucgaugacggcaacgauguguggauggggagaaccauuucugaaaagagcagguugggauaugagacauuuaaagucaucgaggguuggucaaauccaaagaguaaacugcagauuaaccgucaggugauaguagaccggggcaaucgcuccggguacagcggaaucuucucuguugagggcaagucauguauuaacagaugcuuuuauguggaacuaaucaggggucggaaggaggaaacugagguccucuggaccaguaauagcaucguggucuucugugggacauccggcacuuacggaaccggcucuuggcccgauggggccgacauuaaccugaugccuauauga

SEQ ID NO: 141786 - RNA, 1410 nt, Artificial Sequence
  derived and/or modified sequence opt3 from neuraminidase__InfluenzaA__ADM95730
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaguaaucagguuaugcugugugaaccgacuauaaucgagagaaacauuaccgaaaucguguauuugacaaauaccacuauugagaaggaaaucugccccaaauuagcugaguacaggaacuggagcaagccucagugugacauaacaggguucgcaccauuuuccaaagauaauucuauucggcugucggccggaggugacaucuggguaacccgcgagcccuaugugucaugcgauccugacaaguguuaccaauucgcgcuaggccaggggacgacucucaacaauguccauagcaacaauaccgugcgagaucguacaccauauagaacucugcuuaugaacgaacugggaguucccuuucacuugggcaccaaacaggugugcauugcuuggaguuccucuagcugucaugacgguaaggccuggcuccacgucugcaucacaggggaugacaagaaugcaaccgccuccuucaucuacaacggaaggcugguggauucaguaguuaguuggagcaaagagauucugcggacgcaggaaucugagugugugugcauaaauggcacuuguacagucgugaugaccgacggcuccgcuucagggaaggcagauacuaaaauccucuuuauugaggaaggaaagaucgugcauacaagcaccuuaagugguucugcccaacacgucgaggaaugcuccugcuauccucgcuacccaggcguuagaugugugugcagggacaacuggaaggggagcaaccggccgauaguagauauuaauaucaaagaccacucgaucgugucuuccuacgucuguucaggacuggugggcgacacgccccgcaagaacgauaguagcuccucuagccauugccuugacccuaauaacgaggaaggugggcacggaguuaaaggcugggcuuucgaugacggcaaugauguguggauggggcgaaccauuucagagaagaguagauugggauaugagacauuuaaagucaucgaagguugguccaacccaaagagcaaacugcagauuaauaggcaagugauaguagaccggggcaaccguucuggguacucaggaaucuucaguguugagggcaagagcuguauuaaucgcugcuuuuauguggaacuaaucagagguaggaaggaggaaacugagguccucuggaccuccaacucuaucguggucuucugugggacaucgggcacuuacggaaccggcagcuggcccgauggggccgacauuaaucugaugccuauauga

SEQ ID NO: 141787 - RNA, 1410 nt, Artificial Sequence
  derived and/or modified sequence opt3 from neuraminidase__InfluenzaA__ADM95732
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccgggaaggcagacacuaaaauucucuuuaucgaggaaggaaagauagugcauacaucaaccuuaagcgguagugcccaacacguggaggaaugcucuugcuauccucgcuacccaggcgucagauguguuugcagggauaacuggaagggguccaaccggccgauuguggacaucaauaucaaagaccgcagcauuguaucgucuuacguguguuccggacuggucggcgauacgccccgaaagaacgacucaaguagcuccucucacugccuugauccuaauaacgaggaaggugggcauggagugaaaggcugggcuuucgacgauggcaaugacguuuggauggggagaaccaucagcgagaagucaagguugggauaugagacauuuaaagugauugaagguuggaguaaccacaaguccaaacugcagauaaaucggcaggucaucguggaucguggcaaccgcagcggguacucuggaauuuucucaguagagggcaagaguuguaucaauagaugcuuuuauguugaacuaaucaggggucggaaggaggaaacugaggugcucuggaccagcaacuccauugucguguucugugggacaucuggcacuuacggaaccggcucguggccagacggggccgauauaaaucugaugcccaucuga

SEQ ID NO: 141788 - RNA, 1410 nt, Artificial Sequence; identical to SEQ ID NO: 138615
  derived and/or modified sequence opt3 from neuraminidase__InfluenzaA__ADM95733

SEQ ID NO: 141789 - RNA, 1410 nt, Artificial Sequence; identical to SEQ ID NO: 138615
  derived and/or modified sequence opt3 from neuraminidase__InfluenzaA__ADM95734

SEQ ID NO: 141790 - RNA, 1410 nt, Artificial Sequence; identical to SEQ ID NO: 138615
  derived and/or modified sequence opt3 from neuraminidase__InfluenzaA__ADM95735

SEQ ID NO: 141791 - RNA, 1410 nt, Artificial Sequence; identical to SEQ ID NO: 138615
  derived and/or modified sequence opt3 from neuraminidase__InfluenzaA__ADM95736

SEQ ID NO: 141792 - RNA, 1410 nt, Artificial Sequence
  derived and/or modified sequence opt3 from neuraminidase__InfluenzaA__ADM95737
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggcgcgcagauacuaagauccucuuuauugaggaaggaaaaaucgugcauacaucaaccuuaagcgguagugcccaacacgucgaggaaugcucuugcuauccuagauacccaggcguuaggugugugugccgggacaacuggaagggguccaaucgcccgauaguagauauuaacaucaaggaccacagcaucgugucgucuuacgucuguuccggacuggugggcgacacgccccggaaaaaugauucaaguagcuccucucauugccuugacccuaacaaugaggaaggugggcacggaguuaagggcugggcuuucgaugacggcaacgauguguggauggggagaaccauuagcgagaaaucaagguugggauaugagacauuuaaggucaucgaagguuggaguaauccaaaauccaagcugcagauuaaccgacaggugauaguagaccguggcaaucgcagcggguacucuggaaucuucucaguugagggcaaaaguuguauuaacagaugcuuuuauguggaacuaaucaggggucggaaggaggaaacugauguccucuggaccagcaauuccaucguggucuucugugggacaucuggcacuuacggaaccggcucguggcccgacggggccgauauuaaccugaugccuauauga

SEQ ID NO: 141793 - RNA, 1410 nt, Artificial Sequence; identical to SEQ ID NO: 138615
  derived and/or modified sequence opt3 from neuraminidase__InfluenzaA__ADM95738

SEQ ID NO: 141794 - RNA, 1410 nt, Artificial Sequence; identical to SEQ ID NO: 138615
  derived and/or modified sequence opt3 from neuraminidase__InfluenzaA__ADM95739

SEQ ID NO: 141795 - RNA, 1410 nt, Artificial Sequence
  derived and/or modified sequence opt3 from neuraminidase__InfluenzaA__ADM95740
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacgaugaggaaggugggcacggaguuaaaggcugggcuuucgacgauggcaaugacguguggauggggcgaaccauuagcgagaagucaagauugggauaugagacauuuaaagucaucgaagguuggaguaacccaaaguccaaacugcagauuaauaggcaagugauaguagaucggggcaaccguagcggguacucuggaaucuucucaguugagggcaagaguuguauuaaucgcugcuuuuauguggaacuaaucagagguaggaaggaggaaacuaaaguccucuggaccagcaacuccaucguggucuucugugggacaucuggcacuuacggaaccggcucguggcccgacggggccgauauuaaucugaugccuauauga

SEQ ID NO: 141796 - RNA, 1410 nt, Artificial Sequence; identical to SEQ ID NO: 141771
  derived and/or modified sequence opt3 from neuraminidase__InfluenzaA__ADM95741

SEQ ID NO: 141797 - RNA, 1410 nt, Artificial Sequence; identical to SEQ ID NO: 138615
  derived and/or modified sequence opt3 from neuraminidase__InfluenzaA__ADM95742

SEQ ID NO: 141798 - RNA, 1410 nt, Artificial Sequence
  derived and/or modified sequence opt3 from neuraminidase__InfluenzaA__ADM95743
augaaccccaaucagaagaucauuaccauaggcagcgugucccugacaaucucuacuauuugcuucuuuaugcagaucgccauucucaucacgaccgucacacuucacuucaaacaguacgaguuuaacucaaguccuaauaaccagguuaugcugugugaaccaacuauaaucgagagaaauauuaccgaaaucguguauuugacaaacaccacuauugagaaggaaaucugcccgaaauuagcugaguacaggaauuggagcaagccccagugugacauaacaggguucgcaccuuuuuccaaagauaacucuauucggcugucggccggaggugacaucuggguaacccgcgagccauaugugucaugcgaucccgacaaguguuaccaauucgcgcuaggccaggggacgacucucaauaacguccauagcaauaacaccgugcgagaucguacaccuuauagaacucugcuuaugaaugaacugggaguuccauuucacuugggcaccaaacaggugugcauugcuuggaguuccucuagcugucaugacgguaaggccuggcuccacgucugcaucacaggggaugacaagaacgcaaccgccuccuucaucuacaauggaaggcugguggauucaguaguuaguuggagcaaagagauucugcggacgcaggaaucugagugugugugcauaaacggcacuuguacagucgugaugaccgacggcuccgcuucagggaaggcagauacuaaaauccucuuuauugaggaaggaaagaucgugcauacaagcaccuuaagugguucugcccaacacgucgaggaaugcuccugcuauccccgcuacccuggcguuagaugugugugcagggacaacuggaaggggagcaaucggccaauaguagauauuaacaucaaagaccacucgaucgugucuuccuacgucuguucaggacuggugggcgacacgccgcgcaagaaugauaguagcuccucuagccauugccuugaccccaacaaugaggaaggugggcacggaguuaaaggcugggcuuucgaugacggcaacgauguguggauggggcgaaccauuucagagaagaguagauugggauaugagacauuuaaagucaucgaagguugguccaauccuaagagcaaacugcagauuaacaggcaagugauaguagaccggggcaaucguucuggguacucaggaaucuucaguguugagggcaagagcuguauuaaccgcugcuuuuauguggaacuaaucagagguaggaaggaggaaacugagguccucuggaccuccaauucuaucguggucuucugugggacaucgggcacuuacggaaccggcagcuggccagauggggccgacauuaaccugaugcccauauga

SEQ ID NO: 141799 - RNA, 1410 nt, Artificial Sequence; identical to SEQ ID NO: 138615
  derived and/or modified sequence opt3 from neuraminidase__InfluenzaA__ADM95744

SEQ ID NO: 141800 - RNA, 1410 nt, Artificial Sequence; identical to SEQ ID NO: 138754
  derived and/or modified sequence opt3 from neuraminidase__InfluenzaA__ADN05229

SEQ ID NO: 141801 - RNA, 1413 nt, Artificial Sequence; identical to SEQ ID NO: 139477
  derived and/or modified sequence opt3 from neuraminidase__InfluenzaA__ADN06292

SEQ ID NO: 141802 - RNA, 1413 nt, Artificial Sequence; identical to SEQ ID NO: 140946
  derived and/or modified sequence opt3 from neuraminidase__InfluenzaA__ADN06303

SEQ ID NO: 141803 - RNA, 1413 nt, Artificial Sequence
  derived and/or modified sequence opt3 from neuraminidase__InfluenzaA__ADN06314
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggagguguucgucauacgggaaccuuuuaucuccugcucacacuuggagugucgcacuuucuuuuuaacacaaggagcucugcuaaacgacaagcauaguaauggcaccgugaaagaucgaagcccauaucgugcccucaugucuugcccgcugggcgaagcacccuccccuuacaacucaaaguucgagagcguugccuggagugcuucugcaugucacgacgggaugggauggcuuacgauugguaucuccggcccagauaacggggccguggcuguccugaaguauaauggaauaauuacuggcaccaucaaaagcuggaagaaacagaucuugagaacacaggagucggaaugcguguguaugaacgguucuugcuuuacuauuaugaccgacgggcccuccaauaaggccgcgucauacaaaaucuucaagauugagaagggaaaaguaacaaagaguauagaacucaacgcaccuaauuuuuauuacgaggaguguagcugcuacccagauaccggcaucguuaugugugugugcagggacaacuggcauggcuccaaucggcccugggucucuuucaaccagaaucuggauuaucaaauuggguacaucugcagcggaguguuuggugacaacccucgcccagaagauggcgaggggucauguaauccggugacggucgacggagccaacggcguuaaagguuucaguuauaaguacgggaauggcguguggaucggaagaacuaaauccaacaggcugcggaagggcuuugaaaugauuugggaucccaauggguggacaaacaccgacagcgacuucucuguaaaacaggauguggucgcuauaacugacuggucaggauauagugguagcuuugugcagcacccugagcucacaggcuuagauugcauccgcccauguuucuggguugaacuggugcgagggcuucccagagagaacaccacgauuuggaccuccggaucuucgaucagcuucugcggcgucaauggugacacagccaacugguccuggccugauggggcagaguugccauuuacuauugacaaguga

SEQ ID NO: 141804 - RNA, 1413 nt, Artificial Sequence; identical to SEQ ID NO: 140946
  derived and/or modified sequence opt3 from neuraminidase__InfluenzaA__ADN06325

SEQ ID NO: 141805 - RNA, 1413 nt, Artificial Sequence
  derived and/or modified sequence opt3 from neuraminidase__InfluenzaA__ADN06347
augaaccccaaucagaagaucauuaccauaggcagcaucuccauugccaucgggauuaucucucugaugcuccaaauaggaaacaucauuucaaucugggcuagucacagcauucagacagagucccagaauaacacugguaucugcaaucagagaauaauuacguacgaaaacucuaccugggugaaucauacauaugucaacaucaauaacacuaauguuguggcaggcgaggacaaaaccucgguaacacuugccgggaacucaagccuguguaguauuuccggaugggcgaucuacaccaaggauaauucuaucaggauuggcagcaaaggugacguguucgucauacgggaaccuuuuaucuccugcucacacuuggagugucgcacuuucuuuuuaacacaaggggcucugcuaaacgauaagcauaguaauggaaccgugaaagaccgaagcccauaucgugcccucaugucuugcccgcugggcgaagcacccuccccuuacaacucaaaguucgagagcguugccuggagugcuucugcaugucacgauggcaugggguggcuuacgauuggaaucuccgguccagacaacggcgccguggcuguccugaaguauaaugggauaauuacuggaaccaucaaaagcuggaagaaacagaucuugagaacacaggagucggaaugcguguguaugaacggcucuugcuuuacuauuaugaccgauggucccuccaauaaggccgcgucauacaaaaucuucaagauugagaaggggaaaguaacaaagaguauagaacucaacgcaccuaauuuuuauuacgaggaguguagcugcuacccagacaccggaaucguuaugugugugugcagggauaacuggcauggcuccaaucggcccugggucucuuucaaccagaaucuggacuaucaaaugggcuacauuugcagcgggguguuuggagauaacccucgcccagaagacggugagggcucauguaauccggugaacgucgauggggccaauggaguuaaaggcuucaguuauaaguacgguaacgggguguggaucggcagaacgaaauccaauaggcugcggaagggauuugaaaugaucugggaccccaacggcuggacuaacacagacagcgauuucucuguaaaacaggacguggucgcuauuaccgauuggucaggguauagugguagcuuugugcagcacccugagcucacuggauuagacugcauacgcccauguuucuggguugaacuggugcgaggccuucccagagagaauacaaccaucuggacguccgggucuucgauuagcuucugcggagucaacuccgauaccgccaauuggucauggccugacggcgcagaguugccauuuacaaucgauaaguga

SEQ ID NO: 141806 - RNA, 1410 nt, Artificial Sequence; identical to SEQ ID NO: 141426
  derived and/or modified sequence opt3 from neuraminidase__InfluenzaA__ADN06369

SEQ ID NO: 141807 - RNA, 1410 nt, Artificial Sequence; identical to SEQ ID NO: 138754
  derived and/or modified sequence opt3 from neuraminidase__InfluenzaA__ADN26031

SEQ ID NO: 141808 - RNA, 1410 nt, Artificial Sequence; identical to SEQ ID NO: 138754
  derived and/or modified sequence opt3 from neuraminidase__InfluenzaA__ADN26032

SEQ ID NO: 141809 - RNA, 1410 nt, Artificial Sequence; identical to SEQ ID NO: 138754
  derived and/or modified sequence opt3 from neuraminidase__InfluenzaA__ADN26033

SEQ ID NO: 141810 - RNA, 1410 nt, Artificial Sequence; identical to SEQ ID NO: 138754
  derived and/or modified sequence opt3 from neuraminidase__InfluenzaA__ADN26034

SEQ ID NO: 141811 - RNA, 1410 nt, Artificial Sequence; identical to SEQ ID NO: 138754
  derived and/or modified sequence opt3 from neuraminidase__InfluenzaA__ADN26035

SEQ ID NO: 141812 - RNA, 1410 nt, Artificial Sequence; identical to SEQ ID NO: 138754
  derived and/or modified sequence opt3 from neuraminidase__InfluenzaA__ADN26036

SEQ ID NO: 141813 - RNA, 1410 nt, Artificial Sequence
  derived and/or modified sequence opt3 from neuraminidase__InfluenzaA__ADN26037
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucuaauggccaggcuuccuacaaaaucuuucggaucgaaaaggguaaaauugugaagucagucgagaugaacgcccccaauuaucauuacgaagagugcaguuguuacccugacagcuccgagaucacuugcguuugccgcgauaacuggcacgggucuaauagaccaugggugagcuucaaccagaaucucgaauaucagauuggauacauauguucaggcaucuuuggcgacaacccgaggcccauugauaaaaccgggaguugcggaccuguauccagcaauggugcgaacggcgugaagggguucucuuuuaaguauggaaacggcgucuggaucggucggacaaaaucaaucaguagccgcaauggguucgagaugauuugggacccaaacggcuggaccggaacggauaauaacuuuuccauaaagcaagacaucgugggcauuaaugaauggucuggguacucggggagcuucguucagcaucccgagcugacuggucuggacuguauccgaccuugcuucuggguggaacucauuagaggcaggccaaaagagaacacaaucuggaccuccgggucaaguauaucuuuuuguggagucaauagcgauacugugggcugguccuggcccgacggugcagaguuaccguucacaaucgauaaguga

SEQ ID NO: 141814 - RNA, 1410 nt, Artificial Sequence; identical to SEQ ID NO: 138754
  derived and/or modified sequence opt3 from neuraminidase__InfluenzaA__ADN26038

SEQ ID NO: 141815 - RNA, 1410 nt, Artificial Sequence; identical to SEQ ID NO: 138754
  derived and/or modified sequence opt3 from neuraminidase__InfluenzaA__ADN26041

SEQ ID NO: 141816 - RNA, 1410 nt, Artificial Sequence; identical to SEQ ID NO: 138754
  derived and/or modified sequence opt3 from neuraminidase__InfluenzaA__ADN26042

SEQ ID NO: 141817 - RNA, 1410 nt, Artificial Sequence
  derived and/or modified sequence opt3 from neuraminidase__InfluenzaA__ADN26043
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucaggugggauacauauguucaggcaucuuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacaauaacuuuuccauuaagcaagacauagugggcaucaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcagaguuaccguucacaauagacaaguga

SEQ ID NO: 141818 - RNA, 1410 nt, Artificial Sequence; identical to SEQ ID NO: 138754
  derived and/or modified sequence opt3 from neuraminidase__InfluenzaA__ADN26044

SEQ ID NO: 141819 - RNA, 1410 nt, Artificial Sequence; identical to SEQ ID NO: 138754
  derived and/or modified sequence opt3 from neuraminidase__InfluenzaA__ADN26045

SEQ ID NO: 141820 - RNA, 1410 nt, Artificial Sequence
  derived and/or modified sequence opt3 from neuraminidase__InfluenzaA__ADN26047
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccaugguaucugugaaacugaccggaaauucgucauugugcccugucagcggaugggccauauacaguaaggacaacuccgugagaauuggcucuaaaggugauguuuuugugaucagggagccauucauuagcuguuccccguuagaaugccggacauuuuuccugacccagggggcgcuacucaaugacaagcauucaaacggaacuaucaaagaucgcagucccuaucgaacacugaugagcuguccuaucggcgaggucccaucucccuacaacucccguuuugaaucaguggcuuggagcgccagugcaugccacgacggcauuaauuggcuuaccauagggaucucuggaccugauaacggugccguagcuguucugaaguauaauggcauuaucacggacacuauaaaguccuggagaaacaauauuuugaggacccaagagagcgagugugcaugcgugaacgggucguguuucacagucaugacugauggaccaucuaauggccaggccuccuacaaaaucuuucggaucgaaaaggguaaaauugugaagucaguggagaugaacgcucccaauuaucauuacgaagagugcaguuguuacccugacagcuccgagauuaccugcgucugccgcgauaacuggcacgggucuaauagaccauggguuagcuucaaccagaaucucgaauaucagaucggauacauauguucaggcaucuuuggcgacaacccgaggcccaaugauaaaacagggaguugcggaccuguguccagcaacggugccaacggcguaaagggguucucuuuuaaguauggaaauggcguguggauuggucggaccaaaucaaucaguagccgcaacggguucgagaugaucugggacccaaauggcuggacgggaacugauaacaauuuuuccauuaagcaagacauagucggcaucaacgaauggucuggguacucggggagcuucgugcagcaucccgagcugacaggucuggacuguauucgaccuugcuucuggguugaacucaucagaggcaggccaaaagagaauaccauuuggacuuccgggucaaguaucucuuuuuguggagugaacagcgauacagucggcugguccuggcccgacggugcggaguuaccguucaccauagauaaguga

SEQ ID NO: 141821 - RNA, 1410 nt, Artificial Sequence; identical to SEQ ID NO: 138754
  derived and/or modified sequence opt3 from neuraminidase__InfluenzaA__ADN26048

SEQ ID NO: 141822 - RNA, 1410 nt, Artificial Sequence; identical to SEQ ID NO: 138754
  derived and/or modified sequence opt3 from neuraminidase__InfluenzaA__ADN26049

SEQ ID NO: 141823 - RNA, 1410 nt, Artificial Sequence; identical to SEQ ID NO: 138754
  derived and/or modified sequence opt3 from neuraminidase__InfluenzaA__ADN26050

SEQ ID NO: 141824 - RNA, 1410 nt, Artificial Sequence; identical to SEQ ID NO: 138754
  derived and/or modified sequence opt3 from neuraminidase__InfluenzaA__ADN26051

SEQ ID NO: 141825 - RNA, 1410 nt, Artificial Sequence; identical to SEQ ID NO: 138754
  derived and/or modified sequence opt3 from neuraminidase__InfluenzaA__ADN26052

SEQ ID NO: 141826 - RNA, 1410 nt, Artificial Sequence; identical to SEQ ID NO: 138744
  derived and/or modified sequence opt3 from neuraminidase__InfluenzaA__ADN26053

SEQ ID NO: 141827 - RNA, 1410 nt, Artificial Sequence; identical to SEQ ID NO: 138754
  derived and/or modified sequence opt3 from neuraminidase__InfluenzaA__ADN26054

SEQ ID NO: 141828 - RNA, 1410 nt, Artificial Sequence; identical to SEQ ID NO: 138754
  derived and/or modified sequence opt3 from neuraminidase__InfluenzaA__ADN26057

SEQ ID NO: 141829 - RNA, 1410 nt, Artificial Sequence; identical to SEQ ID NO: 138754
  derived and/or modified sequence opt3 from neuraminidase__InfluenzaA__ADN26058

SEQ ID NO: 141830 - RNA, 1410 nt, Artificial Sequence; identical to SEQ ID NO: 138754
  derived and/or modified sequence opt3 from neuraminidase__InfluenzaA__ADN26059

SEQ ID NO: 141831 - RNA, 1410 nt, Artificial Sequence; identical to SEQ ID NO: 139121
  derived and/or modified sequence opt3 from neuraminidase__InfluenzaA__ADN26060

SEQ ID NO: 141832 - RNA, 1410 nt, Artificial Sequence; identical to SEQ ID NO: 138754
  derived and/or modified sequence opt3 from neuraminidase__InfluenzaA__ADN26061

SEQ ID NO: 141833 - RNA, 1410 nt, Artificial Sequence; identical to SEQ ID NO: 138754
  derived and/or modified sequence opt3 from neuraminidase__InfluenzaA__ADN26063

SEQ ID NO: 141834 - RNA, 1410 nt, Artificial Sequence; identical to SEQ ID NO: 138754
  derived and/or modified sequence opt3 from neuraminidase__InfluenzaA__ADN26064

SEQ ID NO: 141835 - RNA, 1410 nt, Artificial Sequence; identical to SEQ ID NO: 139827
  derived and/or modified sequence opt3 from neuraminidase__InfluenzaA__ADN26065

SEQ ID NO: 141836 - RNA, 1410 nt, Artificial Sequence; identical to SEQ ID NO: 138754
  derived and/or modified sequence opt3 from neuraminidase__InfluenzaA__ADN26066

SEQ ID NO: 141837 - RNA, 1410 nt, Artificial Sequence; identical to SEQ ID NO: 138754
  derived and/or modified sequence opt3 from neuraminidase__InfluenzaA__ADN26067

SEQ ID NO: 141838 - RNA, 1410 nt, Artificial Sequence; identical to SEQ ID NO: 138754
  derived and/or modified sequence opt3 from neuraminidase__InfluenzaA__ADN26069

SEQ ID NO: 141839 - RNA, 1410 nt, Artificial Sequence; identical to SEQ ID NO: 138754
  derived and/or modified sequence opt3 from neuraminidase__InfluenzaA__ADN26070

SEQ ID NO: 141840 - RNA, 1410 nt, Artificial Sequence; identical to SEQ ID NO: 138754
  derived and/or modified sequence opt3 from neuraminidase__InfluenzaA__ADN26072

SEQ ID NO: 141841 - RNA, 1410 nt, Artificial Sequence; identical to SEQ ID NO: 138754
  derived and/or modified sequence opt3 from neuraminidase__InfluenzaA__ADN26073

SEQ ID NO: 141842 - RNA, 1410 nt, Artificial Sequence; identical to SEQ ID NO: 138754
  derived and/or modified sequence opt3 from neuraminidase__InfluenzaA__ADN26075

SEQ ID NO: 141843 - RNA, 1410 nt, Artificial Sequence; identical to SEQ ID NO: 138754
  derived and/or modified sequence opt3 from neuraminidase__InfluenzaA__ADN26076

SEQ ID NO: 141844 - RNA, 1410 nt, Artificial Sequence; identical to SEQ ID NO: 138754
  derived and/or modified sequence opt3 from neuraminidase__InfluenzaA__ADN26077

SEQ ID NO: 141845 - RNA, 1410 nt, Artificial Sequence; identical to SEQ ID NO: 138754
  derived and/or modified sequence opt3 from neuraminidase__InfluenzaA__ADN26078

SEQ ID NO: 141846 - RNA, 1410 nt, Artificial Sequence; identical to SEQ ID NO: 138754
  derived and/or modified sequence opt3 from neuraminidase__InfluenzaA__ADN26079

SEQ ID NO: 141847 - RNA, 1410 nt, Artificial Sequence; identical to SEQ ID NO: 138754
  derived and/or modified sequence opt3 from neuraminidase__InfluenzaA__ADN26080

SEQ ID NO: 141848 - RNA, 1410 nt, Artificial Sequence; identical to SEQ ID NO: 138754
  derived and/or modified sequence opt3 from neuraminidase__InfluenzaA__ADN26081

SEQ ID NO: 141849 - RNA, 1410 nt, Artificial Sequence; identical to SEQ ID NO: 138754
  derived and/or modified sequence opt3 from neuraminidase__InfluenzaA__ADN26082

SEQ ID NO: 141850 - RNA, 1410 nt, Artificial Sequence; identical to SEQ ID NO: 138754
  derived and/or modified sequence opt3 from neuraminidase__InfluenzaA__ADN26083

SEQ ID NO: 141851 - RNA, 1410 nt, Artificial Sequence; identical to SEQ ID NO: 140656
  derived and/or modified sequence opt3 from neuraminidase__InfluenzaA__ADN26084

SEQ ID NO: 141852 - RNA, 1410 nt, Artificial Sequence; identical to SEQ ID NO: 138754
  derived and/or modified sequence opt3 from neuraminidase__InfluenzaA__ADN26085

SEQ ID NO: 141853 - RNA, 1410 nt, Artificial Sequence; identical to SEQ ID NO: 138754
  derived and/or modified sequence opt3 from neuraminidase__InfluenzaA__ADN26086

SEQ ID NO: 141854 - RNA, 1410 nt, Artificial Sequence; identical to SEQ ID NO: 138754
  derived and/or modified sequence opt3 from neuraminidase__InfluenzaA__ADN26087

SEQ ID NO: 141855 - RNA, 1410 nt, Artificial Sequence; identical to SEQ ID NO: 138754
  derived and/or modified sequence opt3 from neuraminidase__InfluenzaA__ADN26088

SEQ ID NO: 141856 - RNA, 1410 nt, Artificial Sequence; identical to SEQ ID NO: 138754
  derived and/or modified sequence opt3 from neuraminidase__InfluenzaA__ADN26090

SEQ ID NO: 141857 - RNA, 1410 nt, Artificial Sequence; identical to SEQ ID NO: 138754
  derived and/or modified sequence opt3 from neuraminidase__InfluenzaA__ADN26091

SEQ ID NO: 141858 - RNA, 1410 nt, Artificial Sequence; identical to SEQ ID NO: 138754
  derived and/or modified sequence opt3 from neuraminidase__InfluenzaA__ADN26092

SEQ ID NO: 141859 - RNA, 1410 nt, Artificial Sequence; identical to SEQ ID NO: 138754
  derived and/or modified sequence opt3 from neuraminidase__InfluenzaA__ADN26093

SEQ ID NO: 141860 - RNA, 1410 nt, Artificial Sequence
  derived and/or modified sequence opt3 from neuraminidase__InfluenzaA__ADN26094
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaaaggacaauaacuuuuccauaaaacaagacaucgucggcauuaaugaauggucuggguacucggggagcuucgugcagcaucccgagcugacgggucuggauuguauccgaccuugcuucuggguugaacucauuagaggcaggccaaaggagaacacuaucuggacauccgggucaaguauaucuuuuuguggagugaauagcgacaccgucggcugguccuggcccgauggugcagaguuaccguucacuaucgacaaauga

SEQ ID NO: 141861 - RNA, 1410 nt, Artificial Sequence; identical to SEQ ID NO: 140656
  derived and/or modified sequence opt3 from neuraminidase__InfluenzaA__ADN26095

SEQ ID NO: 141862 - RNA, 1410 nt, Artificial Sequence
  derived and/or modified sequence opt3 from neuraminidase__InfluenzaA__ADN26096
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugaacgggugggcgauauacagcaaggacaauaguauuagaaucggcuccaaaggugauguuuuugugauuagggagccauucaucucuuguagcccguuagaaugccggaccuuuuuccugacacagggggcucuacucaacgacaagcauuccaacggaaccaucaaagaucgcucacccuaucgaacucugaugaguuguccuauuggcgaggucccaagccccuacaauucucguuuugaauccguggccuggucagcaagcgccugccacgacggcauaaacuggcuuacaaucgggauuaguggaccugauaauggugcuguagcaguucugaaguauaacggcaucauaaccgacacgauuaagucuuggagaaauaacaucuugaggacucaagaguccgagugugccugcgugaaugggagcuguuucaccgucaugacagauggaccaucggacggccaggcuucuuacaaaaucuuucggauugaaaaggguaaaaucgugaaguccguggagaugaacgcccccaauuaucauuacgaagagugcucauguuacccugauaguagcgagauuacuugcgucugccgcgacaacuggcacggguccaauagaccauggguuucuuucaaccagaaucucgaauaucagauaggauacaucuguagcggcauuuuuggcgauaacccgaggcccaaugacaaaaccgggucaugcggaccugugaguuccaacggugcgaacggcguaaagggguucagcuuuaaguauggaaauggcguguggaucggucggaccaaaaacaucucuucacgcaauggguucgagaugauuugggauccaaacggcuggacaggaacggacaauaacuuuaguauaaagcaagacaucgucggcauuaaugaauggagcggguacuccggaucuuucgugcagcaucccgagcugacuggucuggauuguauccgaccuugcuucuggguugaacucauuagaggcaggccaaaagagaacacaaucuggaccucggggagcuccauaucauuuuguggagugaauagugacacugucggcuggucuuggcccgauggugcagaguuaccguucacaaucgacaaguga

SEQ ID NO: 141863 - RNA, 1410 nt, Artificial Sequence; identical to SEQ ID NO: 138754
  derived and/or modified sequence opt3 from neuraminidase__InfluenzaA__ADN26097

SEQ ID NO: 141864 - RNA, 1410 nt, Artificial Sequence; identical to SEQ ID NO: 138754
  derived and/or modified sequence opt3 from neuraminidase__InfluenzaA__ADN26098

SEQ ID NO: 141865 - RNA, 1410 nt, Artificial Sequence; identical to SEQ ID NO: 138754
  derived and/or modified sequence opt3 from neuraminidase__InfluenzaA__ADN26099

SEQ ID NO: 141866 - RNA, 1410 nt, Artificial Sequence; identical to SEQ ID NO: 138754
  derived and/or modified sequence opt3 from neuraminidase__InfluenzaA__ADN26100

SEQ ID NO: 141867 - RNA, 1410 nt, Artificial Sequence; identical to SEQ ID NO: 138754
  derived and/or modified sequence opt3 from neuraminidase__InfluenzaA__ADN26101

SEQ ID NO: 141868 - RNA, 1410 nt, Artificial Sequence
  derived and/or modified sequence opt3 from neuraminidase__InfluenzaA__ADN26102
augaaccccaaucagaagaucauuaccauaggcagcgugugcaugacaaucgggauggccaaccugauucuccaaaucggaaauauuaucuccauauggaucucucaccuuauucagcuggguaaccagaaucagaucgagacuuguaaccaaucagucauuacguacgaaaauaacaccuggguuaaucagacauaugugaacaucaguaauacuaacuucgcugcaggccagagcguaguguccgucaaauuggccggaaauucuucguuaugcccugugucagggugggcgauauacagcaaggacaacaguauuagaaucggcuccaaaggugauguuuuugugauuagggagccauucaucucuuguagcccgcuggaaugccggaccuuuuuccuaacacagggggcucuccugaaugacaagcauuccaacggaaccaucaaagaucgcucacccuaucgaacucuuaugaguuguccuauuggcgaggucccaagccccuacaacucucguuuugaauccguggccuggucagcaagcgccugccacgacggcauaaauuggcugacaaucgggauuaguggaccugauaacggugcuguagcaguuuugaaguauaauggcaucauaaccgacacgauuaagucuuggagaaacaauauccucaggacucaagaguccgagugugccugcgugaacgggagcuguuucaccgucaugacagauggaccaucggacggccaggcuucuuacaaaaucuuuaagauugaaaaagguaagaucgugaaauccguggagaugaaugcccccaacuaucauuacgaagagugcucauguuacccugauaguagcgagauuacuugcgucugccgggacaauuggcacggguccaaccgcccauggguuucuuucaaucagaaccuggaauaucagauaggauacaucuguagcggcauuuuuggcgauaauccgagacccaacgacaagaccgggucaugcggaccugugaguuccaauggugcgaacggcguaaagggguucagcuuuaaauauggaaacggcguguggaucgguaggacaaagucuaucucaagucggaauggguucgagaugauuugggauccaaacggcuggaccggaacggacaauaacuuuagcauaaaacaagacaucgucggcauuaaugaaugguccggguacucuggaucguucgugcagcaucccgagcugacuggucucgauuguauccgcccuugcuucuggguugaauuaauucgaggcagaccaaaggagaacagcaucuggacauccgggucaaguauaucuuuuuguggagugaauagcgacaccgucggcugguccuggcccgauggugcagagcugccguucacuaucgacaaauga

SEQ ID NO: 141869 - RNA, 1410 nt, Artificial Sequence; identical to SEQ ID NO: 138754
  derived and/or modified sequence opt3 from neuraminidase__InfluenzaA__ADN26103

SEQ ID NO: 141870 - RNA, 1410 nt, Artificial Sequence; identical to SEQ ID NO: 138754
  derived and/or modified sequence opt3 from neuraminidase__InfluenzaA__ADN26104

SEQ ID NO: 141871 - RNA, 1410 nt, Artificial Sequence; identical to SEQ ID NO: 138754
  derived and/or modified sequence opt3 from neuraminidase__InfluenzaA__ADN26105

SEQ ID NO: 141872 - RNA, 1410 nt, Artificial Sequence; identical to SEQ ID NO: 138754
  derived and/or modified sequence opt3 from neuraminidase__InfluenzaA__ADN26106

SEQ ID NO: 141873 - RNA, 1410 nt, Artificial Sequence; identical to SEQ ID NO: 140656
  derived and/or modified sequence opt3 from neuraminidase__InfluenzaA__ADN26107

SEQ ID NO: 141874 - RNA, 1410 nt, Artificial Sequence; identical to SEQ ID NO: 140656
  derived and/or modified sequence opt3 from neuraminidase__InfluenzaA__ADN26108

SEQ ID NO: 141875 - RNA, 1410 nt, Artificial Sequence; identical to SEQ ID NO: 138754
  derived and/or modified sequence opt3 from neuraminidase__InfluenzaA__ADN26109

SEQ ID NO: 141876 - RNA, 1410 nt, Artificial Sequence; identical to SEQ ID NO: 139728
  derived and/or modified sequence opt3 from neuraminidase__InfluenzaA__ADN26110

SEQ ID NO: 141877 - RNA, 1410 nt, Artificial Sequence; identical to SEQ ID NO: 140656
  derived and/or modified sequence opt3 from neuraminidase__InfluenzaA__ADN26111

SEQ ID NO: 141878 - RNA, 1410 nt, Artificial Sequence; identical to SEQ ID NO: 139728
  derived and/or modified sequence opt3 from neuraminidase__InfluenzaA__ADN26112

SEQ ID NO: 141879 - RNA, 1410 nt, Artificial Sequence; identical to SEQ ID NO: 140656
  derived and/or modified sequence opt3 from neuraminidase__InfluenzaA__ADN26113

SEQ ID NO: 141880 - RNA, 1410 nt, Artificial Sequence
  derived and/or modified sequence opt3 from neuraminidase__InfluenzaA__ADN26114
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucaauaacacuaauuucgcugcaggccagagcguaguguccgucaaacuggccgggaacucuucguugugcccugugucaggaugggcgauauacagcaaggacaauaguauuagaaucggcuccaaaggugauguuuuugugauuagggagccauucaucucuuguagcccguuagaaugccggaccuuuuuccugacacagggggcucuacucaacgacaagcauuccaacggaaccaucaaagaucgcucacccuaucgaacucugaugaguuguccuauuggcgaggucccaagccccuacaauucucguuuugaauccguggccuggucagcaagcgccugccacgacggcauaaacuggcuuacaaucgggauuaguggaccugauaauggugcuguagcaguucugaaguauaacggcaucauaaccgacacgauuaagucuuggagaaauaacaucuugaggacucaagaguccgagugugccugcgugaaugggagcuguuucaccgucaugacagauggaccaucggacggccaggcuucuuacaaaaucuuucggauugaaaaggguaaaaucgugaaguccguggagaugaacgcccccaauuaucauuacgaagagugcucauguuacccugauaguagcgagauuacuugcgucugccgcgacaacuggcacggguccaauagaccauggguuucuuucaaccagaaucucgaauaucagauaggauacaucuguagcggcauuuuuggcgauaacccgaggcccaaugacaaaaccgggucaugcggaccugugaguuccaacggugcgaacggcguaaagggguucagcuuuaaguauggaaauggcguguggaucggucggacaaaaucuaucucaagucgcaacggguucgagaugauuugggauccaaauggcuggaccggaacggacaacaauuuuagcauaaagcaagacaucgucggcauuaacgaaugguccggguacucuggaucguucgugcagcaucccgagcugacuggucuggauuguauccgaccuugcuucuggguugaacucauuagaggcaggccaaaagagaauacaaucuggaccagcggguccucaauaaguuuuuguggagugaacucugacacugucggcuggagcuggcccgauggugcagaguuaccguucacaaucgacaaguga

SEQ ID NO: 141881 - RNA, 1410 nt, Artificial Sequence; identical to SEQ ID NO: 138754
  derived and/or modified sequence opt3 from neuraminidase__InfluenzaA__ADN26115

SEQ ID NO: 141882 - RNA, 1410 nt, Artificial Sequence
  derived and/or modified sequence opt3 from neuraminidase__InfluenzaA__ADN26116
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugaacgggugggcgauauacagcaaggacaauaguauuagaaucggcuccaaaggugauguuuuugugauuagggagccauucaucucuuguagcccguuagaaugccggaccuuuuuccugacacagggggcucuacucaacgacaagcauuccaacggaaccaucaaagaucgcucacccuaucgaacucugaugaguuguccuauuggcgaggucccaagccccuacaauucucguuuugaauccguggccuggucagcaagcgccugccacgacggcauaaacuggcuuacaaucgggauuaguggaccugauaauggugcuguagcaguucugaaguauaacggcaucauaaccgacacgauuaagucuuggagaaauaacaucuugaggacucaagaguccgagugugccugcgugaaugggagcuguuucaccgucaugacagauggaccaucggacggccaggcuucuuacaaaaucuuucggauugaaaaggguaaaaucgugaaguccguggagaugaacgcccccaauuaucauuacgaagagugcucauguuacccugauaguagcgagauuacuugcgucugccgcgacaacuggcacggguccaauagaccauggguuucuuucaaccagaaucucgaauaucagauaggauacaucuguagcggcauuuuuggcgauaacccgaggcccaaugacaaaaccgggucaugcggaccugugaguuccaacggugcgaacggcguaaagggguucagcuuuaaguauggaaauggcguguggaucggucggacaaaaucuaucucaagucgcaacggguucgagaugauuugggauccaaauggcuggaccggaacggacaacaauuuuagcauaaagcaagacaucgucggcauuaacgaaugguccggguacucuggaucguucgugcagcaucccgagcugacucgacuggauuguaucagaccuugcuucuggguugaacucauuaggggucggccaaaagagaauacaaucuggaccagcggcuccucaauaaguuuuuguggggugaacucugacacugucggauggagcuggcccgauggcgcagaguuaccguucacaaucgacaaguga

SEQ ID NO: 141883 - RNA, 1410 nt, Artificial Sequence; identical to SEQ ID NO: 140656
  derived and/or modified sequence opt3 from neuraminidase__InfluenzaA__ADN26117

SEQ ID NO: 141884 - RNA, 1410 nt, Artificial Sequence; identical to SEQ ID NO: 140656
  derived and/or modified sequence opt3 from neuraminidase__InfluenzaA__ADN26118

SEQ ID NO: 141885 - RNA, 1410 nt, Artificial Sequence; identical to SEQ ID NO: 138754
  derived and/or modified sequence opt3 from neuraminidase__InfluenzaA__ADN26119

SEQ ID NO: 141886 - RNA, 1410 nt, Artificial Sequence; identical to SEQ ID NO: 139728
  derived and/or modified sequence opt3 from neuraminidase__InfluenzaA__ADN26120

SEQ ID NO: 141887 - RNA, 1410 nt, Artificial Sequence; identical to SEQ ID NO: 140656
  derived and/or modified sequence opt3 from neuraminidase__InfluenzaA__ADN26121

SEQ ID NO: 141888 - RNA, 1410 nt, Artificial Sequence; identical to SEQ ID NO: 138754
  derived and/or modified sequence opt3 from neuraminidase__InfluenzaA__ADN26122

SEQ ID NO: 141889 - RNA, 1410 nt, Artificial Sequence; identical to SEQ ID NO: 138754
  derived and/or modified sequence opt3 from neuraminidase__InfluenzaA__ADN26123

SEQ ID NO: 141890 - RNA, 1410 nt, Artificial Sequence; identical to SEQ ID NO: 138754
  derived and/or modified sequence opt3 from neuraminidase__InfluenzaA__ADN26124

SEQ ID NO: 141891 - RNA, 1410 nt, Artificial Sequence; identical to SEQ ID NO: 139728
  derived and/or modified sequence opt3 from neuraminidase__InfluenzaA__ADN26125

SEQ ID NO: 141892 - RNA, 1410 nt, Artificial Sequence; identical to SEQ ID NO: 139728
  derived and/or modified sequence opt3 from neuraminidase__InfluenzaA__ADN26126

SEQ ID NO: 141893 - RNA, 1410 nt, Artificial Sequence; identical to SEQ ID NO: 139519
  derived and/or modified sequence opt3 from neuraminidase__InfluenzaA__ADN26127

SEQ ID NO: 141894 - RNA, 1410 nt, Artificial Sequence; identical to SEQ ID NO: 138754
  derived and/or modified sequence opt3 from neuraminidase__InfluenzaA__ADN26128

SEQ ID NO: 141895 - RNA, 1410 nt, Artificial Sequence; identical to SEQ ID NO: 139728
  derived and/or modified sequence opt3 from neuraminidase__InfluenzaA__ADN26129

SEQ ID NO: 141896 - RNA, 1410 nt, Artificial Sequence; identical to SEQ ID NO: 140656
  derived and/or modified sequence opt3 from neuraminidase__InfluenzaA__ADN26130

SEQ ID NO: 141897 - RNA, 1410 nt, Artificial Sequence
  derived and/or modified sequence opt3 from neuraminidase__InfluenzaA__ADN26131
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaaggggaguugcggaccuguguccagcaauggugcgaacggcguaaagggguucucuuuuaaauauggaaacggcguguggaucggucggaccaagucaaucaguagccgcaauggguucgagaugauuugggauccaaacggcuggacaggaaccgacaauaacuuuuccauaaaacaagacaucgucggcauuaaugaauggucuggguacucggggagcuucgugcagcaucccgagcugacgggucuggauuguauccgaccuugcuucuggguugaacucauuagaggcaggccaaaggagaacacuaucuggacauccgggucaaguauaucuuuauguggagugaauagcgacaccgucggcugguccuggcccgauggugcagagcugccguuuacuaucgacaaauga

SEQ ID NO: 141898 - RNA, 1410 nt, Artificial Sequence; identical to SEQ ID NO: 140656
  derived and/or modified sequence opt3 from neuraminidase__InfluenzaA__ADN26132

SEQ ID NO: 141899 - RNA, 1410 nt, Artificial Sequence; identical to SEQ ID NO: 139728
  derived and/or modified sequence opt3 from neuraminidase__InfluenzaA__ADN26134

SEQ ID NO: 141900 - RNA, 1410 nt, Artificial Sequence; identical to SEQ ID NO: 138754
  derived and/or modified sequence opt3 from neuraminidase__InfluenzaA__ADN26135

SEQ ID NO: 141901 - RNA, 1410 nt, Artificial Sequence; identical to SEQ ID NO: 138754
  derived and/or modified sequence opt3 from neuraminidase__InfluenzaA__ADN26136

SEQ ID NO: 141902 - RNA, 1410 nt, Artificial Sequence; identical to SEQ ID NO: 138754
  derived and/or modified sequence opt3 from neuraminidase__InfluenzaA__ADN26137

SEQ ID NO: 141903 - RNA, 1410 nt, Artificial Sequence; identical to SEQ ID NO: 140656
  derived and/or modified sequence opt3 from neuraminidase__InfluenzaA__ADN26138

SEQ ID NO: 141904 - RNA, 1410 nt, Artificial Sequence; identical to SEQ ID NO: 139728
  derived and/or modified sequence opt3 from neuraminidase__InfluenzaA__ADN26140

SEQ ID NO: 141905 - RNA, 1410 nt, Artificial Sequence
  derived and/or modified sequence opt3 from neuraminidase__InfluenzaA__ADN26141
augaaccccaaucagaagaucauuaccauaggcagcgugugcaugacaaucgggauggccaaccugauucuccaaaucggaaauauuaucuccauauggaucucucacucaauucagcuugguaaccagaauagaaucgagacuuguaaccagagugucauuacguacgaaaauaacaccuggguuaaucaaacauaugugaacaucagcaauacuaacuucgcugcaggccaguccguagugucugucaaacuggccggaaauucgucauugugcccugugagcggaugggcgauauacaguaaggacaacuccauuaggaucggcucuaaaggugauguuuuugugauucgggagccauucaucagcuguuccccguuagaaugccgcaccuuuuuccugacacagggggcucuacucaaugacaagcauucaaacggaaccaucaaagaucgaagucccuaucguacucugaugagcuguccuauuggcgaggucccaucucccuacaacuccagauuugaaucaguggccuggagcgcaagugccugccacgacggcauaaauuggcuuacaaucgggauuucuggaccugauaacggugcuguagcaguucugaaguauaauggcaucauaaccgacacgauuaaguccuggaggaacaauaucuugcggacucaggagagcgagugugccugcgugaacgggucguguuucaccgucaugacagauggaccaucugacggccaggcuuccuacaaaaucuuucgcauugaaaaggguaaaaucgugaagucaguggagaugaaugcccccaacuaucauuacgaagagugcaguuguuacccugauagcuccgagauuacuugcgucugcagagacaauuggcacgggucuaacaggccauggguuagcuucaaucaaaaccucgaauaucagauaggauacaucuguucaggcauuuuuggcgauaauccgcggcccaacgacaaaaccgggaguugcggaccuguguccagcaauggugcgaacggcguaaagggguucucuuuuaaguauggaaacggcguguggaucggucgcacaaaaucaaucaguagccgaaauggguucgagaugauuugggauccaaacggcuggaccggaacggacaauaacuuuuccauaaagcaggacaucgucggcauuaaugaauggucuggguacucggggagcuucgugcaacaucccgagcugacuggucuggauuguaucagaccuugcuucuggguugaacucauuaggggccggccaaaagagaacacaaucuggaccuccgggucaaguauaucuuuuuguggagugaauagcgacacugucggcugguccuggcccgauggugcagaguuaccguucacaaucgacaaguga

SEQ ID NO: 141906 - RNA, 1410 nt, Artificial Sequence
  derived and/or modified sequence opt3 from neuraminidase__InfluenzaA__ADN26142
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauaacaauuucgcugcaggccaguccguagugucugucaaacuggccgggaacucgucauugugcccugugaauggaugggcgauauacagcaaggacaacaguauuagaaucggcuccaaaggugauguuuuugugauuagggagccauucaucucuuguagcccguuagaaugccggaccuuuuuccugacucagggggcucuacucaacgacaagcauuccaauggaacaaucaaagaucgcucacccuaucgaacccugaugaguuguccuauuggcgaggucccaagccccuacaacucucguuuugaauccguggccuggucagcaagcgccugccacgacggcauaaauuggcuuacuaucgggauuaguggaccugauaacggugcuguagcaguucugaaguauaauggcaucauaacagacaccauuaagucuuggagaaacaauaucuugaggacgcaagaguccgagugugccugcgugaacgggagcuguuucacugucaugaccgauggaccaucggacggccaggcuucuuacaaaaucuuucggauugaaaaggguaaaaucgugaaguccguggagaugaaugcccccaacuaucauuacgaagagugcucauguuacccugauaguagcgagauuacaugcgucugccgcgacaauuggcacggguccaacagaccauggguuucuuucaaucagaaccucgaauaucagauaggauacaucuguagcggcauuuuuggcgauaauccgaggcccaacgacaaaacugggucaugcggaccugugaguuccaacggugcgaauggcguaaagggguucagcuuuaaguauggaaacggcguguggaucggucggaccaaaucuaucucaagucgcaauggguucgagaugauuugggauccaaacggcuggacaggaaccgacaauaacuuuagcauaaagcaagacaucgucggcauuaaugaaugguccggguacucuggaucguucgugcagcaucccgagcugacgggucuggauuguauccgaccuugcuucuggguugaacucauuagaggcaggccaaaagagaacacuaucuggacaagcggguccucaauaaguuuuuguggagucaauucugacaccgugggcuggagcuggcccgauggugcagaguuaccguucacuaucgacaaguga

SEQ ID NO: 141907 - RNA, 1410 nt, Artificial Sequence; identical to SEQ ID NO: 138754
  derived and/or modified sequence opt3 from neuraminidase__InfluenzaA__ADN26143

SEQ ID NO: 141908 - RNA, 1410 nt, Artificial Sequence; identical to SEQ ID NO: 140656
  derived and/or modified sequence opt3 from neuraminidase__InfluenzaA__ADN26144

SEQ ID NO: 141909 - RNA, 1410 nt, Artificial Sequence; identical to SEQ ID NO: 140656
  derived and/or modified sequence opt3 from neuraminidase__InfluenzaA__ADN26145

SEQ ID NO: 141910 - RNA, 1410 nt, Artificial Sequence; identical to SEQ ID NO: 138754
  derived and/or modified sequence opt3 from neuraminidase__InfluenzaA__ADN26146

SEQ ID NO: 141911 - RNA, 1410 nt, Artificial Sequence; identical to SEQ ID NO: 140656
  derived and/or modified sequence opt3 from neuraminidase__InfluenzaA__ADN26147

SEQ ID NO: 141912 - RNA, 1410 nt, Artificial Sequence; identical to SEQ ID NO: 138754
  derived and/or modified sequence opt3 from neuraminidase__InfluenzaA__ADN26148

SEQ ID NO: 141913 - RNA, 1410 nt, Artificial Sequence; identical to SEQ ID NO: 140656
  derived and/or modified sequence opt3 from neuraminidase__InfluenzaA__ADN26149

SEQ ID NO: 141914 - RNA, 1410 nt, Artificial Sequence
  derived and/or modified sequence opt3 from neuraminidase__InfluenzaA__ADN26150
augaaccccaaucagaagaucauuaccauaggcagcgugugcaugacaaucgggauggccucccugauucuccaaaucggaaacauuaucucuauauggaucucacacaguauucagcuugguaaucagaaccagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccgucaugacagauggaccauccgacggccaggcuucauacaaaaucuuucggauugaaaaggguaaaaucgugaagaguguggagaugaacgcccccaauuaucauuacgaagagugcagcuguuacccugauuccucugagauuacuugcgucugccgcgacaacuggcacgggagcaauagaccauggguuucauucaaccagaaucucgaauaucagauaggauacaucuguaguggcauuuuuggcgauaacccgaggcccaaugacaaaaccggguccugcggaccugugagcucuaacggugcgaauggcguaaagggguucucauuuaaguauggaaacggcguguggaucggucggacaaaaaguaucagcucccgcaacggguucgagaugauuugggauccaaauggcuggaccggaacggacaacaauuuuucuauaaagcaagacaucgucggcauuaacgaauggucgggguacagcggauccuucgugcagcaucccgagcugacuggucuggauuguauccgaccuugcuucuggguugaacucauuagaggcaggccaaaagagaauacaaucuggaccucagggaguucuauaucauuuuguggagugaacuccgacacugucggcuggucauggcccgauggugcagaguuaccguucacaaucgacaaguga

SEQ ID NO: 141915 - RNA, 1410 nt, Artificial Sequence; identical to SEQ ID NO: 139728
  derived and/or modified sequence opt3 from neuraminidase__InfluenzaA__ADN26151

SEQ ID NO: 141916 - RNA, 1410 nt, Artificial Sequence
  derived and/or modified sequence opt3 from neuraminidase__InfluenzaA__ADN26152
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucuaugaaacuggccggaaauucgucauugugcccugucaacgggugggcgauauacagcaaggacaauaguauuagaaucggcuccaaaggugauguguuuguuauuagggagccauucaucucuuguagcccguuagaaugccggaccuuuuuccugacacagggggcucuacucaacgacaagcauuccaacggaaccaucaaagaucgcucacccuaucgaacucugaugaguuguccuauuggcgaggugccaagccccuacaauucucguuuugaauccgucgccuggucagcaagcgccugccacgacggcauaaacuggcuuacaaucgggauuaguggaccugauaauggugcuguggcaguacugaaguauaacggcaucauaaccgacacgauuaagucuuggagaaauaacaucuugaggacucaagaguccgagugugccugcguuaaugggagcuguuucaccgugaugacagauggaccaucggacggccaggcuucuuacaaaaucuuucggauugaaaaggguaaaaucgucaaguccguggagaugaacgcccccaauuaucauuacgaagagugcucauguuacccugauaguagcgagauuacuugcgugugccgcgacaacuggcacggguccaauagaccaugggucucuuucaaccagaaucucgaauaucagauaggauacaucuguagcggcauuuuuggcgauaacccgaggcccaaugacaaaaccgggucaugcggaccuguuaguuccaacggugcgaacggcgugaagggguucagcuuuaaguauggaaauggcguauggaucggucggacaaaaucuaucucaagucgcaacggguucgagaugauuugggauccaaauggcuggacccgaacggacaacaauuuuagcauaaagcaagacaucgugggaauuaacgaaugguccggcuacucugggucguucguccagcaucccgagcugacuggacuggauuguaucagaccuugcuucuggguggaacucauuaggggucggccaaaagagaauacaaucuggaccagcggcuccucaauaaguuuuugugggguuaacucugacacugugggauggagcuggcccgauggcgcagaguuaccguucacaaucgacaaguga

SEQ ID NO: 141917 - RNA, 1410 nt, Artificial Sequence; identical to SEQ ID NO: 140656
  derived and/or modified sequence opt3 from neuraminidase__InfluenzaA__ADN26153

SEQ ID NO: 141918 - RNA, 1410 nt, Artificial Sequence; identical to SEQ ID NO: 139337
  derived and/or modified sequence opt3 from neuraminidase__InfluenzaA__ADN26154

SEQ ID NO: 141919 - RNA, 1410 nt, Artificial Sequence; identical to SEQ ID NO: 138754
  derived and/or modified sequence opt3 from neuraminidase__InfluenzaA__ADN26155

SEQ ID NO: 141920 - RNA, 1410 nt, Artificial Sequence; identical to SEQ ID NO: 139728
  derived and/or modified sequence opt3 from neuraminidase__InfluenzaA__ADN26157

SEQ ID NO: 141921 - RNA, 1410 nt, Artificial Sequence; identical to SEQ ID NO: 138754
  derived and/or modified sequence opt3 from neuraminidase__InfluenzaA__ADN26159

SEQ ID NO: 141922 - RNA, 1410 nt, Artificial Sequence; identical to SEQ ID NO: 138754
  derived and/or modified sequence opt3 from neuraminidase__InfluenzaA__ADN26161

SEQ ID NO: 141923 - RNA, 1410 nt, Artificial Sequence
  derived and/or modified sequence opt3 from neuraminidase__InfluenzaA__ADN26162
augaaccccaaucagaagaucauuaccauaagcuccgugugcaugacagucggcauggccaaccugauccuccaaauugggaauaucauuucuaucuggauaucacacaguauccagcuuggaaaccagaaucagauugagacuuguaaccaaagcguuaucacguacgaaaauaacaccugggugaaucagacauauguaaacauuuccaauacuaacuucgcugcaggucagucuguggucucggugaaacuggccggcaauagcucauugugcccuguuagugggugggcgaucuacuccaaggacaacucuauaagaauuggaagcaaaggcgauguguuugucaucagggagccauucauuuccuguucaccguuagaaugccggaccuuuuuccugacacagggugcucuacucaaugacaagcauaguaacgggaccaucaaagaucgcagccccuaucgaacucugaugucuuguccuaucggagaggugccaucccccuacaacucacguuuugaaagcguagccuggagugcaucugccugccacgacggcauuaauuggcuuacaauaggcaucuccgggccugauaacggagcuguugcagugcugaaguauaaugguauuaucaccgacacgauaaagagcuggagaaacaauauuuugaggacucaagagucggagugugccugcgucaacggcucuuguuucaccgugaugacagaugggccauccgacggacaggcuucauacaaaaucuuucggaucgaaaagggcaaaauugugaagagugucgagaugaaugcccccaacuaucauuacgaagagugcagcuguuacccugauuccucugagaucacuugcguuugccgcgacaauuggcacgguagcaacagaccaugggugucauucaaucagaaccucgaauaucagauuggguacauauguaguggaaucuuuggcgauaauccgaggcccaacgacaaaaccggcuccugcgggccuguaagcucuaauggagcgaacggugugaagggcuucucauuuaaguaugggaacggagucuggauuggccggacaaaaaguaucagcucccgcaaugguuucgagaugaucugggauccaaacggguggaccggcacggacaauaacuuuucuauuaagcaagacauagugggaaucaaugaauggucgggcuacagcggguccuucguucagcaucccgagcugacuggacuggauuguauucgaccuugcuucuggguggaacucaucagagguaggccaaaagagaacacaauuuggaccucaggcaguucuaucagcuuuuguggggucaauuccgacacugugggauggucauggcccgauggcgcagaguuaccguucacaauagacaaguga

SEQ ID NO: 141924 - RNA, 1410 nt, Artificial Sequence
  derived and/or modified sequence opt3 from neuraminidase__InfluenzaA__ADN26163
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucauuggcaucaaugaauggucuggguacucggggagcuucguccagcaucccgagcugacuggucuggauuguauucgaccuugcuucuggguggaacucaucagaggcaggccaaaagagaacacaauauggaccuccgggucaaguaucucuuuuuguggaguuaauagcgacacugugggcugguccuggcccgauggugcagaguuaccguucauuaucgacaaguga

SEQ ID NO: 141925 - RNA, 1410 nt, Artificial Sequence
  derived and/or modified sequence opt3 from neuraminidase__InfluenzaA__ADN26164
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugccucaacgggucguguuucaccgugaugacagauggaccaucugacggccaggcuuccuacaaaaucuuucggauugaaaaggguaaaaucgucaagucaguggagaugaaugcccccaacuaucauuacgaagagugcaguuguuacccugauagcuccgagauuacuugcgugugccgcgacaauuggcacgggucuaacagaccaugggucagcuucaaucagaaccuggaauaucagauaggauacaucuguucaggcauuuuuggcgauaauccgaggcccaacgacaaaaccgggaguugcggaccuguuuccagcaauggugcgaacggcgugaagggguucucuuuuaaguauggaaacggcguauggaucggucggacaaaaucaaucaguagccgcaauggguucgagaugauuugggauccaaacggcuggaccggaacggacaaugacuuuuccauaaagcaagauaucgugggcauuaacgaauggucuggguacucggggagcuucguccagcaucccgagcugacuggucucgacuguauccgaccuugcuucuggguggaauuaauuagaggcaggccaaaagagaauacaaucuggaccuccgggucaaguauaucuuuuuguggaguuaacagcgauacugugggcugguccuggcccgacggugcagagcugccguucacaaucgauaaguga

SEQ ID NO: 141926 - RNA, 1410 nt, Artificial Sequence; identical to SEQ ID NO: 140711
  derived and/or modified sequence opt3 from neuraminidase__InfluenzaA__ADN26168

SEQ ID NO: 141927 - RNA, 1410 nt, Artificial Sequence; identical to SEQ ID NO: 139977
  derived and/or modified sequence opt3 from neuraminidase__InfluenzaA__ADN26178

SEQ ID NO: 141928 - RNA, 1410 nt, Artificial Sequence; identical to SEQ ID NO: 138754
  derived and/or modified sequence opt3 from neuraminidase__InfluenzaA__ADN26868

SEQ ID NO: 141929 - RNA, 1410 nt, Artificial Sequence; identical to SEQ ID NO: 138754
  derived and/or modified sequence opt3 from neuraminidase__InfluenzaA__ADN26869

SEQ ID NO: 141930 - RNA, 1410 nt, Artificial Sequence; identical to SEQ ID NO: 138754
  derived and/or modified sequence opt3 from neuraminidase__InfluenzaA__ADN26870

SEQ ID NO: 141931 - RNA, 1410 nt, Artificial Sequence
  derived and/or modified sequence opt3 from neuraminidase__InfluenzaA__ADN26871
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuacaaccaaagugucauuacguaugaaaauaacaccuggguuaaucagacauacgugaacaucagcaauacuaacuucgcugcaggccaguccguagugucugucaaacuggccggaaauucgucauuguguccugugagcggaugggcgauauauaguaaggacaacuccauuagaaucggcucuaaaggugauguuuuugugauuagggagccauucaucagcugcuccccguuagaaugucggaccuuuuuccugacacagggggcucuacucaaugacaagcauucaaacggaaccaucaaagaucgcagucccuaccgaacucugaugagcugcccuauuggcgaggucccaucucccuauaacucccguuuugaaucaguggccuggagcgcaagugccugucacgacggcauaaauuggcuuacaaucgggauuucuggaccugauaacggugcuguagcaguucugaaguacaauggcaucauaaccgacacgauuaaguccuggagaaacaauaucuugaggacucaagagagcgagugcgccugugugaacgggucgugcuucaccgucaugacagauggaccaucugacggccaggcuuccuauaaaaucuuucggauugaaaaggguaaaaucgugaagucaguggagaugaaugcccccaacuaccauuacgaagaguguaguugcuauccugauagcuccgagauuacuugugucugccgcgacaauuggcacgggucuaacagaccauggguuagcuucaaucagaaccucgaauaccagauaggauauaucugcucaggcauuuuuggcgauaauccgaggcccaacgacaaaaccgggaguuguggaccuguguccagcaauggugcgaacggcguaaagggguucucuuuuaaguacggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguauucggggagcuucgugcagcaucccgagcugacuggucuggauugcauccgaccuuguuucuggguugaacucauuagaggcaggccaaaagagaacacaaucuggaccuccgggucaaguauaucuuuuugcggagugaauagcgacacugucggcugguccuggcccgauggugcagaguuaccguucacaaucgacaaguga

SEQ ID NO: 141932 - RNA, 1410 nt, Artificial Sequence
  derived and/or modified sequence opt3 from neuraminidase__InfluenzaA__ADN26872
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccuguccguagugucugucaaauuggccggaaauucgucauuaugcccugugagcgggugggcgauauacaguaaggacaacuccauuagaaucggcucuaaaggugauguuuuugugauuagggagccauucaucagcuguuccccgcuggaaugccggaccuuuuuccuaacacagggggcucuccugaaugacaagcauucaaacggaaccaucaaagaucgcagucccuaucgaacucuuaugagcuguccuauuggcgaggucccaucucccuacaacucccguuuugaaucaguggccuggagcgcaagugccugccacgacggcauaucuuggcugacaaucgggauuuccggaccugauaauggugcuguagcaguuuugaaguauaacggcaucauaaccgacacgauuaagagcuggagaaauaacauccucaggacucaggagucggagugugccugcgugaaugggucuuguuucaccgucaugacagauggaccauccgacggccaagcuagcuacaaaaucuuucggauugaaaaggguaaaaucgugaagaguguggagaugaacgcccccaauuaucauuacgaagagugcagcuguuacccugauuccucugagauuacuugcgucugccgcgacaacuggcacgggagcaauagaccauggguuucauucaaccagaaucuggaauaucagauaggauacaucuguaguggcauuuuuggcgauaacccgaggcccaaugacaaaaccggguccugcggaccugugagcucuaacggugcgaauggcguaaagggguucucauuuaaguauggaaacggcguguggaucggucggacaaaaaguaucagcucccgcaacggguucgagaugauuugggauccaaauggcuggaccggaacggacaacaauuuuucuauaaagcaggacaucgucggcauuaacgaauggucgggguacagcggauccuucgugcaacaucccgagcugacuggucucgauuguauccgaccuugcuucuggguugaauuaauuagaggcaggccaaaagagaauacaaucuggaccucagggaguucuauaucauuuuguggagugaacuccgacacugucggcuggucauggcccgauggugcagagcugccguucacaaucgacaaguga

SEQ ID NO: 141933 - RNA, 1410 nt, Artificial Sequence; identical to SEQ ID NO: 138754
  derived and/or modified sequence opt3 from neuraminidase__InfluenzaA__ADN26873

SEQ ID NO: 141934 - RNA, 1410 nt, Artificial Sequence; identical to SEQ ID NO: 138754
  derived and/or modified sequence opt3 from neuraminidase__InfluenzaA__ADN26874

SEQ ID NO: 141935 - RNA, 1410 nt, Artificial Sequence; identical to SEQ ID NO: 138754
  derived and/or modified sequence opt3 from neuraminidase__InfluenzaA__ADN26875

SEQ ID NO: 141936 - RNA, 1410 nt, Artificial Sequence; identical to SEQ ID NO: 138754
  derived and/or modified sequence opt3 from neuraminidase__InfluenzaA__ADN26876

SEQ ID NO: 141937 - RNA, 1410 nt, Artificial Sequence; identical to SEQ ID NO: 138754
  derived and/or modified sequence opt3 from neuraminidase__InfluenzaA__ADN26877

SEQ ID NO: 141938 - RNA, 1410 nt, Artificial Sequence; identical to SEQ ID NO: 138754
  derived and/or modified sequence opt3 from neuraminidase__InfluenzaA__ADN26878

SEQ ID NO: 141939 - RNA, 1410 nt, Artificial Sequence; identical to SEQ ID NO: 139891
  derived and/or modified sequence opt3 from neuraminidase__InfluenzaA__ADN26879

SEQ ID NO: 141940 - RNA, 1410 nt, Artificial Sequence; identical to SEQ ID NO: 138754
  derived and/or modified sequence opt3 from neuraminidase__InfluenzaA__ADN26880

SEQ ID NO: 141941 - RNA, 1410 nt, Artificial Sequence; identical to SEQ ID NO: 138754
  derived and/or modified sequence opt3 from neuraminidase__InfluenzaA__ADN26881

SEQ ID NO: 141942 - RNA, 1410 nt, Artificial Sequence; identical to SEQ ID NO: 138754
  derived and/or modified sequence opt3 from neuraminidase__InfluenzaA__ADN26882

SEQ ID NO: 141943 - RNA, 1410 nt, Artificial Sequence; identical to SEQ ID NO: 138754
  derived and/or modified sequence opt3 from neuraminidase__InfluenzaA__ADN26883

SEQ ID NO: 141944 - RNA, 1413 nt, Artificial Sequence
  derived and/or modified sequence opt3 from neuraminidase__InfluenzaA__ADN89064
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucgauggagccaacggcguuaaagguuucaguuauaaguacgggaauggcguguggaucggaagaacuaaauccaacaggcugcggcgcggcuuugagaugauuugggaccccaauggguggacaaacaccgacagcgauuucucuguaaagcaggacguggucgcuauaacugauuggucaggauauagugguagcuuugugcagcacccugaacucacaggcuuagacugcauccgaccauguuucuggguugagcuggugagagggcuucccagggaaaacaccacgauuuggaccuccggaucuucgaucagcuucugcggcgucaauuccgauacagccaacuggucauggccugacggugcagaguugccauuuacuauugauaaauga

SEQ ID NO: 141945 - RNA, 1413 nt, Artificial Sequence; identical to SEQ ID NO: 139477
  derived and/or modified sequence opt3 from neuraminidase__InfluenzaA__ADN89075

SEQ ID NO: 141946 - RNA, 1413 nt, Artificial Sequence
  derived and/or modified sequence opt3 from neuraminidase__InfluenzaA__ADN89086
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaagacagccucauacaaaaucuucaagauugaaaagggaaaaguaaccaagaguauagagcucaacgcgccuaauuuuuauuacgaagaguguagcugcuacccagacacgggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacugucgauggagcaaacggcguuaaagguuucaguuauaaguacgggaauggcguguggaucggaagaacaaaauccaacaggcugcggaagggcuuugagaugauuugggaccccaauggguggaccaacacugacagcgauuucucuguaaaacaggacguggucgccauaacagauuggucaggauauagugguagcuuugugcagcacccugaacucaccggcuuagacugcauccgcccauguuucuggguugagcuggugcgagggcuucccagagaaaacacgaccauuuggacauccggaucuucgaucagcuucugcggcgucaauuccgauacugcuaacuggucauggccugacggugccgaguugccauuuaccauugauaaguga

SEQ ID NO: 141947 - RNA, 1413 nt, Artificial Sequence; identical to SEQ ID NO: 139477
  derived and/or modified sequence opt3 from neuraminidase__InfluenzaA__ADN89097

SEQ ID NO: 141948 - RNA, 1413 nt, Artificial Sequence
  derived and/or modified sequence opt3 from neuraminidase__InfluenzaA__ADN89108
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucgauggagccaacggcguuaaagguuucaguuauaaguacgggaauggcguguggaucggaagaacuaaauccaacaggcugcggaagggcuuugagaugauuugggaccccaauggguggacaaacaccgacagcgauuucucuguaaaacaggacguggucucaauaacugauuggaguggauauagcgguuccuuugugcagcacccugaacucacaggcuuagacugcauccgcccauguuucuggguugagcuggugcgagggcuucccagagaaaacaccacgauuuggaccucuggaucgagcaucuccuucugcggcgucaauucagauacagcuaacuggaguuggccugacggugccgaguugccauuuacuauugauaaguga

SEQ ID NO: 141949 - RNA, 1413 nt, Artificial Sequence
  derived and/or modified sequence opt3 from neuraminidase__InfluenzaA__ADN89119
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucaacggagccgauggcguuaaagguuucaguuauaaguacgggaauggcguguggaucggaagaacuaaauccaacaggcugcggaagggcuuugagaugauuugggaccccaauggguggacaaacaccgacagcgauuucucuguaaaacaggacguggucgcuauaacugauuggucaggauauagugguagcuuugugcagcacccugaacucacaggcuuagacugcacccgcccauguuucuggguugagcuggugcgagggcuucccagagaaaacacgaccaucuggacauccggaucuucgauuagcuucugcggcgucaauuccgauacugccaacuggucauggccugacggugcagaguugccauuuaccaucgauaaguga

SEQ ID NO: 141950 - RNA, 1413 nt, Artificial Sequence
  derived and/or modified sequence opt3 from neuraminidase__InfluenzaA__ADN89130
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaacuucgaaagcguugccuggagugcuucugcaugucacgaugggaugggauggcuuacgauugguaucuccggcccagacaauggggccguggcuguccugaaguauaacggaauaauuacuggcaccaucaagagcuggaaaaagcagaucuugagaacacaggagucggagugcguguguaugaaugguucuugcuuuacuauuaugaccgaugggcccuccaacaaagccgcgucauacaagaucuucaaaauugaaaagggaaagguaacaaaaaguauagagcucaaugcaccuaacuuuuauuacgaagaguguagcugcuacccagacaccggcaucguuaugugugugugcagggauaauuggcauggcuccaaccggcccugggucucuuucaaucagaaccuggacuaucaaauuggguacaucugcagcggaguguuuggugauaauccucgcccagaggacggcgaagggucauguaacccggugacggucgauggagccaauggcguuaaggguuucaguuauaaauacgggaacggcguguggaucggaagaacuaaguccaauaggcugcggaaaggcuuugagaugauuugggaccccaacggguggacaaacaccgacagcgauuucucuguaaagcaggacguggucgcuauaacugauuggucaggauauagugguagcuuugugcagcacccugaacucacaggcuuagacugcauccgcccauguuucuggguugagcuggugcgagggcuucccagagaaaauaccacgauuuggaccuccggaucuucgaucagcuucugcggcgucaacggugauacagccaauugguccuggccugacggggcagaguugccauuuacuauugauaaauga

SEQ ID NO: 141951 - RNA, 1413 nt, Artificial Sequence; identical to SEQ ID NO: 141948
  derived and/or modified sequence opt3 from neuraminidase__InfluenzaA__ADN89141

SEQ ID NO: 141952 - RNA, 1413 nt, Artificial Sequence
  derived and/or modified sequence opt3 from neuraminidase__InfluenzaA__ADN89152
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugugaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacgaucgauggagccaacggcgucaaagguuucaguuauaaguacgggaauggcguuuggauuggaagaacuaaauccaacaggcugcggaagggcuuugagaugauaugggaccccaauggguggacaaacaccgacagcgauuucucugugaaacaggacguaguggcuaucacugauuggucaggauauagugguagcuuuguccagcacccugaacucacaggcuuagacugcauucgcccauguuucuggguggagcugguucgagggcuucccagagaaaacaccacgaucuggaccuccggaucuucgauuagcuucugcggcgucaauuccgauacagccaacuggucauggccugacggugcagaguugccauuuacuaucgauaaguga

SEQ ID NO: 141953 - RNA, 1413 nt, Artificial Sequence
  derived and/or modified sequence opt3 from neuraminidase__InfluenzaA__ADN89163
augaaccccaaucagagaaucauuaccauaggcagcaucuccauugccaucgggauuaucucucugaugcuccaaauaggaaacaucauuucaaucugggcuagucacagcauucagacagguucccagaauaacacuggcaucugcaaucagaggauaauuacguacgagaacucuaccugggugaaucauacauaugugaacaucaauaacacuaauguuguggcaggggaagacaagaccucgguaacacuugccggaaacucaagccuguguaguauuuccggcugggcgaucuacaccaaagauaauucuauccggauugguagcaagggggacguguucgucauacgcgagccuuuuaucuccugcucacacuuggaaugucgaacuuucuuuuuaacacaaggagcucugcuaaacgauaaacauaguaauggcaccgccaaggaccguagcccauauagagcacucaugucuugcccgcugggcgaggcccccuccccuuacaacucaaaauucgaaagcguggcuuggagugcaucugccugucacgaugggaugggauggcuuacgauugguaucuccggcccagacaacggggcuguugccgugcugaaguauaauggaauaauuacuggcaccaucaagagcuggaaaaagcagaucuugaggacacaggagucggagugcgucuguaugaacgguucuugcuuuacuauuaugaccgaugggcccuccaauaaagcggcaucauacaagaucuucaaaauugaaaagggaaaggugacaaaaaguauagagcucaacgccccuaauuuuuauuacgaagaguguagcugcuacccagacaccggcaucguaauguguguuugccgggauaacuggcauggcuccaaucgccccugggugucuuucaaccagaaucuggacuaucaaauuggguacaucugcagcggagucuuuggugauaacccuagaccagaggacggcgaagggucauguaauccggugacgguggauggagcuaacggcgucaaggguuucaguuauaaauacgggaauggcguuuggaucggaaggacuaaguccaaccggcugcgcaaaggcuuugagaugauuugggaccccaauggguggacaaacaccgacagcgauuucucugugaagcaggacguaguggccauaacugauuggucaggauauagugguagcuuuguccagcacccugaacucacaggcuuagacugcauccgaccauguuucuggguggagcugguuagagggcuucccagggaaaacaccacgauuuggaccuccggaucuucgaucagcuucugcggcgucaauuccgauacagcaaacuggucauggccugacggugcugaguugccauuuacuauugauaaauga

SEQ ID NO: 141954 - RNA, 1413 nt, Artificial Sequence; identical to SEQ ID NO: 140946
  derived and/or modified sequence opt3 from neuraminidase__InfluenzaA__ADN89174

SEQ ID NO: 141955 - RNA, 1413 nt, Artificial Sequence; identical to SEQ ID NO: 141948
  derived and/or modified sequence opt3 from neuraminidase__InfluenzaA__ADN89185

SEQ ID NO: 141956 - RNA, 1413 nt, Artificial Sequence
  derived and/or modified sequence opt3 from neuraminidase__InfluenzaA__ADN89196
augaaccccaaucagaagaucauuaccauaggcagcaucuccauugccaucgggauuaucucucugaugcuccaaauaggaucaaucauuaguaucugggcuagccacuccauucagacagguucucagaacaauacuggcaucugcaaccagagaauaauuacguacgaaaauucgaccugggugaaccauacauaugucaauaucaacaauacuaacguuguggcaggggaggacaaaaccucaguaacacuugccggaaauagcagucuguguuccauuucuggcugggcgaucuacaccaaggauaacagcaucaggauugguuccaaaggggacguguucgucauacgggagccuuuuaucucaugcagucacuuggaaugucgcacuuucuuuuuaacacaaggagcucugcuaaaugauaagcauagcaacggcaccgugaaagaccgaucuccauaucgugcccucauguccugcccgcugggcgaggcacccucaccuuacaauagcaaguucgaaaguguugccuggucugcuuccgcaugucacgaugggaugggauggcuuacgauugguaucagcggcccagacaacggggccguggcuguccugaaguauaacggaauaauuacuggcaccaucaaaucguggaagaaacagaucuugagaacacaggagucugagugcguguguaugaaugguuccugcuuuacuauuaugaccgaugggcccucaaacaaggccgcgaguuacaaaaucuucaagauugaaaagggaaaaguaacaaagagcauagagcucaaugcaccuaacuuuuauuacgaagaguguuccugcuacccagacaccggcaucguuaugugugugugcagggauaauuggcauggcucuaaccggcccugggucagcuucaaucagaaccuggacuaucaaaugggguacauuugcucaggaguguuuggugauaauccucgcccagaggacggcgaagggaguuguaacccggugacggucgauggagccaauggcguuaaagguuucuccuauaaguacgggaacggcguguggaucggaagaacuaaaagcaauaggcugcggaagggcuuugagaugaucugggaccccaacggguggacaaauaccgacucugauuucucacucaaacaggacguaguggcuauuacugauuggaguggauauagcgguuccuuuguccagcacccugaauuaacaggccuggacugcauacgcccauguuucuggguggagcuuguucgaggguugcccagagaaaacaccacgaucuggaccucuggaucgagcauuuccuucugcggcgugaacucagauacagccaauuggaguuggccugacggugcagagcugccauuuacuaucgauaaguga

SEQ ID NO: 141957 - RNA, 1413 nt, Artificial Sequence; identical to SEQ ID NO: 141956
  derived and/or modified sequence opt3 from neuraminidase__InfluenzaA__ADN89207

SEQ ID NO: 141958 - RNA, 1413 nt, Artificial Sequence
  derived and/or modified sequence opt3 from neuraminidase__InfluenzaA__ADN89218
augaaccccaaucagaagaucauuaccauaggcagcaucuccauugccaucgggauuaucucucugaugcuccaaauaggaaacaucauuucaaucugggcuagucacagcauucagccugguucccagaauaacacaggcaucugcaaucagagaauaauuacuuacgagaacucuacgugggugaaucauaccuaugucaacaucaauaacacaaauguuguggcaggggaagacaaaacuucgguaacccuugccggaaacucaagccuguguaguauuuccggcugggcgaucuacacaaaggauaauucuaucaggauugguagcaaaggggacguguucgucauacgggagccauuuaucuccugcucacacuuggaaugucgcaccuucuuuuuaacucaaggagcucugcuaaacgauaagcauaguaauggcacagugaaagaccgaagcccguaucgugcccucaugucuugcccccugggcgaggcaccuuccccauacaacucaaaguucgaaagcguugccuggagugcuucugcaugucacgaugggaugggauggcuuaccauugguaucuccggccccgacaacggggccguggcuguccugaaguauaauggaauaauuacgggcacuaucaaaagcuggaagaaacagaucuugagaacccaggagucggagugcguguguaugaacgguucuugcuuuacaauuaugacugaugggccuuccaauaaggccgcgucauacaaaaucuucaagauugaaaagggaaaaguaaccaagaguauagagcucaacgcaccaaauuuuuauuacgaagaguguagcugcuaccccgacacaggcaucguuaugugugugugcagggauaacuggcauggcuccaaucggccuugggucucuuucaaccagaaucuggacuaucaaauuggguacaucugcagcggaguguuuggugauaacccacgcccggaggacggcgaagggucauguaaucccgugaccgucgauggagccaacggcguuaaagguuucaguuauaaguacgggaauggcguguggaucggaagaacgaaauccaacaggcugcggaagggcuuugagaugauuugggacccuaauggguggacuaacacagacagcgauuucucuguaaaacaggacguggucgcuauaaccgauuggucaggauauagugguagcuuugugcagcacccagaacucacuggcuuagacugcauccgccccuguuucuggguugagcuggugcgagggcuuccuagagaaaacacaaccauuuggacguccggaucuucgaucagcuucugcggcgucaauggugauaccgccaacugguccuggccagacggggcagaguugcccuuuacaauugauaaguga

SEQ ID NO: 141959 - RNA, 1413 nt, Artificial Sequence
  derived and/or modified sequence opt3 from neuraminidase__InfluenzaA__ADN89229
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucgauggagccaacggcguuaaagguuucaguuauaaguacgggaauggcguguggaucggaagaacuaaauccaacaggcugcggaagggcuuugagaugauuugggaccccaauggguggacaaacaccgacagcgauuucucuguaaaacaggacguggucgcuacuacagauuggucaggauauagugguagcuuugugcagcacccugaacucaccggcuuagacugcauacgcccauguuucuggguugagcuggugcgagggcuucccagagaaaacacgaccaucuggacauccggaucuucgauuagcuucugcggcgucaauuccgauacugccaacuggucauggccugacggugcagaguugccauuuaccaucgauaaguga

SEQ ID NO: 141960 - RNA, 1413 nt, Artificial Sequence
  derived and/or modified sequence opt3 from neuraminidase__InfluenzaA__ADN89240
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucgauggagccaacggcguuaaagguuucaguuauaaguacgggaauggcguguggaucggaagaacuaaauccaacaggcugcggaagggcuuugagaugauuugggaccccaauggguggacaaacaccgacagcgauuucucuguaaaacaggacguggucgcuauaacugauuggucaggauauagugguagcuuugugcagcacccugaacucacaggcuuagacugcauccgcccauguuucuggguugagcuggugcgagggcuucccagagaaaacaccacgauuuggaccuccggaucuucgaucagcuucugcggcgucaauggugauacagccaacugguccuggccugacggggcagaguugccauuuacuauugauaaguga

SEQ ID NO: 141961 - RNA, 1413 nt, Artificial Sequence; identical to SEQ ID NO: 139477
  derived and/or modified sequence opt3 from neuraminidase__InfluenzaA__ADN89251

SEQ ID NO: 141962 - RNA, 1413 nt, Artificial Sequence; identical to SEQ ID NO: 139477
  derived and/or modified sequence opt3 from neuraminidase__InfluenzaA__ADN89262

SEQ ID NO: 141963 - RNA, 1413 nt, Artificial Sequence; identical to SEQ ID NO: 139477
  derived and/or modified sequence opt3 from neuraminidase__InfluenzaA__ADN89273

SEQ ID NO: 141964 - RNA, 1413 nt, Artificial Sequence; identical to SEQ ID NO: 139477
  derived and/or modified sequence opt3 from neuraminidase__InfluenzaA__ADN89284

SEQ ID NO: 141965 - RNA, 1413 nt, Artificial Sequence; identical to SEQ ID NO: 139477
  derived and/or modified sequence opt3 from neuraminidase__InfluenzaA__ADN89295

SEQ ID NO: 141966 - RNA, 1413 nt, Artificial Sequence; identical to SEQ ID NO: 139477
  derived and/or modified sequence opt3 from neuraminidase__InfluenzaA__ADN89306

SEQ ID NO: 141967 - RNA, 1413 nt, Artificial Sequence
  derived and/or modified sequence opt3 from neuraminidase__InfluenzaA__ADN89317
augaaccccaaucagagaaucauuaccauaggcagcaucuccauugccaucgggauuaucucucugaugcuccaaauaggaaacaucauuucaaucugggcuagucacagcauucagacagguucccagaauaacacuggcaucugcaaucagaggauaauuacguacgagaacucuaccugggugaaucauacauaugucaacaucaauucgacuaacguuguggcaggggaagacaagaccucaguaacacuugccggaaauagcagucuguguuccauuucuggcugggcgaucuacaccaaagauaacagcauccggauugguuccaagggggacguguucgucauacgcgagccuuuuaucucaugcagucacuuggaaugucgaacuuucuuuuuaacacaaggagcucugcuaaaugauaaacauagcaacggcaccgugaaggaccguucuccauauagagcccucauguccugcccgcugggcgaggcacccucaccuuacaauagcaaauucgaaaguguugccuggucugcuuccgcaugucacgaugggaugggauggcuuacgauugguaucagcggcccagacaacggggccguggcuguccugaaguauaacggaauaauuacuggcaccaucaagucguggaaaaagcagaucuugaggacacaggagucugagugcguguguaugaaugguuccugcuuuacuauuaugaccgaugggcccucaaacaaagccgcgaguuacaagaucuucaaaauugaaaagggaaagguaacaaaaagcauagagcucaaugcaccuaacuuuuauuacgaagaguguuccugcuacccagacaccggcaucguuaugugugugugccgggauaauuggcauggcucuaaccgccccugggucagcuucaaucagaaccuggacuaucaaauuggguacaucugcucaggaguguuuggugauaauccuagaccagaggacggcgaagggaguuguaacccggugacggucgauggagccaauggcguuaaggguuucuccuauaaauacgggaacggcguguggaucggaaggacuaagagcaaucggcugcgcaaaggcuuugagaugauuugggaccccaacggguggacaaauaccgacucugauuucucaguaaagcaggacguggucgcuauaacugauuggaguggauauagcgguuccuuugugcagcacccugaacucacaggcuuagacugcauccgaccauguuucuggguugagcuggugagagggcuucccagggaaaacaccacgauuuggaccucuggaucgagcaucuccuucugcggcgucaacggugauacagccaauuggucauggccugacggggcagaguugccauuuacuauugauaaauga

SEQ ID NO: 141968 - RNA, 1413 nt, Artificial Sequence
  derived and/or modified sequence opt3 from neuraminidase__InfluenzaA__ADN89328
augaaccccaaucagaagaucauuaccauaggcagcaucuccauugccaucgggauuaucucucugaugcuccaaauaggaucaaucauuaguaucugggcuagccacuccauucagacagguucucagaacaauacuggcaucugcaaccagagaauaauuacguacgaaaauucgaccugggugaaccauacauaugucaauaucaacaauacuaacguuguggcaggggaggacaaaaccucaguaacacuugccggaaauagcagucuguguuccauuucuggcugggcgaucuacaccaaggauaacagcaucaggauugguuccaaaggggacguguucgucauacgggagccuuuuaucucaugcagucacuuggaaugucgcacuuucuuuuuaacacaaggagcucugcuaaaugauaagcauagcaacggcaccgugaaagaccgaucuccauaucgugcccucauguccugcccgcugggcgaggcacccucaccuuacaauagcaaguucgaaaguguugccuggucugcuuccgcaugucacgaugggaugggauggcuuacgauugguaucagcggcccagacaacggggccguggcuguccugaaguauaacggaauaauuacuggcaccaucaaaucguggaagaaacagaucuugagaacacaggagucugagugcguguguaugaaugguuccugcuuuacuauuaugaccgaugggcccucaaacaaggccgcgaguuacaaaaucuucaagauugaaaagggaaaaguaacaaagagcauagagcucaaugcaccuaacuuuuauuacgaagaguguuccugcuacccagacaccggcaucguuaugugugugugcagggauaauuggcauggcucuaaccggcccugggucagcuucaaucagaaccuggacuaucaaauuggguacaucugcucaggaguguuuggugauaauccucgcccagaggacggcgaagggaguuguaacccggugacggucgauggagccaauggcguuaaagguuucuccuauaaguacgggaacggcguguggaucggaagaacuaaaagcaauaggcugcggaagggcuuugagaugauuugggaccccaacggguggacaaauaccgacucugauuucucaguaaaacaggacguggucgcuauaacugauuggaguggauauagcgguuccuuugugcagcacccugaacucacaggcuuagacugcauccgcccauguuucuggguugagcuggugcgagggcuucccagagaaaacaccacgauuugggccucuggaucgagcaucuccuucugcggcgucaacucagauaccgcaaauuggaguuggccugacggugcugaguugccauuuacaauugauaaguga

SEQ ID NO: 141969 - RNA, 1413 nt, Artificial Sequence; identical to SEQ ID NO: 141953
  derived and/or modified sequence opt3 from neuraminidase__InfluenzaA__ADN89339

SEQ ID NO: 141970 - RNA, 1413 nt, Artificial Sequence; identical to SEQ ID NO: 141959
  derived and/or modified sequence opt3 from neuraminidase__InfluenzaA__ADN89350

SEQ ID NO: 141971 - RNA, 1413 nt, Artificial Sequence
  derived and/or modified sequence opt3 from neuraminidase__InfluenzaA__ADN89361
augaaccccaaucagaagaucauuaccauaggcagcaucuccauugccaucgggauuaucucucugaugcuccaaauaggaucaaucauuaguaucugggcuagccacuccauucagacagguucucagaacaauacuggcaucugcaaccagagaauaauuacguacgaaaauucgaccugggugaaccauacauaugucaauaucaacaauacuaacguuguggcaggggaggacaaaaccucaguaacacuugccggaaauagcagucuguguuccauuucuggcugggcgaucuacaccaaggauaacagcaucaggauugguuccaaaggggacguguucauaauccgggagccuuuuauuucaugcagucacuuggaaugucgcacuuucuuuuuaacacaaggagcucugcuaaaugauaagcauagcaacggcaccgucaaagaccgaucuccauaucgugcccucauguccugcccgcugggcgaggcacccucaccuuacaauagcaaguucgaaaguguggccuggucugcuuccgcaugucacgaugggaugggauggcuuacgaucgguauaagcggcccagacaacggggccguugcugugcugaaguauaacggaauuaucacuggcaccaucaaaucguggaagaaacagauuuugagaacacaggagucugagugcgucuguaugaaugguuccugcuuuacuaucaugaccgaugggcccucaaacaaggccgcgaguuacaaaauuuucaagauagaaaagggaaaagugacaaagagcaucgagcucaaugcaccuaacuuuuauuacgaagaguguuccugcuacccagacaccggcauuguaauguguguuugcagggauaauuggcauggcucuaaccggcccugggugagcuucaaucagaaccuggacuaucaaaucggguacaucugcucaggagucuuuggugauaauccucgcccagaggacggcgaagggaguuguaacccggugacgguggauggagccaauggcgucaaagguuucuccuauaaguacgggaacggcguuuggauuggaagaacuaaaagcaauaggcugcggaagggcuuugagaugauaugggaccccaacggguggacaaauaccgacucugauuucucagugaaacaggacguaguggcuaucacugauuggaguggauauagcgguuccuuuguccagcacccugaacucacaggcuuagacugcauucgcccauguuucuggguggagcugguucgagggcuucccagagaaaacaccacgaucuggaccucuggaucgagcauuuccuucugcggcgugaacucagauacagccaauuggaguuggccugacggugcagaguugccauuuacuaucgauaaguga

SEQ ID NO: 141972 - RNA, 1413 nt, Artificial Sequence
  derived and/or modified sequence opt3 from neuraminidase__InfluenzaA__ADN89372
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugugaacaucaauaacacuaauauuguugcaggggaagacaaaaccucggugacacuugccggaaacucaagccuguguaguaucuccggcugggcgaucuacaccaaggauaauucuauuaggauagguagcaaaggggacguauucgugauccgggagccuuuuauuuccugcucacacuuggaaugucgcacuuucuuuuuaacacaaggagcucugcuaaacgauaagcauaguaauggcaccgucaaagaccgaagcccauaucgugcccucaugucuugcccgcugggcgaggcacccuccccuuacaacucaaaguucgaaagcguggccuggagugcuucugcaugucacgaugggaugggauggcuuacgaucgguauauccggcccagacaacggggccguugcugugcugaaguauaauggaauuaucacuggcaccaucaaaagcuggaagaaacagauuuugagaacacaggagucggagugcgucuguaugaacgguucuugcuuuacuaucaugaccgaugggcccuccaauaaggccgcgucauacaaaauuuucaagauagaaaagggaaaagugacaaagaguaucgagcucaacgcaccuaauuuuuauuacgaagaguguagcugcuacccagacaccggcauuguaauguguguuugcagggauaacuggcauggcuccaaucggcccugggugucuuucaaccagaaucuggacuaucaaaucggguacaucugcagcggagucuuuggugauaacccucgcccagaggacggcgaagggucauguaauccggugacggugaacggagccgauggcgucaaagguuucaguuauaaguacgggaauggcguuuggauuggaagaacuaaauccaacaggcugcggaagggcuuugagaugauaugggaccccaauggguggacaaacaccgacagcgauuucucugugaaacaggacguaguggcuaucacugauuggucaggauauagugguagcuuuguccagcacccugaacucacaggcuuagacugcauucgcccauguuucuggguggagcugguucgagggcuucccagagaaaacaccacgaucuggaccuccggaucuucgauuagcuucugcggcgucaauuccgauacagccaacuggucauggccugacggugcagaguugccauuuacuaucgauaaguga

SEQ ID NO: 141973 - RNA, 1413 nt, Artificial Sequence; identical to SEQ ID NO: 141948
  derived and/or modified sequence opt3 from neuraminidase__InfluenzaA__ADN89383

SEQ ID NO: 141974 - RNA, 1413 nt, Artificial Sequence
  derived and/or modified sequence opt3 from neuraminidase__InfluenzaA__ADN89405
augaaccccaaucagaagaucauuaccauaggcagcaucuccauugccaucgggauuaucucucugaugcuccaaauaggaucaaucauuaguaucugggcuagccacuccauucagacagguucucagaacaauacuggcaucugcaaccagagaauaauuacguacgaaaauucgaccugggugaaccauacauaugucaauaucaacaauacuaacguuguggcaggggaggacaaaaccucaguaacacuugccggaaauagcagucuguguuccaccucuggcugggcgauuuacacuaaggauaacagcaucaggaucgguuccaaaggggacguguucgucauucgggagccuuuuauaucaugcagucacuuggaaugucgcacauucuuuuuaacccaaggagcucugcuaaaugauaagcauagcaacggcacggugaaagaccgaucuccauaucgugcccucauguccugcccgcugggcgaggcacccucaccuuacaauagcaaguucgaaaguguugccuggucugcuuccgcaugucacgaugggaugggauggcuuacuaucgguauuagcggcccagacaacggggccguggcuguccugaaguauaacggaaucauaaccggcacaauuaaaucguggaagaaacagaucuugagaacucaggagucugagugcguguguaugaaugguuccugcuuuaccaucaugacagaugggcccucaaacaaggccgcgaguuacaaaauuuucaagaucgaaaagggaaaaguaaccaagagcauugagcucaaugcaccuaacuuuuauuacgaagaguguuccugcuacccagacacgggcauaguuaugugugugugcagggauaauuggcauggcucuaaccggcccugggucagcuucaaucagaaccuggacuaucaaaucggguacauuugcucaggaguguuuggugauaauccucgcccagaggacggcgaagggaguuguaacccggugacugucgauggagccaauggcguuaaagguuucuccuauaaguacgggaacggcguguggaucggaagaacaaaaagcaauaggcugcggaagggcuuugagaugaucugggaccccaacggguggaccaauacugacucugauuucucaguaaaacaggacguggucgcuauuacagauuggaguggauauagcgguuccuuugugcagcacccugaacucaccggcuuagacugcauacgcccauguuucuggguugagcuggugcgagggcuucccagagaaaacacgaccaucuggacaucuggaucgagcauuuccuucugcggcgucaacucagauacugccaauuggaguuggccugacggugcagaguugccauuuaccaucgauaaguga

SEQ ID NO: 141975 - RNA, 1413 nt, Artificial Sequence
  derived and/or modified sequence opt3 from neuraminidase__InfluenzaA__ADN89416
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggagugcugggugauaacccucgcccagaggacggcgaagggucauguaauccggugacggucgauggagccaacggcguuaaagguuuuaguuauaaguacgggaauggcguguggaucggaagaacuaaauccaacaggcuccggaagggcuucgagaugauuugggaccccaauggguggacaaacaccgacagcgauuuuucuguaaaacaggacguggucgcuauaacugauuggucaggauauagugguagcuucgugcagcacccugaauuaacaggccuggacugcauccgcccauguuuuuggguugagcuugugcgaggguugcccagagaaaacaccacgauuuggaccuccggaucuucgaucagcuucugcggcgucaauggugauacagccaacugguccuggccugacggggcagagcugccauucacuauugauaaguga

SEQ ID NO: 141976 - RNA, 1413 nt, Artificial Sequence
  derived and/or modified sequence opt3 from neuraminidase__InfluenzaA__ADN89427
augaaccccaaucagaagaucauuaccauaggcagcaucuccauugccaucgggauuaucucucugaugcuccaaauaggaucaaucauuaguaucugggcuagccacuccauucagacagguucucagaacaauacuggcaucugcaaccagagaauaauuacguacgaaaauucgaccugggugaaccauacauaugucaauaucaacaauacuaacguuguggcaggggaggacaaaaccucaguaacacuugccggaaauagcagucuguguuccauuucuggcugggcgaucuacaccaaggauaacagcaucaggauugguuccaaaggggacguguucgucauacgggagccuuuuaucucaugcagucacuuggaaugucgcacuuucuuuuuaacacaaggagcucugcuaaaugauaagcauagcaacggcaccgugaaagaccgaucuccauaucgugcccucauguccugcccgcugggcgaggcacccucaccuuacaauagcaaguucgaaaguguugccuggucugcuuccgcaugucacgaugggaugggauggcuuacgauugguaucagcggcccagacaacggggccguggcuguccugaaguauaacggaauaauuacuggcaccaucaaaucguggaagaaacagaucuugagaacacaggagucugagugcguguguaugaaugguuccugcuuuacuauuaugaccgaugggcccucaaacaaggccgcgaguuacaaaaucuucaagauugaaaagggaaaaguaacaaagagcauagagcucaaugcaccuaacuuuuauuacgaagaguguuccugcuacccagacaccggcaucguuaugugugugugcagggauaauuggcauggcucuaaccggcccugggucagcuucaaucagaaccuggacuaucaaauuggguacaucugcucaggaguguuuggugauaauccucgcccagaggacggcgaagggaguuguaacccggugacggucgauggagccaauggcguuaaagguuucuccuauaaguacgggaacggcguguggaucggaagaacuaaaagcaauaggcugcggaagggcuuugagaugauuugggaccccaacggguggacaaauaccgacucugauuucucaguaaaacaggacguggucgcuauaacugauuggaguggauauagcgguuccuuugugcagcacccugaacucacaggcuuagacugcauccgcccauguuucuggguugagcuggugcgagggcuucccagagaaaacaccacgauuuggaccucuggaucgagcaucuccuucugcggcgucgauucagacgccgcagauuggaguuggccugacggugcugaguugccauuuacaauugauaaguga

SEQ ID NO: 141977 - RNA, 1413 nt, Artificial Sequence; identical to SEQ ID NO: 139477
  derived and/or modified sequence opt3 from neuraminidase__InfluenzaA__ADN89438

SEQ ID NO: 141978 - RNA, 1413 nt, Artificial Sequence
  derived and/or modified sequence opt3 from neuraminidase__InfluenzaA__ADN89449
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaccuucgguaacccuugccggaaacucaagccuguguaguauuuccggcugggcgaucuacacaaaggauaauucuaucaggauugguagcaaaggggacguguucgucauacgggagccauuuaucuccugcucacacuuggaaugucgcaccuucuuuuuaacucaaggagcucugcuaaacgauaagcauaguaauggcacagugaaagaccgaagcccguaucgugcccucaugucuugcccccugggcgaggcaccuuccccauacaacucaaaguucgaaagcguugccuggagugcuucugcaugucacgaugggaugggauggcuuaccauugguaucuccggccccgacaacggggccguggcuguccugaaguauaauggaauaauuacgggcacuaucaaaagcuggaagaaacagaucuugagaacccaggagucggagugcguguguaugaacgguucuugcuuuacaauuaugacugaugggccuuccaauaaggccgcgucauacaaaaucuucaagauugaaaagggaaaaguaaccaagaguauagagcucaacgcaccaaauuuuuauuacgaagaguguagcugcuaccccgacacaggcaucguuaugugugugugcagggauaacuggcauggcuccaaucggccuugggucucuuucaaccagaaucuggacuaucaaauuggguacaucugcagcggaguguuuggugauaacccacgcccggaggacggcgaagggucauguaaucccgugaccgucgauggagccaacggcguuaaagguuucaguuauaaguacgggaauggcguguggaucggaagaacgaaauccaacaggcugcggaagggcuuugagaugauuugggacccuaauggguggacuaacacagacagcgauuucucuguaaaacaggacguggucgcuauaaccgauuggucaggauauagugguagcuuugugcagcacccagaacucacuggcuuagacugcauccgccccuguuucuggguugagcuggugcgagggcuuccuagagaaaacacaaccauuuggacguccggaucuucgaucagcuucugcggcgucaauuccgauaccgccaacuggucauggccagacggugcagaguugcccuuuacaauugauaaguga

SEQ ID NO: 141979 - RNA, 1413 nt, Artificial Sequence; identical to SEQ ID NO: 140946
  derived and/or modified sequence opt3 from neuraminidase__InfluenzaA__ADN89460

SEQ ID NO: 141980 - RNA, 1413 nt, Artificial Sequence; identical to SEQ ID NO: 139477
  derived and/or modified sequence opt3 from neuraminidase__InfluenzaA__ADN89482

SEQ ID NO: 141981 - RNA, 1413 nt, Artificial Sequence
  derived and/or modified sequence opt3 from neuraminidase__InfluenzaA__ADN89493
augaaccccaaucagaagaucauuaccauaggcagcaucuccauugccaucgggauuaucucucugaugcuccaaauaggaaacaucauuucaaucugggcuagucacagcauucagacagagucccagaauaacacugguaucugcaaucagagaauaauuacguacgaaaacucuaccugggugaaucauacauaugucaacaucaauaacacuaauguuguggcaggcgaggacaaaaccucgguaacacuugccgggaacucaagccuguguaguauuuccggaugggcgaucuacaccaaggauaauucuaucaggauuggcagcaaaggugacguguucgucauacgggaaccuuuuaucuccugcucacacuuggagugucgcacuuucuuuuuaacacaaggggcucugcuaaacgauaagcauaguaauggaaccgugaaagaccgaagcccauaucgugcccucaugucuugcccgcugggcgaagcacccuccccuuacaacucaaaguucgagagcguugccuggagugcuucugcaugucacgauggcaugggguggcuuacgauuggaaucuccgguccagacaacggcgccguggcuguccugaaguauaaugggauaauuacuggaaccaucaaaagcuggaagaaacagaucuugagaacacaggagucggaaugcguguguaugaacggcucuugcuuuacuauuaugaccgauggucccuccaauaaggccgcgucauacaaaaucuucaagauugagaaggggaaaguaacaaagaguauagaacucaacgcaccuaauuuuuauuacgaggaguguagcugcuacccagacaccggaaucguuaugugugugugcagggauaacuggcauggcuccaaucggcccugggucucuuucaaccagaaucuggacuaucaaaugggcuacauuugcagcgggguguuuggagauaacccucgcccagaagacggugagggcucauguaauccggugacggucgauggggccaacggaguuaaaggcuucaguuauaaguacgguaaugggguguggaucggcagaacuaaauccaacaggcugcggaagggauuugaaaugaucugggaccccaauggcuggacaaacaccgacagcgauuucucuguaaaacaggacguggucgcuauuacugauuggucaggguauagugguagcuuugugcagcacccugagcucacaggauuagacugcauacgcccauguuucuggguugaacuggugcgaggccuucccagagagaacaccacgaucuggaccuccgggucuucgauuagcuucugcggagucaauuccgauacagccaacuggucauggccugacggcgcagaguugccauuuacuaucgauaaguga

SEQ ID NO: 141982 - RNA, 1413 nt, Artificial Sequence; identical to SEQ ID NO: 139477
  derived and/or modified sequence opt3 from neuraminidase__InfluenzaA__ADN89504

SEQ ID NO: 141983 - RNA, 1413 nt, Artificial Sequence
  derived and/or modified sequence opt3 from neuraminidase__InfluenzaA__ADN89515
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucgauggagccaacggcguuaaagguuucaguuauaaguacgggaauggcguguggaucggaagaacuaaauccaacaggcugcggaagggcuuugagaugauuugggaccccaauggguggacaaacaccgacagcgauuucacuguaaaacaggacguggucgcuauaacagauuggucuggauauucagguaguuuugugcagcacccugaacucaccggcuuagacugcauccgcccauguuucuggguugagcuggugcgagggcuucccagagaaaacacgaccauuuggacaagcggauccucuaucucguucugcggcgucaauagcgauacugccaacugguccuggccugacggugcagaguugccauuuaccauugauaaguga

SEQ ID NO: 141984 - RNA, 1413 nt, Artificial Sequence; identical to SEQ ID NO: 139477
  derived and/or modified sequence opt3 from neuraminidase__InfluenzaA__ADN89526

SEQ ID NO: 141985 - RNA, 1413 nt, Artificial Sequence; identical to SEQ ID NO: 141948
  derived and/or modified sequence opt3 from neuraminidase__InfluenzaA__ADN89537

SEQ ID NO: 141986 - RNA, 1413 nt, Artificial Sequence; identical to SEQ ID NO: 139477
  derived and/or modified sequence opt3 from neuraminidase__InfluenzaA__ADN89548

SEQ ID NO: 141987 - RNA, 1413 nt, Artificial Sequence; identical to SEQ ID NO: 139477
  derived and/or modified sequence opt3 from neuraminidase__InfluenzaA__ADN89570

SEQ ID NO: 141988 - RNA, 1413 nt, Artificial Sequence
  derived and/or modified sequence opt3 from neuraminidase__InfluenzaA__ADN89581
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaagacagccucauacaaaaucuucaagauugaaaagggaaaaguaaccaagaguauagagcucaacgcgccuaauuuuuauuacgaagaguguagcugcuacccagacacgggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacugucgauggagcaaacggcguuaaagguuucaguuauaaguacgggaauggcguguggaucggaagaacaaaauccaacaggcugcggaagggcuuugagaugauuugggaccccaauggguggaccaacacugacagcgauuucucuguaaaacaggacguggucgccauaacagauuggucaggauauagugguagcuuugugcagcacccugaacucaccggcuuagacugcauccgcccauguuucuggguugagcuggugcgagggcuucccagagaaaacacgaccauuuggacauccggaucuucgaucagcuucugcggcgucaauggugauacugcuaacugguccuggccugacggggccgaguugccauuuaccauugauaaguga

SEQ ID NO: 141989 - RNA, 1413 nt, Artificial Sequence; identical to SEQ ID NO: 140946
  derived and/or modified sequence opt3 from neuraminidase__InfluenzaA__ADN89592

SEQ ID NO: 141990 - RNA, 1413 nt, Artificial Sequence; identical to SEQ ID NO: 140946
  derived and/or modified sequence opt3 from neuraminidase__InfluenzaA__ADN89603

SEQ ID NO: 141991 - RNA, 1413 nt, Artificial Sequence; identical to SEQ ID NO: 141956
  derived and/or modified sequence opt3 from neuraminidase__InfluenzaA__ADN89614

SEQ ID NO: 141992 - RNA, 1413 nt, Artificial Sequence; identical to SEQ ID NO: 141975
  derived and/or modified sequence opt3 from neuraminidase__InfluenzaA__ADN89625

SEQ ID NO: 141993 - RNA, 1413 nt, Artificial Sequence; identical to SEQ ID NO: 139477
  derived and/or modified sequence opt3 from neuraminidase__InfluenzaA__ADN89636

SEQ ID NO: 141994 - RNA, 1413 nt, Artificial Sequence; identical to SEQ ID NO: 139477
  derived and/or modified sequence opt3 from neuraminidase__InfluenzaA__ADN89647

SEQ ID NO: 141995 - RNA, 1413 nt, Artificial Sequence; identical to SEQ ID NO: 139477
  derived and/or modified sequence opt3 from neuraminidase__InfluenzaA__ADN89658

SEQ ID NO: 141996 - RNA, 1413 nt, Artificial Sequence; identical to SEQ ID NO: 140946
  derived and/or modified sequence opt3 from neuraminidase__InfluenzaA__ADN89669

SEQ ID NO: 141997 - RNA, 1413 nt, Artificial Sequence; identical to SEQ ID NO: 139477
  derived and/or modified sequence opt3 from neuraminidase__InfluenzaA__ADN89680

SEQ ID NO: 141998 - RNA, 1413 nt, Artificial Sequence; identical to SEQ ID NO: 139477
  derived and/or modified sequence opt3 from neuraminidase__InfluenzaA__ADN89691

SEQ ID NO: 141999 - RNA, 1413 nt, Artificial Sequence; identical to SEQ ID NO: 141975
  derived and/or modified sequence opt3 from neuraminidase__InfluenzaA__ADN89702

SEQ ID NO: 142000 - RNA, 1413 nt, Artificial Sequence; identical to SEQ ID NO: 139477
  derived and/or modified sequence opt3 from neuraminidase__InfluenzaA__ADN89713

SEQ ID NO: 142001 - RNA, 1413 nt, Artificial Sequence; identical to SEQ ID NO: 139477
  derived and/or modified sequence opt3 from neuraminidase__InfluenzaA__ADN89724

SEQ ID NO: 142002 - RNA, 1413 nt, Artificial Sequence; identical to SEQ ID NO: 139477
  derived and/or modified sequence opt3 from neuraminidase__InfluenzaA__ADN89735

SEQ ID NO: 142003 - RNA, 1413 nt, Artificial Sequence; identical to SEQ ID NO: 139477
  derived and/or modified sequence opt3 from neuraminidase__InfluenzaA__ADN89746

SEQ ID NO: 142004 - RNA, 1413 nt, Artificial Sequence; identical to SEQ ID NO: 139477
  derived and/or modified sequence opt3 from neuraminidase__InfluenzaA__ADN89757

SEQ ID NO: 142005 - RNA, 1413 nt, Artificial Sequence; identical to SEQ ID NO: 139477
  derived and/or modified sequence opt3 from neuraminidase__InfluenzaA__ADN89768

SEQ ID NO: 142006 - RNA, 1413 nt, Artificial Sequence; identical to SEQ ID NO: 141952
  derived and/or modified sequence opt3 from neuraminidase__InfluenzaA__ADN89779

SEQ ID NO: 142007 - RNA, 1413 nt, Artificial Sequence; identical to SEQ ID NO: 139477
  derived and/or modified sequence opt3 from neuraminidase__InfluenzaA__ADN89790

SEQ ID NO: 142008 - RNA, 1413 nt, Artificial Sequence
  derived and/or modified sequence opt3 from neuraminidase__InfluenzaA__ADN89801
augaaccccaaucagaagaucauuaccauaggcagcaucuccauugccaucgggacaauuucucugaugcuccaaaucggaaacauaaucucaauuugggcuagucacagcauccagacugguucccagaauaacacgggcauuugcaaucagagaaucauaaccuacaaaaacucuacaugggugaaucauacuuaugucaacauuaauaacaccaauguuguggcaggggaggacaagacaucgguaacccuugccggaaacucaagccuguguaguaucuccggcugggcgauuuacacuaaagauaauucuaucaggaucgguagcaagggggacguguucgucauucgggaaccuuuuauauccugcucacacuuggagugucgcacauucuuuuuaacccaaggagcucugcuaaacgauaaacauaguaauggcacggugaaggaccgaagcccauaucgugcccucaugucuugcccgcugggcgaagcacccuccccuuacaacucaaaguucgagagcguugccuggagugcuucugcaugucacgaugggaugggauggcuuacuaucgguauuuccggcccagacaacggggccguggcuguccugaaauauaauggaaucauaaccggcacaauuaagagcuggaaaaagcagaucuugagaacucaggaaucggagugcguguguaugaacgguucuugcuuuaccaucaugacagaugggcccuccaauaaagccgcgucauacaagauuuucaagaucgagaaaggaaagguaaccaaaaguauugaacucaacgcaccuaauuuuuauuacgaggaauguagcugcuacccagacacgggcauaguuaugugugugugcagggauaacuggcauggcuccaaucggcccugggucucuuucaaccagaaucuggacuaucaaaucggguacauuugcagcggaguguuuggugauaacccucgcccagaggacggcgaggggucauguaauccggugacugucgauggagccaacggcguuaaggguuucaguuauaaauacgggaauggcguguggaucggaagaacaaaguccaacaggcugcggaaaggcuuugaaaugaucugggaccccaauggguggaccaacacugacagcgauuucucuguaaagcaggacguggucgcuauuacagauuggucaggauauagugguagcuuugugcagcacccugagcucaccggcuuagacugcauacgcccauguuucuggguugaacuggugcgagggcuucccagagagaacacgaccaucuggacauccggaucuucgauuagcuucugcggcgucaauuccgauacugccaacuggucauggccugacggugcagaauugccauuuaccaucgauaaguga

SEQ ID NO: 142009 - RNA, 1413 nt, Artificial Sequence
  derived and/or modified sequence opt3 from neuraminidase__InfluenzaA__ADN89823
augaaccccaaucagaagaucauuaccauaggcagcaucuccauugccaucgggauuaucucucugaugcuccaaauaggaucaaucauuaguaucugggcuagccacuccauucauacagguucucagaacaauacuggcaucugcaaccagagaauaauuacguacgaaaauucgaccugggugaaccacacauaugucaauaucaacaauacuaacguuguggcaggggaggacaaaaccucaguaacacuugccggaaauagcagucuguguuccauuucuggcugggcgaucuacaccaaggauaacagcaucaggauugguuccaaaggggacguguucgucauacgggagccuuuuaucucaugcagucauuuggaaugucgcacuuucuuuuuaacacagggagcucugcuaaaugauaagcacagcaacggcaccgugaaagaccgaucuccauaucgugcccucauguccugcccgcugggcgaggcacccucaccuuacaauagcaaguucgaaaguguugccuggucugcuuccgcaugucaugaugggaugggauggcuuacgauugguaucagcggcccagacaacggggccguggcuguccugaaguauaacggaauaauuacuggcaccaucaaaucguggaagaaacaaaucuugagaacacaggagucugagugcguguguaugaaugguuccugcuuuacuauuaugaccgaugggcccucaaacaaggccgcgaguuacaaaaucuucaagauugaaaagggaaaaguaacaaagagcauagagcucaaugcaccuaacuuuuauuacgaagaguguuccugcuacccagacaccggcaucguuaugugugugugcagggauaauuggcacggcucuaaccggcccugggucagcuucaaucagaaccuggacuaucagauuggguacaucugcucaggaguguuuggugauaauccucgcccagaggacggcgaagggaguuguaacccggugacggucgauggagccaauggcguuaaagguuucuccuauaaguacgggaacggcguguggaucggaagaacuaaaagcaauaggcugcggaagggcuuugagaugauuugggaccccaacggguggacaaauaccgacucugauuucucaguaaaacaagacguggucgcuauaacugauuggaguggauauagcgguuccuuugugcagcacccugaacucacaggcuuagacugcauccgcccauguuucuggguugagcuggugcgagggcuucccagagaaaacaccacgauuuggaccucuggaucgagcaucuccuucugcggcgucaacucagauacagccaauuggaguuggccugacggugcagaguugccauuuacuauugauaaguga

SEQ ID NO: 142010 - RNA, 1413 nt, Artificial Sequence; identical to SEQ ID NO: 140946
  derived and/or modified sequence opt3 from neuraminidase__InfluenzaA__ADN89834

SEQ ID NO: 142011 - RNA, 1413 nt, Artificial Sequence; identical to SEQ ID NO: 141948
  derived and/or modified sequence opt3 from neuraminidase__InfluenzaA__ADN89845

SEQ ID NO: 142012 - RNA, 1413 nt, Artificial Sequence; identical to SEQ ID NO: 139477
  derived and/or modified sequence opt3 from neuraminidase__InfluenzaA__ADN89856

SEQ ID NO: 142013 - RNA, 1410 nt, Artificial Sequence; identical to SEQ ID NO: 141426
  derived and/or modified sequence opt3 from neuraminidase__InfluenzaA__ADN89867

SEQ ID NO: 142014 - RNA, 1410 nt, Artificial Sequence; identical to SEQ ID NO: 141426
  derived and/or modified sequence opt3 from neuraminidase__InfluenzaA__ADN89878

SEQ ID NO: 142015 - RNA, 1410 nt, Artificial Sequence; identical to SEQ ID NO: 141426
  derived and/or modified sequence opt3 from neuraminidase__InfluenzaA__ADN89889

SEQ ID NO: 142016 - RNA, 1410 nt, Artificial Sequence; identical to SEQ ID NO: 141426
  derived and/or modified sequence opt3 from neuraminidase__InfluenzaA__ADN89900

SEQ ID NO: 142017 - RNA, 1410 nt, Artificial Sequence; identical to SEQ ID NO: 141426
  derived and/or modified sequence opt3 from neuraminidase__InfluenzaA__ADN89911

SEQ ID NO: 142018 - RNA, 1410 nt, Artificial Sequence
  derived and/or modified sequence opt3 from neuraminidase__InfluenzaA__ADN89922
augaaccccaaucagaagaucauuaccauaggcagcgugucccugacaaucucuacuauuugcuucuuuaugcagaucgccauucucaucacgaccgucacacuucacuucaaacaguacaaguuuaacucaccuccaaauaaccagguuaugcugugugagccgacuauaaucgaaagaaauauuaccgagaucguguauuugacaaacaccacuauugaaaaagagaucugccccaaguuagcugaauacaggaauuggaguaaaccucagugugacauaacaggguucgcaccauuuagcaaggauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugagcugggaguucccuuucacuugggcaccaaacaggugugcauugcuuggagcaguuccucuugucaugacgguaaggccuggcuccacgucugcaucacaggggaugacaaaaacgcaaccgccagcuucaucuacaauggaaggcugguggauuccguaguuucauggaguaaggaaauucugcggacgcaggagagcgaaugugugugcauaaacggcacuuguacagucgugaugaccgacggcucugcuuccgggaaagcagauacuaagauccucuuuauugaggagggaaagaucgugcauacaucaaccuuaagcgguagugcccaacacgucgaagagugcucuugcuauccucgcuacccaggcguuagaugugugugcagggacaacuggaaaggguccaaucggccgauaguagauauuaacaucaaggaccacagcaucgugucgucuuacgucuguuccggacuggugggcgacacgccccgcaaaaaugauucaaguagcuccucucauugccuugacccuaacaaugaagagggugggcacggaguuaagggcugggcuuucgaugacggcaacgauguguggauggggcgaaccauuaaugaaacaagcagauugggauaugagacuuuuaaagucaucgaggguuggucaaacccaaagaguaaacugcagauuaauaggcaagugauaguagaccggggcaaccguuccggguacagcggaaucuucucuguugaaggcaagucauguauuaaucgcugcuuuuauguggagcuaaucagagguaggaaggaagagaccgaaguccucuggacaaguaacagcaucguggucuucugugggacuuccggcaccuacggaacaggcucuuggcccgauggggccgaccugaauauuaugccuauauga

SEQ ID NO: 142019 - RNA, 1410 nt, Artificial Sequence; identical to SEQ ID NO: 141426
  derived and/or modified sequence opt3 from neuraminidase__InfluenzaA__ADN89933

SEQ ID NO: 142020 - RNA, 1410 nt, Artificial Sequence; identical to SEQ ID NO: 141426
  derived and/or modified sequence opt3 from neuraminidase__InfluenzaA__ADN89955

SEQ ID NO: 142021 - RNA, 1410 nt, Artificial Sequence; identical to SEQ ID NO: 141426
  derived and/or modified sequence opt3 from neuraminidase__InfluenzaA__ADN89966

SEQ ID NO: 142022 - RNA, 1410 nt, Artificial Sequence; identical to SEQ ID NO: 141426
  derived and/or modified sequence opt3 from neuraminidase__InfluenzaA__ADN89977

SEQ ID NO: 142023 - RNA, 1410 nt, Artificial Sequence; identical to SEQ ID NO: 141426
  derived and/or modified sequence opt3 from neuraminidase__InfluenzaA__ADN89988

SEQ ID NO: 142024 - RNA, 1410 nt, Artificial Sequence; identical to SEQ ID NO: 141426
  derived and/or modified sequence opt3 from neuraminidase__InfluenzaA__ADN89999

SEQ ID NO: 142025 - RNA, 1410 nt, Artificial Sequence; identical to SEQ ID NO: 141426
  derived and/or modified sequence opt3 from neuraminidase__InfluenzaA__ADN90010

SEQ ID NO: 142026 - RNA, 1410 nt, Artificial Sequence; identical to SEQ ID NO: 141426
  derived and/or modified sequence opt3 from neuraminidase__InfluenzaA__ADN90021

SEQ ID NO: 142027 - RNA, 1410 nt, Artificial Sequence; identical to SEQ ID NO: 141426
  derived and/or modified sequence opt3 from neuraminidase__InfluenzaA__ADN90032

SEQ ID NO: 142028 - RNA, 1410 nt, Artificial Sequence; identical to SEQ ID NO: 141426
  derived and/or modified sequence opt3 from neuraminidase__InfluenzaA__ADN90043

SEQ ID NO: 142029 - RNA, 1410 nt, Artificial Sequence; identical to SEQ ID NO: 141426
  derived and/or modified sequence opt3 from neuraminidase__InfluenzaA__ADN90054

SEQ ID NO: 142030 - RNA, 1410 nt, Artificial Sequence; identical to SEQ ID NO: 141426
  derived and/or modified sequence opt3 from neuraminidase__InfluenzaA__ADN90065

SEQ ID NO: 142031 - RNA, 1410 nt, Artificial Sequence; identical to SEQ ID NO: 141426
  derived and/or modified sequence opt3 from neuraminidase__InfluenzaA__ADN90076

SEQ ID NO: 142032 - RNA, 1410 nt, Artificial Sequence; identical to SEQ ID NO: 141426
  derived and/or modified sequence opt3 from neuraminidase__InfluenzaA__ADN90087

SEQ ID NO: 142033 - RNA, 1410 nt, Artificial Sequence; identical to SEQ ID NO: 141426
  derived and/or modified sequence opt3 from neuraminidase__InfluenzaA__ADN90098

SEQ ID NO: 142034 - RNA, 1410 nt, Artificial Sequence; identical to SEQ ID NO: 141426
  derived and/or modified sequence opt3 from neuraminidase__InfluenzaA__ADN90109

SEQ ID NO: 142035 - RNA, 1410 nt, Artificial Sequence; identical to SEQ ID NO: 141426
  derived and/or modified sequence opt3 from neuraminidase__InfluenzaA__ADN90120

SEQ ID NO: 142036 - RNA, 1410 nt, Artificial Sequence; identical to SEQ ID NO: 141426
  derived and/or modified sequence opt3 from neuraminidase__InfluenzaA__ADN90131

SEQ ID NO: 142037 - RNA, 1410 nt, Artificial Sequence; identical to SEQ ID NO: 141426
  derived and/or modified sequence opt3 from neuraminidase__InfluenzaA__ADN90142

SEQ ID NO: 142038 - RNA, 1410 nt, Artificial Sequence; identical to SEQ ID NO: 141426
  derived and/or modified sequence opt3 from neuraminidase__InfluenzaA__ADN90153

SEQ ID NO: 142039 - RNA, 1410 nt, Artificial Sequence; identical to SEQ ID NO: 141426
  derived and/or modified sequence opt3 from neuraminidase__InfluenzaA__ADN90164

SEQ ID NO: 142040 - RNA, 1410 nt, Artificial Sequence; identical to SEQ ID NO: 141426
  derived and/or modified sequence opt3 from neuraminidase__InfluenzaA__ADN90186

SEQ ID NO: 142041 - RNA, 1410 nt, Artificial Sequence; identical to SEQ ID NO: 141426
  derived and/or modified sequence opt3 from neuraminidase__InfluenzaA__ADN90197

SEQ ID NO: 142042 - RNA, 1410 nt, Artificial Sequence
  derived and/or modified sequence opt3 from neuraminidase__InfluenzaA__ADN90208
augaaccccaaucagaagaucauuaccauaggcagcgugucccugacaaucucuacuauuugcuucuuuaugcagaucgccauucucaucacgaccgucacacuucacuucaaacaguacaaguuuaacucaccuccaaauaaccagguuaugcugugugagccgacuauaaucgaaagaaauauuaccgagaucguguauuugacaaacaccacuauugaaaaagagaucugccccaaguuagcugaauacaggaauuggaguaaaccucagugugacauaacaggguucgcaccauuuagcaaggauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugagcugggaguucccuuucacuugggcaccaaacaggugugcauugcuuggagcaguuccucuugucaugacgguaaggccuggcuccacgucugcaucacaggggaugacaaaaacgcaaccgccagcuucaucuacaauggaaggcugguggauuccguaguuucauggaguaaggaaauucugcggacgcaggagagcgaaugugugugcauaaacggcacuuguacagucgugaugaccgacggcucugcuuccgggaaagcagauacuaagauccucuuuauugaggagggaaagaucgugcauacaucaaccuuaagcgguagugcccaacacgucgaagagugcucuugcuauccucgcuacccaggcguuagaugugugugcagggacaacuggaaaggguccaaucggccgauaguagauauuaacaucaaggaccacagcaucgugucgucuuacgucuguuccggacuggugggcgacacgccccgcaaaaaugauucaaguagcuccucucauugccuugacccuaacaaugaagagggugggcacggaguuaagggcugggcuuucgaugacggcaacgauguguggauggggcgaaccauuaaugaaacaagcagauugggauaugagacuuuuaaagucaucgaggguuggucaaacccaaagaguaaacugcagauuaauaggcaagugauaguagaccgguccaaccguagcggcuacucugggaucuucucaguugaaggaaagaguuguauuaaucgcugcuuuuauguggagcuaaucagaggcaggaaggaagagaccgaaguccucuggacaagcaacuccaucguggucuucugugguacuucugggaccuacggcacaggaucguggcccgauggcgccgaccugaaucuuaugccuauuuga

SEQ ID NO: 142043 - RNA, 1410 nt, Artificial Sequence; identical to SEQ ID NO: 141426
  derived and/or modified sequence opt3 from neuraminidase__InfluenzaA__ADN90219

SEQ ID NO: 142044 - RNA, 1410 nt, Artificial Sequence
  derived and/or modified sequence opt3 from neuraminidase__InfluenzaA__ADN92469
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgagaaggcagauacuaaaauccucuuuauugaagaggggaagaucgugcauacaucaaccuuaagcggaagugcccaacacgucgaagagugcucuugcuauccucgcuacccagguguuagaugugugugcagggacaacuggaagggcuccaaucggccgauaguagauauuaacaucaaagaccacagcaucgugucgucuuacgucuguuccgggcuggugggagacacgccccgcaagaaugauucaaguagcuccucucauugccuugacccuaacaaugaagagggcggucacgggguuaaaggaugggcuuucgaugacggcaacgauguguggaugggccgaaccauuagcgagaagucaagauugggguaugaaacauuuaaagucaucgagggauggaguaauccaaaguccaaacugcagauuaacaggcaagugauaguagaccgggguaaucguagcggcuacucugggaucuucucaguugaaggaaagaguuguauuaaccgcugcuuuuauguggagcuaaucagaggcaggaaggaagagacugagguccucuggaccagcaauuccaucguggucuucugugguacaucugggacuuacggcaccggaucguggcccgauggcgccgacauuaaccugaugccuauauga

SEQ ID NO: 142045 - RNA, 1410 nt, Artificial Sequence; identical to SEQ ID NO: 141271
  derived and/or modified sequence opt3 from neuraminidase__InfluenzaA__ADN92480

SEQ ID NO: 142046 - RNA, 1410 nt, Artificial Sequence; identical to SEQ ID NO: 141271
  derived and/or modified sequence opt3 from neuraminidase__InfluenzaA__ADN92491

SEQ ID NO: 142047 - RNA, 1410 nt, Artificial Sequence
  derived and/or modified sequence opt3 from neuraminidase__InfluenzaA__ADN92502
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggaacggaguuaaaggcugggcuuucgaugacggcaaugauguguggauggggcgaaccauuagcgagaagucaagauugggauaugagacauuuaaagucaucgaagguuggaguaacccaaaguccaaacugcagauuaauaggcaagugauaguagaccggggcaaccguagcggguacucuggaaucuucucaguugagggcaagaguuguauuaaucgcugcuuuuauguggaacuaaucagagguaggaaggaggaaaacgagguccucuggacuagcaauuccaucguggucuucugugggaccucuggcacauacggaacuggcucguggcccgauggggccgacauuaaccugaugccuauauga

SEQ ID NO: 142048 - RNA, 1410 nt, Artificial Sequence; identical to SEQ ID NO: 138754
  derived and/or modified sequence opt3 from neuraminidase__InfluenzaA__ADN92512

SEQ ID NO: 142049 - RNA, 1410 nt, Artificial Sequence; identical to SEQ ID NO: 138754
  derived and/or modified sequence opt3 from neuraminidase__InfluenzaA__ADN92522

SEQ ID NO: 142050 - RNA, 1410 nt, Artificial Sequence; identical to SEQ ID NO: 138754
  derived and/or modified sequence opt3 from neuraminidase__InfluenzaA__ADN92532

SEQ ID NO: 142051 - RNA, 1410 nt, Artificial Sequence; identical to SEQ ID NO: 138754
  derived and/or modified sequence opt3 from neuraminidase__InfluenzaA__ADN92542

SEQ ID NO: 142052 - RNA, 1410 nt, Artificial Sequence; identical to SEQ ID NO: 138754
  derived and/or modified sequence opt3 from neuraminidase__InfluenzaA__ADN92552

SEQ ID NO: 142053 - RNA, 1410 nt, Artificial Sequence; identical to SEQ ID NO: 138754
  derived and/or modified sequence opt3 from neuraminidase__InfluenzaA__ADO00733

SEQ ID NO: 142054 - RNA, 1410 nt, Artificial Sequence
  derived and/or modified sequence opt3 from neuraminidase__InfluenzaA__ADO00743
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugccaaacuggcgggaaauucgucauugugcccugucagcggaugggcuauauacaguaaggacaacuccauuagaaucggcucuaaaggugauguguuuguuauuagggagccauucaucagcuguuccccguuagaaugccggaccuuuuuccugacacagggggcccuacucaaugacaagcauucaaacggaaccaucaaagaucgcagucccuaucgaacucugaugagcuguccuauuggcgaggugccaucucccuacaacucccguuuugaaucagucgcauggagcgccagugcuugccacgacggcauaaauuggcuuacaaucgggauuucuggaccugauaacggugcaguggccguacugaaguauaauggcaucauaaccgacacgauuaaguccuggagaaacaauaucuugaggacucaagagagcgagugugcuugcguuaacgggucguguuucaccgugaugacagauggaccaucugacggccaggccuccuacaaaaucuuucggauugaaaaggguaaaaucgucaagucaguggagaugaaugcgcccaacuaucauuacgaagagugcaguuguuacccugauagcuccgagauuacuugcgugugccgcgacaauuggcacgggucuaacagaccaugggucagcuucaaucagaaccucgaauaucagauaggauacaucuguucaggcauuuuuggcgauaauccgaggcccaacgacaaaaccgggaguugcggaccuguuuccagcaauggugcaaacggcgugaagggguucucuuuuaaguauggaaacggcguauggaucggucggacaaaaucaaucaguagccgcaauggguucgagaugauuugggauccaaacggcuggaccggaacggacaauaacuuuuccauacgacaagacaucgugggcauuaaugaauggucuggguacucggggagcuucguccagcaucccgagcugacuggucuggauuguaucagaccuugcuucuggguggaacucauuaggggccggccaaaggagaacacaaucuggaccuccgggucaaguauaucuuuuuguggaguuaauagcgacacugugggcugguccuggcccgauggugccgaguuaccguucacaaucgacaaauga

SEQ ID NO: 142055 - RNA, 1410 nt, Artificial Sequence; identical to SEQ ID NO: 139931
  derived and/or modified sequence opt3 from neuraminidase__InfluenzaA__ADO00753

SEQ ID NO: 142056 - RNA, 1410 nt, Artificial Sequence; identical to SEQ ID NO: 138754
  derived and/or modified sequence opt3 from neuraminidase__InfluenzaA__ADO12146

SEQ ID NO: 142057 - RNA, 1410 nt, Artificial Sequence; identical to SEQ ID NO: 138754
  derived and/or modified sequence opt3 from neuraminidase__InfluenzaA__ADO12156

SEQ ID NO: 142058 - RNA, 1410 nt, Artificial Sequence; identical to SEQ ID NO: 138754
  derived and/or modified sequence opt3 from neuraminidase__InfluenzaA__ADO12166

SEQ ID NO: 142059 - RNA, 1410 nt, Artificial Sequence; identical to SEQ ID NO: 138754
  derived and/or modified sequence opt3 from neuraminidase__InfluenzaA__ADO12176

SEQ ID NO: 142060 - RNA, 1410 nt, Artificial Sequence; identical to SEQ ID NO: 138754
  derived and/or modified sequence opt3 from neuraminidase__InfluenzaA__ADO12186

SEQ ID NO: 142061 - RNA, 1410 nt, Artificial Sequence; identical to SEQ ID NO: 138754
  derived and/or modified sequence opt3 from neuraminidase__InfluenzaA__ADO12196

SEQ ID NO: 142062 - RNA, 1410 nt, Artificial Sequence; identical to SEQ ID NO: 138754
  derived and/or modified sequence opt3 from neuraminidase__InfluenzaA__ADO12206

SEQ ID NO: 142063 - RNA, 1410 nt, Artificial Sequence; identical to SEQ ID NO: 138754
  derived and/or modified sequence opt3 from neuraminidase__InfluenzaA__ADO12216

SEQ ID NO: 142064 - RNA, 1410 nt, Artificial Sequence; identical to SEQ ID NO: 138754
  derived and/or modified sequence opt3 from neuraminidase__InfluenzaA__ADO12226

SEQ ID NO: 142065 - RNA, 1410 nt, Artificial Sequence; identical to SEQ ID NO: 138754
  derived and/or modified sequence opt3 from neuraminidase__InfluenzaA__ADO12246

SEQ ID NO: 142066 - RNA, 1410 nt, Artificial Sequence; identical to SEQ ID NO: 138754
  derived and/or modified sequence opt3 from neuraminidase__InfluenzaA__ADO12266

SEQ ID NO: 142067 - RNA, 1410 nt, Artificial Sequence
  derived and/or modified sequence opt3 from neuraminidase__InfluenzaA__ADO12276
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaguggguccugcggaccugugagcucuaauggugcgaacggcguaaagggguucucauuuaaguauggaaacggcguguggaucggucggaccaaaaguaucagcucccgcaauggguucgagaugauuugggauccaaacggcuggacaggaaccgacaauaacuuuucuauaaagcaagacaucgucggcauuaaugaauggucgggguacagcggauccuucgugcagcaucccgagcugacgggucuggauuguauccgaccuugcuucuggguugaacucauuagaggcaggccaaaagagaacacuaucuggacaucagggaguucuauaucguuuuguggagucaauuccgacaccgugggcuggucauggcccgauggugcagaguuaccguucacuaucgacaaguga

SEQ ID NO: 142068 - RNA, 1410 nt, Artificial Sequence; identical to SEQ ID NO: 138754
  derived and/or modified sequence opt3 from neuraminidase__InfluenzaA__ADO12286

SEQ ID NO: 142069 - RNA, 1410 nt, Artificial Sequence; identical to SEQ ID NO: 138754
  derived and/or modified sequence opt3 from neuraminidase__InfluenzaA__ADO12296

SEQ ID NO: 142070 - RNA, 1410 nt, Artificial Sequence; identical to SEQ ID NO: 138754
  derived and/or modified sequence opt3 from neuraminidase__InfluenzaA__ADO12306

SEQ ID NO: 142071 - RNA, 1410 nt, Artificial Sequence
  derived and/or modified sequence opt3 from neuraminidase__InfluenzaA__ADO12316
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggagauggcguguggaucggucggacaaaaucaaucaguagccgcaacggguucgagaugauuugggacccaaauggcuggaccggaacggacaacaauuuuuccauaaagcaagauaucgucggcauuaacgaauggucuggguacucggggagcuucgugcagcaucccgagcugacuggucuggacuguauccgaccuugcuucuggguugaacucauuagaggcaggccaaaagagaauacaaucuggaccuccgggucaaguauaucuuuuuguggagugaacagcgauacugucggcugguccuggcccgacggugcagaguuaccguucacaaucgauaaguga

SEQ ID NO: 142072 - RNA, 1410 nt, Artificial Sequence; identical to SEQ ID NO: 138754
  derived and/or modified sequence opt3 from neuraminidase__InfluenzaA__ADO12326

SEQ ID NO: 142073 - RNA, 1410 nt, Artificial Sequence; identical to SEQ ID NO: 138754
  derived and/or modified sequence opt3 from neuraminidase__InfluenzaA__ADO12336

SEQ ID NO: 142074 - RNA, 1410 nt, Artificial Sequence; identical to SEQ ID NO: 138754
  derived and/or modified sequence opt3 from neuraminidase__InfluenzaA__ADO12346

SEQ ID NO: 142075 - RNA, 1410 nt, Artificial Sequence; identical to SEQ ID NO: 138754
  derived and/or modified sequence opt3 from neuraminidase__InfluenzaA__ADO12356

SEQ ID NO: 142076 - RNA, 1410 nt, Artificial Sequence; identical to SEQ ID NO: 138754
  derived and/or modified sequence opt3 from neuraminidase__InfluenzaA__ADO12366

SEQ ID NO: 142077 - RNA, 1410 nt, Artificial Sequence; identical to SEQ ID NO: 138754
  derived and/or modified sequence opt3 from neuraminidase__InfluenzaA__ADO12376

SEQ ID NO: 142078 - RNA, 1410 nt, Artificial Sequence; identical to SEQ ID NO: 138754
  derived and/or modified sequence opt3 from neuraminidase__InfluenzaA__ADO12386

SEQ ID NO: 142079 - RNA, 1410 nt, Artificial Sequence; identical to SEQ ID NO: 138754
  derived and/or modified sequence opt3 from neuraminidase__InfluenzaA__ADO12396

SEQ ID NO: 142080 - RNA, 1410 nt, Artificial Sequence; identical to SEQ ID NO: 138754
  derived and/or modified sequence opt3 from neuraminidase__InfluenzaA__ADO12406

SEQ ID NO: 142081 - RNA, 1410 nt, Artificial Sequence; identical to SEQ ID NO: 139521
  derived and/or modified sequence opt3 from neuraminidase__InfluenzaA__ADO12416

SEQ ID NO: 142082 - RNA, 1410 nt, Artificial Sequence; identical to SEQ ID NO: 138754
  derived and/or modified sequence opt3 from neuraminidase__InfluenzaA__ADO12426

SEQ ID NO: 142083 - RNA, 1410 nt, Artificial Sequence; identical to SEQ ID NO: 138754
  derived and/or modified sequence opt3 from neuraminidase__InfluenzaA__ADO12436

SEQ ID NO: 142084 - RNA, 1410 nt, Artificial Sequence; identical to SEQ ID NO: 138754
  derived and/or modified sequence opt3 from neuraminidase__InfluenzaA__ADO12446

SEQ ID NO: 142085 - RNA, 1410 nt, Artificial Sequence; identical to SEQ ID NO: 138754
  derived and/or modified sequence opt3 from neuraminidase__InfluenzaA__ADO12456

SEQ ID NO: 142086 - RNA, 1410 nt, Artificial Sequence; identical to SEQ ID NO: 138754
  derived and/or modified sequence opt3 from neuraminidase__InfluenzaA__ADO12466

SEQ ID NO: 142087 - RNA, 1410 nt, Artificial Sequence; identical to SEQ ID NO: 138754
  derived and/or modified sequence opt3 from neuraminidase__InfluenzaA__ADO12476

SEQ ID NO: 142088 - RNA, 1410 nt, Artificial Sequence; identical to SEQ ID NO: 138754
  derived and/or modified sequence opt3 from neuraminidase__InfluenzaA__ADO12486

SEQ ID NO: 142089 - RNA, 1410 nt, Artificial Sequence; identical to SEQ ID NO: 138754
  derived and/or modified sequence opt3 from neuraminidase__InfluenzaA__ADO12496

SEQ ID NO: 142090 - RNA, 1410 nt, Artificial Sequence; identical to SEQ ID NO: 138754
  derived and/or modified sequence opt3 from neuraminidase__InfluenzaA__ADO12506

SEQ ID NO: 142091 - RNA, 1410 nt, Artificial Sequence; identical to SEQ ID NO: 138754
  derived and/or modified sequence opt3 from neuraminidase__InfluenzaA__ADO12516

SEQ ID NO: 142092 - RNA, 1410 nt, Artificial Sequence; identical to SEQ ID NO: 138754
  derived and/or modified sequence opt3 from neuraminidase__InfluenzaA__ADO12526

SEQ ID NO: 142093 - RNA, 1410 nt, Artificial Sequence; identical to SEQ ID NO: 138754
  derived and/or modified sequence opt3 from neuraminidase__InfluenzaA__ADO12536

SEQ ID NO: 142094 - RNA, 1410 nt, Artificial Sequence; identical to SEQ ID NO: 138754
  derived and/or modified sequence opt3 from neuraminidase__InfluenzaA__ADO12546

SEQ ID NO: 142095 - RNA, 1410 nt, Artificial Sequence; identical to SEQ ID NO: 138754
  derived and/or modified sequence opt3 from neuraminidase__InfluenzaA__ADO12556

SEQ ID NO: 142096 - RNA, 1410 nt, Artificial Sequence; identical to SEQ ID NO: 138754
  derived and/or modified sequence opt3 from neuraminidase__InfluenzaA__ADO12566

SEQ ID NO: 142097 - RNA, 1410 nt, Artificial Sequence; identical to SEQ ID NO: 138754
  derived and/or modified sequence opt3 from neuraminidase__InfluenzaA__ADO12576

SEQ ID NO: 142098 - RNA, 1410 nt, Artificial Sequence
  derived and/or modified sequence opt3 from neuraminidase__InfluenzaA__ADO12586
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauuccggugcuguagcaguucugaaguauaacggcaucauaaccgacacgauuaagagcuggagaaauaacaucuugaggacucaagagucggagugugccugcgugaaugggucuuguuucaccgucaugacagauggaccauccgacggccaggcuucauacaaaaucuuucggauugaaaaggguaaaaucgugaagaguguggagaugaacgcccccaauuaucauuacgaagagugcagcuguuacccugauuccucugagauuacuugcgucugccgcgacaacuggcacgggagcaauagaccauggguuucauucaaccagaaucucgaauaucagauaggauacaucuguaguggcauuuuuggcgauaacccgaggcccaaugacaaaaccggguccugcggaccugugagcucuaacggugcgaauggcguaaagggguucucauuuaaguauggaaacggcguguggaucggucggacaaaaaguaucagcucccgcaacggguucgagaugauuugggauccaaauggcuggaccggaacggacaacaauuuuucuauaaagcaagacaucgucggcauuaacgaauggucgggguacagcggauccuucgugcagcaucccgagcugacuggucuggauuguauccgaccuugcuucuggguugaacucauuagaggcaggccaaaagagaauacaaucuggaccucagggaguucuauaucguuuuguggagugaacuccgacacugucggcuggucauggcccgauggugcagaguuaccguucacaaucgacaaguga

SEQ ID NO: 142099 - RNA, 1410 nt, Artificial Sequence; identical to SEQ ID NO: 142098
  derived and/or modified sequence opt3 from neuraminidase__InfluenzaA__ADO12596

SEQ ID NO: 142100 - RNA, 1410 nt, Artificial Sequence; identical to SEQ ID NO: 138754
  derived and/or modified sequence opt3 from neuraminidase__InfluenzaA__ADO12606

SEQ ID NO: 142101 - RNA, 1410 nt, Artificial Sequence; identical to SEQ ID NO: 138754
  derived and/or modified sequence opt3 from neuraminidase__InfluenzaA__ADO12616

SEQ ID NO: 142102 - RNA, 1410 nt, Artificial Sequence; identical to SEQ ID NO: 138754
  derived and/or modified sequence opt3 from neuraminidase__InfluenzaA__ADO12626

SEQ ID NO: 142103 - RNA, 1410 nt, Artificial Sequence; identical to SEQ ID NO: 138754
  derived and/or modified sequence opt3 from neuraminidase__InfluenzaA__ADO14355

SEQ ID NO: 142104 - RNA, 1401 nt, Artificial Sequence
  derived and/or modified sequence opt3 from neuraminidase__InfluenzaA__ADO21028
augaaccccaaucagaagaucauugccauaggcagcgugucccugaccaucgcuacaauuugcuuccucaugcaaaucgcaauucuugccacuacgaugacccugcacuuuaaacagaacgaguguucuaauccuucaaacaaucaggucguuccaugcgaaccgacaaucauagagagaaacaucgugcauuugaauaguacuaccauugaaaaggagaucugucccaaaguagcggaauacaagaacuggagcaaaccucagugccaaauuacaggguccgcuccauucucuaagggaaauucgaucagguuaucagccgguggcgacauaugggugacccgggagcccuaugucagcuguagucuggggaagugcuaccaguuugcacuaggacagggcacuacacucaaaaacaagcacuccaaugguaccacgcaugaucgcgugccucaccgaacucugcuuaugucugagcuggggguuccauuccauuugggaaccaaacagguguguauugccuggagcuccucaaguugccacgacggcaaggcuuggcuccacgucugugugacaggcgaugacaaaaacgcaacugccagcaucauuuaugaugggaugcugguagacucuaucggauccuggucaaagaauauccugcguacccaagaaagcgagugcguuuguauuaacgguacaugcaccguggucaugacggauggcagugcuucugggaaggccgacacuagaauacucuuuaucagggaaggaaaaauugugcauaucucccccuuaagcggcucggcgcagcacguggaggagugcucuuguuacccucgguauccagaaguccgcugcguuuguagagauaauuggaaggguuccaacaggccggugcuguacauaaacauggcagacuauucaauugagaguagcuacguaugcuccgggcuugugggagauacaccccggaaugacgauucuuacagcucaaguaacugucgcgacccuaauaacgaacgaggcgccccaggcgucaaagggugggcuuucgacaauggaaacgauaucuggauggguagaaccaucaaggaggacuccaggagcggcuaugaaacuuuucgggugguugggggauggacaaccgccaauucuaaaucacagauuaaccgucaggugaucgucgauagugacaauuggagcggcuacuccgguauuuucucuguggaggggaagaacugcauaaaucgcuguuuuuauguagaguugaucagaggcaggccccaagaaacgcggguuugguggaccucgaacagcauuaucguguucugcggaacauccggcacuuacgggaccggaucauggccugauggugcaaauaucaacuuuaugccaauuuga

SEQ ID NO: 142105 - RNA, 1401 nt, Artificial Sequence
  derived and/or modified sequence opt3 from neuraminidase__InfluenzaA__ADO21039
augaaccccaaucagaagaucauugccauaggcagcgugucccugaccaucgcuacaauuugcuuccucaugcaaaucgcaauucuugccacuacgaugacccugcacuuuaaacagaacgaguguucuaauccuucaaacaaucaggucguuccaugcgaaccgacaaucauagagagaaacaucgugcauuugaauaguacuaccauugaaaaggagaucugucccaaaguagcggaauacaagaacuggagcaaaccucagugccaaauuacaggguccgcuccauucucuaagggaaauucgaucagguuaucagccgguggcgacauaugggugacccgggagcccuaugucagcuguagucuggggaagugcuaccaguuugcacuaggacagggcacuacacucaaaaacaagcacuccaaugguaccacgcaugaucgcgacccucaccgaacucugcuuaugucugagcugggggugccauuccauuugggaaccaaacagguuuguauugccuggagcuccucaaguugccacgauggcaaggcuuggcuccacgugugugucacaggcgacgauaaaaacgcaacugccagcaucauuuaugacgggaugcugguggauucuaucggauccuggucaaagaauauccugcguacccaagaaagcgagugcguauguauuaacgguacaugcaccguugugaugacggacggcagugcuucugggaaggccgauacuagaauacucuuuaucagggaaggaaaaauuguccauaucucccccuuaagcggcucggcgcagcacguggaggagugcucuuguuacccucgguauccagaagugcgcugcgucuguagagacaauuggaaggguuccaacaggccgguucuguacauaaacauggcagauuauacaauugagucaaguuacgugugcagcgggcuuguaggagacacuccccggaaugaugacuccuacucuagcucaaacugucgcgacccuaauaacgaacgaggcgccccaggcgugaaagggugggcuuucgauaauggaaacgacaucuggauggguagaaccaucaaggaggauaguagguccggcuaugaaacauuucgggucguugggggauggaccacggccaauagcaaaucucagauuaaccgucaggugaucguggacucagauaauuggaguggcuacagcgguauuuucuccgucgaggggaagaacugcauaaaucgcuguuuuuauguggaguugaucagaggcaggccccaagaaacccggguaugguggacaucuaacucgauuaucguuuucugcggaacuagcggcaccuacgggacaggauccuggccugacggugcaaauaucaacuuuaugccaauuuga

SEQ ID NO: 142106 - RNA, 1401 nt, Artificial Sequence
  derived and/or modified sequence opt3 from neuraminidase__InfluenzaA__ADO21050
augaaccccaaucagaagaucauugccauaggcagcgugucccugaccaucgcuacaauuugcuuccucaugcaaaucgcaauucuugccacuacgaugacccugcacuuuaaacagaacgaguguucuaauccuucaaacaaucaggucguuccaugcgaaccgacaaucauagagagaaacaucgugcauuugaauaguacuaccauugaaaaggagaucugucccaaaguagcggaauacaagaacuggagcaaaccucagugccaaauuacaggguccgcuccauucucuaagggaaauucgaucagguuaucagccgguggcgacauaugggugacccgggagcccuaugucagcuguagucuggggaagugcuaccaguuugcacuaggacagggcacuacacucaaaaacaagcacuccaaugguaccacgcaugaucgcgggccucaccgaacucugcuuaugucugagcugggagugccauuccauuugggcaccaaacagguuuguauugccuggagcuccucaaguugccacgacggcaaggcuuggcuccacgugugugucacaggggaugacaaaaacgcaacugccagcaucauuuaugauggaaugcugguggacucuaucgguuccuggucaaagaauauccugcguacccaagaaagcgagugcguauguauuaacggcacaugcaccguugugaugacggaugggagugcuucuggaaaggccgacacuagaauacucuuuaucagggaaggcaaaauuguccauaucucccccuuaagcgguucggcgcagcacguggaggagugcucuuguuacccucgguauccagaagugcgcugcgucuguagagauaauuggaagggguccaacaggccgguucuguacauaaacauggcagacuauucaauugagaguagcuacgugugcuccggacuuguaggcgauacaccccggaaugacgauucuuacagcucaaguaacugucgcgacccuaauaacgaauccggcgccccaggggugaaaggaugggcuuucgacaaugguaacgauaucuggaugggccgaaccaucaaggaggacagcagaucuggguaugaaacuuuuagggucgugggaggcuggacaaccgccaauucaaaaagucagauuaaccggcagguuaucguggauagcgacaauugguccgguuacucugggauuuucucggucgagggcaagaacugcauaaaucguuguuuuuauguggaguugauccgcggaagaccccaagaaacgaggguaugguggaccagcaacuccauuaucguuuucugcggcacaucagggacuuacggaaccgguaguuggccugauggcgcaaauaucaacuuuaugccaauuuga

SEQ ID NO: 142107 - RNA, 1410 nt, Artificial Sequence
  derived and/or modified sequence opt3 from neuraminidase__InfluenzaA__ADO25095
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaaguauuaucacguacgaaaauaacaccugggucaaucagacauauguuaacauaagcaauacuaacuucgcugcaggccaguccgugguaucugugaaacuggccggaaauucgucauugugcccugucagcgggugggcgauuuacaguaaggacaacuccaucagaauuggcucuaaaggugauguguuuguuaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggugccaucucccuacaacucccguuuugaaucagucgccuggagcgcaagugccugccacgacggcaucaauuggcuuacaauugggaucucuggaccugauaacggugcuguggcaguacugaaguauaauggcauaauuaccgacacgaucaaguccuggagaaacaauaucuugaggacucaagagagcgagugugccugcguuaacgggucguguuucaccgugaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcuccggguucgagaugauaugggauccaaauggcuggaccggaacggacaacaauuuuucuaucaagcaagacauugugggcaucaacgaauggucgggguacagcggauccuucguccagcaucccgagcugacuggucuggauuguauucgaccuugcuucuggguggaacucaucagaggcaggccaaaagagaauacaauauggaccucagggaguucuaucagcuuuuguggaguuaacuccgacacugugggcuggucauggcccgauggugcagaguuaccguucacaauugacaaguga

SEQ ID NO: 142108 - RNA, 1410 nt, Artificial Sequence
  derived and/or modified sequence opt3 from neuraminidase__InfluenzaA__ADO25105
augaaccccaaucagaagaucauuaccauaggcagcgugugcaugacaaucgggauggccaaccugauucuccaaaucggaaauauuaucuccauauggaucucucacucaauucagcuugguaaccagaaucagaucggcacuuguaaccaaagugucauuacguacgagaccaauacauggguuaaccagacuuaugugaauaucagcaacaccaauuucgcugcagggcaguccguagugucugucaaacuggccggaaacucgucauugugcccugugagcggcugggcgauauacaguaaggacaauuccauuagaaucgguucuaaaggggauguuuuugugauuagggaaccauucaucagcuguuccccguuagagugccggacauuuuuccugacccagggagcucuacucaacgacaagcauucaaauggcacuaucaaagaucgcagucccuaucgaacacugaugagcuguccuauuggcgaagucccaucucccuacaacucccguuuugagucaguggccuggagcgcaagugccugccacgacgggauaaacuggcuuaccaucggaauuucugguccugauaauggcgcuguagcaguucugaaguauaacgggaucauaacggacacuauuaaguccuggagaaauaacaucuugaggacccaagaaagcgagugugccugcgugaauggaucguguuucacagucaugacugauggcccaucugaccggcaggcuuccuacaaaaucuuucgcauugagaaggguaaaaucgugaagucaguggaaaugaacgcccccaauuaucauuacgaggaaugcaguuguuacccugauagcuccgagauuaccugcgucugcagagacaacuggcacgggucuaauaggccauggguuagcuucaaccagaaucucgaguaucagauaggauacaucuguucaggcauuuuuggcgauaacccgcggcccaaugacaaaacagggaguugcggaccuguguccagcaacggugcgaauggcguaaagggguucucuuuuaaguauggaaacggcguguggaucggucgcaccaaaucaaucaguagccgaaacggguucgaaaugauuugggauccaaauggcuggacgggaacugacaacaauuuuuccauaaagcaagacaucgucggcauuaacgaguggucuggguacucggguagcuucgugcagcaucccgaacugacaggacuggauuguaucagaccuugcuucuggguugagcucauuaggggccggccaaaagaaaauaccaucuggacuuccgggucaaguauaucuuuuuguggagugaacagcgacacagucggcugguccuggcccgauggugcagaguuaccguucaccaucgacaaguga

SEQ ID NO: 142109 - RNA, 1410 nt, Artificial Sequence; identical to SEQ ID NO: 140535
  derived and/or modified sequence opt3 from neuraminidase__InfluenzaA__ADO25115

SEQ ID NO: 142110 - RNA, 1410 nt, Artificial Sequence; identical to SEQ ID NO: 140535
  derived and/or modified sequence opt3 from neuraminidase__InfluenzaA__ADO25125

SEQ ID NO: 142111 - RNA, 1410 nt, Artificial Sequence
  derived and/or modified sequence opt3 from neuraminidase__InfluenzaA__ADO25135
augaaccccaaucagaagaucauuaccauaggcagcgugugcaugacaaucgggauggccaaccugguccuccaaauuggaaauaucauuuccaucuggauaucucacucaauccagcuugguaaccagaaucagauugagacuuguaaccaaaguguuaucacguacgaaaauaacaccugggugaaucagacauauguaaacauuagcaauacuaacuucgcugcaggccaguccguggucucugugaaacuggccggaaauucgucauugugcccuguuagcggaugggcgaucuacaguaaggacaacuccauaagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucugacggccaggcuuccuacaaaaucuuucggaucgaaaaggguaaaauugugaagucagucgagaugaaugcccccaacuaucauuacgaagagugcaguuguuacccugauagcuccgagaucacuugcguuugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacaauaacuuuuccauuaagcaagacauagugggcaucaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcagaguuaccguucacaauagacaaguga

SEQ ID NO: 142112 - RNA, 1410 nt, Artificial Sequence; identical to SEQ ID NO: 140105
  derived and/or modified sequence opt3 from neuraminidase__InfluenzaA__ADO25145

SEQ ID NO: 142113 - RNA, 1410 nt, Artificial Sequence; identical to SEQ ID NO: 138754
  derived and/or modified sequence opt3 from neuraminidase__InfluenzaA__ADO25155

SEQ ID NO: 142114 - RNA, 1410 nt, Artificial Sequence; identical to SEQ ID NO: 138754
  derived and/or modified sequence opt3 from neuraminidase__InfluenzaA__ADO25165

SEQ ID NO: 142115 - RNA, 1410 nt, Artificial Sequence; identical to SEQ ID NO: 138754
  derived and/or modified sequence opt3 from neuraminidase__InfluenzaA__ADO25175

SEQ ID NO: 142116 - RNA, 1410 nt, Artificial Sequence
  derived and/or modified sequence opt3 from neuraminidase__InfluenzaA__ADO25185
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaugaguagccgcaauggguucgagaugaucugggauccaaacggcuggaccggaacggacaauaacuuuuccauuaagcaagacauagucggcaucaaugaauggucuggguacucggggagcuucgugcagcaucccgagcugacuggucuggauuguauucgaccuugcuucuggguugaacucaucagaggcaggccaaaagagaacacaauuuggaccuccgggucaaguaucucuuuuuguggagugaauagcgacacugucggcugguccuggcccgauggugcagaguuaccguucacaauagacaaguga

SEQ ID NO: 142117 - RNA, 1410 nt, Artificial Sequence; identical to SEQ ID NO: 141183
  derived and/or modified sequence opt3 from neuraminidase__InfluenzaA__ADO25195

SEQ ID NO: 142118 - RNA, 1410 nt, Artificial Sequence; identical to SEQ ID NO: 139891
  derived and/or modified sequence opt3 from neuraminidase__InfluenzaA__ADO25205

SEQ ID NO: 142119 - RNA, 1410 nt, Artificial Sequence; identical to SEQ ID NO: 140105
  derived and/or modified sequence opt3 from neuraminidase__InfluenzaA__ADO25215

SEQ ID NO: 142120 - RNA, 1410 nt, Artificial Sequence; identical to SEQ ID NO: 138754
  derived and/or modified sequence opt3 from neuraminidase__InfluenzaA__ADO25225

SEQ ID NO: 142121 - RNA, 1410 nt, Artificial Sequence; identical to SEQ ID NO: 140105
  derived and/or modified sequence opt3 from neuraminidase__InfluenzaA__ADO25235

SEQ ID NO: 142122 - RNA, 1410 nt, Artificial Sequence; identical to SEQ ID NO: 138754
  derived and/or modified sequence opt3 from neuraminidase__InfluenzaA__ADO25245

SEQ ID NO: 142123 - RNA, 1410 nt, Artificial Sequence; identical to SEQ ID NO: 138754
  derived and/or modified sequence opt3 from neuraminidase__InfluenzaA__ADO25255

SEQ ID NO: 142124 - RNA, 1410 nt, Artificial Sequence; identical to SEQ ID NO: 140535
  derived and/or modified sequence opt3 from neuraminidase__InfluenzaA__ADO25265

SEQ ID NO: 142125 - RNA, 1410 nt, Artificial Sequence; identical to SEQ ID NO: 140346
  derived and/or modified sequence opt3 from neuraminidase__InfluenzaA__ADO25275

SEQ ID NO: 142126 - RNA, 1410 nt, Artificial Sequence; identical to SEQ ID NO: 140105
  derived and/or modified sequence opt3 from neuraminidase__InfluenzaA__ADO25285

SEQ ID NO: 142127 - RNA, 1413 nt, Artificial Sequence
  derived and/or modified sequence opt3 from neuraminidase__InfluenzaA__ADO27623
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugugaacaucaauaacacuaauguugcagccggggaagacaaaaccucggugacacuugcgggaaacucaagccuguguaguauuuccggcugggcuaucuacaccaaggauaauucuaucaggauugguagcaaaggggacguauucgugauacgggagccuuuuaucuccugcucacacuuggaaugucgcacuuucuuuuuaacacaaggagcccugcuaaacgauaagcauaguaauggcaccgucaaagaccgaagcccauaucgugcacucaugucuugcccgcugggcgaggcccccuccccuuacaacucaaaguucgaaagcguggcuuggagugcaucugccugucacgaugggaugggauggcuuacgauugguaucuccggcccagacaacggggcuguugccgugcugaaguauaauggaauaauuacuggcaccaucaaaagcuggaagaaacagaucuugagaacacaggagucggagugcgucuguaugaacgguucuugcuuuacuauuaugaccgaugggcccuccaauaaggcggcaucauacaaaaucuucaagauugaaaagggaaaagugacaaagaguauagagcucaacgccccuaauuuuuauuacgaagaguguagcugcuacccagacaccggcaucguaauguguguuugcagggauaacuggcauggcuccaaucggcccugggugucuuucaaccagaaucuggacuaucaaauuggguacaucugcagcggagucuuuggugauaacccucgcccagaggacggcgaagggucauguaauccggugacgguggauggagcuaacggcgucaaagguuucaguuauaaguacgggaauggcguuuggaucggaagaacuaaauccaacaggcugcggaagggcuuugagaugauuugggaccccaauggguggacaaacaccgacagcgauuucucugugaaacaggacguaguggccauaacugauuggucaggauauagugguagcuuuguccagcacccugaacucacaggcuuagacugcauccgcccauguuucuggguggagcugguucgagggcuucccagagaaaacaccacgauuuggaccuccggaucuucgaucagcuucugcggcgucaauuccgauacagcaaacuggucauggccugacggugcugaguugccauuuacuauugauaaguga

SEQ ID NO: 142128 - RNA, 1410 nt, Artificial Sequence; identical to SEQ ID NO: 138754
  derived and/or modified sequence opt3 from neuraminidase__InfluenzaA__ADO30410

SEQ ID NO: 142129 - RNA, 1410 nt, Artificial Sequence; identical to SEQ ID NO: 140105
  derived and/or modified sequence opt3 from neuraminidase__InfluenzaA__ADO30420

SEQ ID NO: 142130 - RNA, 1410 nt, Artificial Sequence; identical to SEQ ID NO: 139462
  derived and/or modified sequence opt3 from neuraminidase__InfluenzaA__ADP95343

SEQ ID NO: 142131 - RNA, 1410 nt, Artificial Sequence; identical to SEQ ID NO: 138744
  derived and/or modified sequence opt3 from neuraminidase__InfluenzaA__ADP95353

SEQ ID NO: 142132 - RNA, 1410 nt, Artificial Sequence; identical to SEQ ID NO: 138744
  derived and/or modified sequence opt3 from neuraminidase__InfluenzaA__ADP95363

SEQ ID NO: 142133 - RNA, 1410 nt, Artificial Sequence; identical to SEQ ID NO: 138744
  derived and/or modified sequence opt3 from neuraminidase__InfluenzaA__ADP95373

SEQ ID NO: 142134 - RNA, 1410 nt, Artificial Sequence; identical to SEQ ID NO: 138744
  derived and/or modified sequence opt3 from neuraminidase__InfluenzaA__ADP95383

SEQ ID NO: 142135 - RNA, 1410 nt, Artificial Sequence; identical to SEQ ID NO: 138744
  derived and/or modified sequence opt3 from neuraminidase__InfluenzaA__ADP95393

SEQ ID NO: 142136 - RNA, 1410 nt, Artificial Sequence
  derived and/or modified sequence opt3 from neuraminidase__InfluenzaA__ADQ43774
augaaccccaaucagaagaucauuaccauaggcagcgggugcaugacaaucggaauggccaaccugauucuccaaaucgguaauauuaucuccauauggaucucucacucaauucagcuuggcaaccagaaucagaucgagacuuguaaccaaagugugauuacguacgaaaauaacaccugggucaaucagacauauguuaacaucagcaauacuaacuucgcugcagggcaguccgugguaucugugaaacuggccggaaauucgucauugugcccugucagcggcugggcgauauacaguaaggacaacuccauuagaaucgguucuaaaggggauguguuuguuauuagggagccauucaucagcuguuccccguuagaaugccggaccuuuuuccugacacagggagcucuacucaaugacaagcauucaaacggcaccaucaaagaucgcagucccuaucgaacucugaugagcuguccuauuggcgaggugccaucucccuacaacucccguuuugaaucagucgccuggagcgcaagugccugccacgacgggauaaauuggcuuacaaucggaauuucugguccugauaacggcgcuguggcaguacugaaguauaaugggaucauaaccgacacgauuaaguccuggagaaacaauaucuugaggacucaagagagcgagugugccugcguuaacggaucguguuucaccgugaugacagauggcccaucugacggucaggcuuccuacaaaaucuuucggauugaaaaggggaaaaucgucaagucaguggagaugaaagcccccaauuaucauuacgaagagugcaguuguuacccugauagcuccgagauuacuugcgugugccgcgacaacuggcacggaucuaauagaccaugggucagcuucaaccagaaucucgaauaucagauaggcuacaucuguucaggcauuuuuggggauaacccgaggcccaaugacaagaccggaaguugcgguccuguuuccagcaacggcgcgaauggggugaagggauucucuuuuaaauauggcaacgguguauggaucgggcggacaaagucaaucaguagccgcaacggcuucgagaugauuugggauccaaauggauggaccggcacggacaacaauuuuuccauaaaacaagacaucguggggauuaacgaauggucuggauacucggguagcuucguccagcaucccgagcugacuggccuggauuguauccgaccuugcuucuggguggaacucauuagagggaggccaaaggagaauacaaucuggaccuccggaucaaguauaucuuuuuguggcguuaacagcgacacuguggguugguccuggcccgauggggcagaguuaccguucacaaucgacaaauga

SEQ ID NO: 142137 - RNA, 1410 nt, Artificial Sequence
  derived and/or modified sequence opt3 from neuraminidase__InfluenzaA__ADQ92578
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuauacugugugaaccgacuaucauugagagaaauaucaccgaaauuguguauuugacaaacgcuaccaucgagaaggaaauaugccccaaauuagcagaguacaggaauuggaguaagccucagugugacauuacuggguucgccccauuuagcaaagauaacuccauccggcugucugcgggaggugacauuuggguaacacgcgagcccuaugugucgugcgauccugacaaguguuaccaauucgcucuaggccaggggaccacgcucaauaacguccauucaaauaacacugugcgagaucguaccccauauagaacacugcuuaugaaugaacugggaguucccuuucacuugggcacuaaacaggugugcaucgccuggagcaguuccucuugucaugacgguaaggcauggcuccacgucugcaucaccggggaugacaagaacgccacagcuagcuucauuuacaauggaaggcugguggauuccguaguuucauggaguaaagagauacugcggacccaggaaagcgagugugugugcaucaacggcacguguacugucgugaugacagacggcucugcauccgggaaggccgauaccaaaauucucuuuaucgaggaaggaaagauagugcauacuucaacauuaagcgguagugcucaacacgucgaggaaugcucuugcuauccucgcuacccaggcguuagaugugugugcagggacaacuggaagggguccaaucggccgauuguagauaucaacaucaaagaccacagcauugugucgucuuacgucuguuccggacuggugggcgacacccccaggaagaaugauucaaguagcuccucucauugccuugacccuaacaaugaggaaggugggcacggaguuaaaggcugggccuucgaugacggcaacgauguguggauggggcgaacgaucagcgagaagucaagauugggauaugagaccuuuaaagucauugaagguuggaguaauccaaaguccaaacugcagauaaaccgccaggugaucguagaccggggcaaucguagcggguacucuggaauuuucucaguugagggcaagaguuguaucaaccgcugcuuuuauguggaacuaaucagagguaggaaggaggaaacagagguccucuggacuagcaauuccauuguggucuucugugggaccucuggcacauacggaacuggcucguggcccgauggggcggacauaaaccugaugccuaucuga

SEQ ID NO: 142138 - RNA, 1410 nt, Artificial Sequence; identical to SEQ ID NO: 138615
  derived and/or modified sequence opt3 from neuraminidase__InfluenzaA__ADR32364

SEQ ID NO: 142139 - RNA, 1410 nt, Artificial Sequence
  derived and/or modified sequence opt3 from neuraminidase__InfluenzaA__ADT64478
augaaccccaaucagaagaucauuaccauaggcagcgugugcaugacaaucgggauggccaaccugauucuccaaaucggaaauauuaucuccauauggaucggucacucuauucagcuuggcaaccagaaucagaucgagacuuguaaccaaucagucauuacguacgaaaauaacaccuggguuaaucagacauaugugaacaucaguaauacuaacuucgcugcagggcagagcguaguguccgucaaacuggccggaaauucuucguugugcccugugucaggcugggcgauauacagcaaggacaacaguguuagaauugguuccaaaggggauguguuugucaucagggagccauucauuucuuguagcccguuagaaugccggaccuuuuuccugacacagggagcucuacucaaugacaagcauuccaacggcaccaucaaagaucgcucacccuaucgaacucugaugaguuguccuaucggcgaggugccaagccccuacaacucucguuuugaauccguagccuggucagcaagcgccugccacgacgggauuaauuggcuuacaauaggaaucagugguccugauaacggcgcuguugcagugcugaaguauaaugggauuaucaccgacacgauaaagucuuggagaaacaauauuuugaggacucaagaguccgagugugccugcgucaacggaagcuguuucaccgugaugacagauggcccaucgaauggucaggcuucuuacaaaaucuuucggaucgaaaaggggaaaauugugaaguccgucgagaugaacgcccccaauuaucauuacgaagagugcucauguuacccugacaguagcgagaucacuugcguuugccgcgauaacuggcacggauccaauagaccaugggugucuuucaaccagaaucucgaauaucagauuggcuacauauguagcggcaucuuuggggacaacccgaggcccaaugauaaaaccggaucaugcgguccuguaaguuccaacggcgcgaacggggugaagggauucagcuuuaaguauggcaauggugucuggauugggcggacaaaaucuaucucaagucgcaacggcuucgagaugaucugggacccaaauggauggaccggcacggauaacaauuuuagcauuaagcaagacauaguggggaucaacgaaugguccggauacucugguucguucguucagcaucccgagcugacuggccuggacuguauucgaccuugcuucuggguggaacucaucagagggaggccaaaagagaauacaauuuggaccagcggauccucaaucaguuuuuguggcgucaacucugauacuguggguuggagcuggcccgacggggcagaguuaccguucacaauagauaaguga

SEQ ID NO: 142140 - RNA, 1410 nt, Artificial Sequence
  derived and/or modified sequence opt3 from neuraminidase__InfluenzaA__ADT78889
augaaccccaaucagaagaucauuaccauaggcagcgugucccugacaaucgccacugucugcuuccucaugcaaauugcuauccuuguuacgaccgugacacugcacuuuaaacagcaugagugugacucuccugcaucaaaccagguaaugccaugcgaaccgauuaucauagagagaaauaucacugaaauuguguacuugaacaauaccacaaucgagaaggaaauuugucccaaagucguggaguauaggaacuggaguaagccucagugccaaaucaccggguucgccccauuuagcaaagauaauuccauacgguuaucugcgggaggugacauuuggguuacucgcgagcccuacgugucgugugauccuggcaagugcuaucaguucgcucuggggcagggaacaacccuagacaacaagcacucaaaugauacgauccaugaccgaauaccacaccguacucuccugaugaacgaacuuggcguccccuuucaucuggguaccagacagguguguguagccuggagcaguuccucuugccacgaugggaaagcaugguugcacguuugugugacaggagacgauaagaaugccacugcuagcuucaucuacgacggcaggcucgucgauuccaucggcucauggagucaaaacauucugcggacccaggagagcgaaugcguguguauaaaugggacaugcaccguggucaugacggacggaucugcauccggucgcgccgauacuagaauccuguuuauugaggagggcaaaaucguucauauaucaccucucagcgggagugcucagcacguggaagagugcucuuguuauccaagguacccggacguacggugcauuugucgcgacaacuggaagggauccaaucgacccgugaucgauaucaacauggaagacuauagcauugauucgucuuacgucugcuccggcuuagugggugacacaccuagaaacgaugacaggucaaguaauagcaacugucgggauccaaauaacgagcgugggaaucccggaguuaaaggcugggccuucgacaacggcgaugacguguggauggggcgcaccaucuccaaggaucugagaucuggauacgaaacuuuuaaggucauugguggcuggagcacaccuaauucaaaaagucagauaaacaggcaagugaucguagacuccaauaacuggagcggguauucuggaauuuucucaguugagggcaagaguugcaucaaucgguguuuuuacguggagcuuauccgaggucgccagcaggaaaccagagucugguggacgagcaacuccauuguggucuucugcgggaccucuggcacauauggaacuggcucguggccagacggggcgaauauuagcuuuaugcccaucuga

SEQ ID NO: 142141 - RNA, 1410 nt, Artificial Sequence
  derived and/or modified sequence opt3 from neuraminidase__InfluenzaA__ADT78899
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgagguggucgaguauaggaacuggaguaaaccucagugccaaaucaccggguucgcgccauuuagcaaggauaauuccauacgguuaucugcuggaggugacauuugggugaugcgcgaacccuacguuucguguaacccuggcaaaugcuaucaguucgcccuggggcagggaacuacacuagauaauaagcacucaaacggcaccauccaugaccguauuccacaccgaacgcuccugaugaaugagcuuggugugcccuuucaucuggggacuaagcaggucuguguggcauggagcaguuccucuugccacgauggaaaagccugguugcacguauguguuaccggcgacgauagaaacgcuacagccagcuucaucuacgacggcaggcucguggauuccaucgggucauggagucaaaauauucugcggacucaggaaagcgagugcgucuguauaaacggaaccugcacaguggugaugaccgacgguucugcauccggccgcgcugauacgagaauccuguuuauuaaggaggggaaaaucguccauauaucaccucucagcggaagugcccagcacauugaagagugcucuuguuauccaagguacccggacguucggugcaucugucgcgauaauuggaagggcuccaaccgacccgugaucgacauuaacauggaagacuauagcaucgauucgucuuacguaugcuccgguuuagugggggacacuccuagaaaugaugacucaaguagcaacuccaauuguagggauccaaacaaugagcggggaaaccccggcgucaaaggcugggcguucgacaauggggaugacguguggaugggacguacaauuucuaaggaucugcgcagcgguuacgaaaccuuuaagguuauaggcggguggucaacuccuaacaguaaaucccaggugaauagacaagucaucguggacaacaauaacuggagcggauauucuggcauuuucucaguagaggguaagaguugcaucaauagguguuuuuacguugagcuuauccgggggcgaccacaggaaacacgcgugugguggaccagcuccucuauugucguguucugcggcacgucgggaaccuauggcacagggagcuggcccgauggagcaaacauaaauuuuaugccgaucuga

SEQ ID NO: 142142 - RNA, 1410 nt, Artificial Sequence
  derived and/or modified sequence opt3 from neuraminidase__InfluenzaA__ADT78963
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgagguggucgaguauaggaacuggaguaaaccucagugccaaaucaccggguucgcgccauuuagcaaggauaauuccauacgguuaucugcuggaggugacauuugggugacucgcgaacccuacguuucgugugauccuggcaaaugcuaucaguucgcccuggggcagggaacaacccuagacaacaagcacucaaaugauacgauccaugaccguauuccacaccgaacucuccugaugaacgagcuuggcgugcccuuucaucuggguaccagacaggucuguguggcauggagcaguuccucuugccacgaugggaaggccugguugcacguauguguuacaggagacgauaggaaugcuacugccagcuucaucuacgacggccggcucguggauuccaucggcucauggagucaaaacauucugcgcacccaggaaagcgagugcgucuguauaaaugggacaugcaccguggugaugacggacggaucugcauccgguagagcugauacuaggauccuguuuauuaaagagggcaagaucguccauauaucaccucucagcgggagugcccagcacguugaagagugcucuuguuauccacgguacccggacgugcgcugcauuugucgagacaacuggaaaggauccaauagacccguaaucgauaucaacauggaagacuauagcauugauucgucuuacgugugcuccggcuuagucggugacacaccuaggaacgaugaccggucaaguaauagcaacugucgugauccaaauaacgagcgcgggaaucccggagugaagggcugggcguucgacaacggcaaugauguuuggauggggagaaccaucuccaaagaccugaggucuggauacgaaacuuuuaaggugauugguggcuggagcacaccuaacucaaagagucaggucaaucggcaagugauaguagauaacaauaacugguccggguauagcggaaucuucucuguugagggcaaaucaugcauuaaucgauguuuuuacguggagcuuauccgcgguagacagcaggaaaccagggucugguggacgaguaacagcaucguggucuucugcgggaccuccggcacauauggaacuggcucuuggccagacggggcaaauauuaacuuuaugcccauauga

SEQ ID NO: 142143 - RNA, 1410 nt, Artificial Sequence
  derived and/or modified sequence opt3 from neuraminidase__InfluenzaA__ADT79001
augaaccccaaucagaagaucauuaccauaggcagcaucucccugacaauugccacuaucugcuuccucaugcaaauugcuauccuugugacgaccgucacacugcacuuuaaacaguacgagugugacucuccugcaaacaaucagguuaugccaugcgaaccgauaaucauugagagaaacaucacugaaauuguguauuugaccaauacaaccaucgagaaggaaauaugucccaaauuaguagaguacaggaacuggucaaagccucagugcaaaauuacuggguucgccccauuuaguaaggauaauagcauccggcuguccgcgggaggugacauuugggugacacgcgagcccuaugucucuugugauccuggcaagugcuaccaauucgcucuagggcagggaaccacgcucgacaacaaacauucgaaugauacuauccacgaccgaaucccacaucguacccugcuuaugaacgaacugggcgugcccuuucacuuggguacaagacagguuuguauugccuggucaagcaguuccugccaugaugggaaggcauggcuccacgugugugucacuggagacgauaaaaaugccaccgcuucuuucauauaugacggcaggcugguggauagcaucggcuccuggucacagaacauucugcggacacaagagagugaaugcguauguaucaaugggaccugcacgguugugaugacugacggaagcgcaucugguaaggccgauacacgcauacucuuuauugaggagggcaaaaucguccacaucuccccuuuaucagggagcgcucagcauguggaagagugcaguuguuacccaagauauccgggagugaggugcauuugucgggacaacuggaagggcucuaaucgccccgucguugacaucaacgugaaggauuacuccauugacagcucguacguaugcucuggucuggugggggauaccccucgaaacaaugacagauccucaaguagcuauuguaggaacccaaauaacgaacggggaaaucacggcgucaaaggcugggccuucgaugacgggaacgauguguggaugggacguacuauauccaaggacucucgcagcgguuacgagacauuuaaaguuaucggcggguggucaacccccaauaguaagucccagauuaacagacaggugaucgucgauagcgacaauaggucuggauauucaggcaucuucaguguggaagguaaaagcugcauuaaccgguguuuuuacguagagcuuauacgagggcgcgagcaagaaacgagaguuugguggaccuccaauucuaucguggucuucugcggcacaucgggaacuuauggcaccgggagcuggccugauggagcggacauuaacuugaugccaaucuga

SEQ ID NO: 142144 - RNA, 1410 nt, Artificial Sequence; identical to SEQ ID NO: 136134
  derived and/or modified sequence opt3 from neuraminidase__InfluenzaA__ADT79021

SEQ ID NO: 142145 - RNA, 1410 nt, Artificial Sequence
  derived and/or modified sequence opt3 from neuraminidase__InfluenzaA__ADT79041
augaaccccaaucagaagaucauuaccauaggcagcgugucccugacaaucgccacugucugcuuccucaugcaaauugcuauccuuguuacgaccgugacacugcacuuuagacaguacgagugugacucuccugcaaacaaucagguaaugccaugcgaaccgauuaucauagagaggaacaucacugaaauuguguauuugaauaacaccacaaucgagaaagaaauuugucccaaguuagucgaguaccggaauuggucaaaaccucagugcaagaucaccggguucgccccauuuaguaaagauaacagcauacgccuguccgcgggaggugacauuugggugacucgagagcccuauguuucuugugauccuggcaagugcuaccaauucgcucuagggcagggaacaacccucgacaauaagcauucgaacgauacgauccacgaccguauuccacauagaacucugcuuaugaaugaacugggcgugcccuuucacuuggguaccaggcaggucuguaucgccuggucaagcaguuccugccaugaugggaaagcauggcuccacguguguguaacaggagacgauaagaacgccacugcuucuuucaucuaugacggccggcugguugauagcauuggcuccuggucacagaauauacugcgcacccaagagagugaaugcguguguaucaacgggacaugcaccgucgugaugacggacggaagcgcaucugguagagccgauacuaaaauucucuuuaucgaggagggcaagauagugcacauuuccccuuuaucagggagcgcucagcaugucgaagagugcaguuguuacccaagguauccgggaguucggugcaucugucgcgacaauuggaaaggcucuaaccgacccgugguagacaucaacguggaagauuacuccauugacagcucguacgucugcucuggucuggugggggauacaccuagaaauaacgacagguccucaaauaguaacugucggaauccaaacaaugagcguggaaaccacggcguuaagggcugggccuucgaugacgggaaugauguguggaugggacgcaccaucagcaaggaccuuagauccgguuaugaaacuuuuaaagucauuggcggguggucuacacccaacagcaagucacagauaaauaggcaagugaucguagauagugacaaccgguccggauacagcggcauuuucucuguugaggguaaaucaugcaucaaucgauguuuuuauguggaguugauccgcgggagagaacaggagaccagggucugguggacgaguaacagcauuguggucuucugcggcaccuccggaacauacggcacugggucuuggccugauggagcggacauaaaucugaugccaaucuga

SEQ ID NO: 142146 - RNA, 1410 nt, Artificial Sequence; identical to SEQ ID NO: 137776
  derived and/or modified sequence opt3 from neuraminidase__InfluenzaA__ADT79121

SEQ ID NO: 142147 - RNA, 1410 nt, Artificial Sequence
  derived and/or modified sequence opt3 from neuraminidase__InfluenzaA__ADT79131
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgagguggucgaguauaggaacuggaguaaaccucagugccaaaucaccggguucgcgccauuuagcaaggauaauuccauacgguuaucugcuggaggugacauuugggugacucgcgaacccuacguuucgugugauccuggcaaaugcuaucaguucgcccuggggcagggaacaacccuagacaacaagcacucaaauggcacgauccaugaucguauuccacaccgaacucuccugaugaacgagcuuggugugcccuuucaucuggggaccaagcaggucuguguggcauggagcaguuccucuugccacgacggaaaagccugguugcacguauguguuacaggcgaugacagaaaugcuacugccagcuucaucuacgauggcaggcucgaagacuccaucgggucauggagucaaaacauucugcggacccaggagagcgagugcguguguauaaauggaacaugcaccgucgugaugacggaugguucugcauccggccgcgcugacacuagaauccuguuuauuaaggaagggaaaaucgugcauauaucaccucucagcggaagugcccagcacauugaggaaugcucuuguuauccaagguacccggauguccggugcaucugucgcgacaacuggaagggcuccaaucgacccguuuuagacaucagcauggaggauuauucgauugacucuuccuacgugugcucaggucugguaggggauacaccuagaaacgacgauaguagcuccaacucuaauuguagggacccaaacaaugaacggggaaaccccggcgugaaaggcugggcguucgauaauggggacgaugucuggaugggacguaccaucagcaaggaccuucgcucagguuacgagacuuuuaaggugauuggcggguggaguacaccuaacuccaaaagccagguuaauagacaagugauagucgauaacaauaacuggucuggauauucaggcaucuucaguguggaggguaagagcugcauuaauagguguuuuuacguagaauugauccgggggcgaucccaggagacccgcguuugguggacgucuaacucgaucguggucuucugcggcaccagcggaacauauggcacuggguccuggccagacggagcaaauauuaacuuuaugcccauauga

SEQ ID NO: 142148 - RNA, 1410 nt, Artificial Sequence; identical to SEQ ID NO: 138754
  derived and/or modified sequence opt3 from neuraminidase__InfluenzaA__ADT79234

SEQ ID NO: 142149 - RNA, 1410 nt, Artificial Sequence; identical to SEQ ID NO: 138744
  derived and/or modified sequence opt3 from neuraminidase__InfluenzaA__ADT79244

SEQ ID NO: 142150 - RNA, 1410 nt, Artificial Sequence
  derived and/or modified sequence opt3 from neuraminidase__InfluenzaA__ADU25480
augaaccccaaucagaagaucauuauaaucagcuccauuugccugaucaacggcauuaccucucucauccuucaaauagggaauaucauuucaaucuggauuagucacagcauccagauaggaaaccagaaucagacagagacuuguucccaaaacauuaucacguacgaaaauaacaccugggugaaucagacauaugucaacauuucuaauaacaauuucguugccgagcaggcugugguaucgaugaaacuggcagguucaagcccuuugugcccagugaguggcugggccaucuacuccaaggacaacucugucagaaucgggagcaaaggagauguguuuguuauuagggaaccguucauauccuguucacauuuagagugccggaccuuuuuccugacucagggcgcgcuacucaaugacaagcacaguaacgguacaaucaaagaucgcagccccuaucgaacccugaugucuuguccuauuggggaagugccaucccccuacaacucacguuuugagagcgucgcuuggagugccucugcaugccaugacggaacuuccuggcuuacaaucggcauaagcggcccugauaauggggccguggcuguacugaaguauaacgacauuaucaccgauacgaucaagucguggagaaauaacauuuugaggacucaagagucugaauguguuugcgugaauggauccuguuucaccgucaugacagacgguccaucaaacggccaggcaaguuacaaaaucuuuaagauugagaaagggaagguggugaaaagcgucgaacucaaugcccccaacuaucacuacgaggagugcuccuguuacccugauucuggagaaauaaucugcguuugccgggacaauuggcauggcagcaaccgcccaugggugucauucaaucagaaccuggaguaucagauugguuacaucuguagugggauccugggagauaauccgagacccaacgacaggacuggcuccugcggcccuguaagccucaauggggcuaacggagugaaggguuuuucuuucaaguauggcaacggggucuggauuggacggaccaaaucaaguagcucccgcucuggcuuugaaaugauaugggauccaaaugguuggacagagaccgacaacaauuucuuagugaagcaagacaucguugggaugacggauuggucgggcuacagcggauccuuugugcagcaccccgaacugacuggcaugaacuguaugcgaccuugcuucugggucgagcuuauuagagggaggccaaaagagaauacaaucuggaccucaggaaguucuauuagcuucuguggugugaacuccgacacuguagauuggucauggcccgacggcgccgaauugccguuuacaaucgauaaguga

SEQ ID NO: 142151 - RNA, 1410 nt, Artificial Sequence; identical to SEQ ID NO: 138754
  derived and/or modified sequence opt3 from neuraminidase__InfluenzaA__ADU59780

SEQ ID NO: 142152 - RNA, 1410 nt, Artificial Sequence
  derived and/or modified sequence opt3 from neuraminidase__InfluenzaA__ADU59789
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacguaagcaauacuaacuucgcugcaggccaguccguggucucugugaaacuggccggaaauucgucauugugcccuguuagcggaugggcgaucuacaguaaggacaacuccauaagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucugacggccaggcuuccuacaaaaucuuucggaucgaaaaggguaaaauugugaagucagucgagaugaaugcccccaacuaucauuacgaagagugcaguuguuacccugauagcuccgagaucacuugcguuugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacaauaacuuuuccauuaagcaagacauagugggcaucaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcagaguuaccguucacaauagacaaguga

SEQ ID NO: 142153 - RNA, 1410 nt, Artificial Sequence; identical to SEQ ID NO: 138754
  derived and/or modified sequence opt3 from neuraminidase__InfluenzaA__ADU59829

SEQ ID NO: 142154 - RNA, 1410 nt, Artificial Sequence
  derived and/or modified sequence opt3 from neuraminidase__InfluenzaA__ADU59838
augaaccccaaucagaagaucauuauaaucggcagcgugugcaugaccauugggauggccaaccugauccuccaaauuggaaauaucauauccaucuggauuucucacucaauccagcuugguaaccagaaucagauugagacauguaaccaaagugucaucacuuacgaaaauaacacguggguuaaucagaccuaugugaacauaagcaauacaaacuucgcugcaggccaguccguagugucugucaaacuggccggaaauucgucauugugcccugugagcggaugggcgauuuacaguaaggacaacuccaucagaauuggcucuaaaggugauguuuuugugaucagggagccauucaucagcuguuccccguuagaaugccggaccuuuuuccugacucagggggcucuacucaaugacaagcauucaaacggaacaauuaaagaucgcagucccuaucgaacccugaugagcuguccuauaggcgaggucccaucucccuacaacucccguuuugaaucaguggccuggagcgcaagugccugccacgacggcaucaauuggcuuacuauugggaucucuggaccugauaacggugcuguagcaguucugaaguauaauggcauaauuacagacaccaucaaguccuggagaaacaauaucuugaggacgcaagagagcgagugugccugcgugaacgggucguguuucacugucaugaccgauggaccaucugacggccaggcuuccuacaaaauuuuucggaucgaaaaggguaaaauugugaagucaguggagaugaaugcccccaacuaucauuucgaagagugcaguuguuacccugauagcuccgagauaacaugcgucugccgcgacaauuggcacgggucuaacagaccauggguuagcuuuaaucagaaccucgaauaccagaucggauauauuuguucaggcaucuucggcgauaauccgaggcccaacgacaaaacugggaguugcggaccuguguccagcaauggugcgaacggcguaaagggguuuucuuucaaguacggaaacggcguguggaucggucggaccaaaucaauuaguagccgcaauggguuugagaugauaugggauccaaacggcuggacaggaaccgacaauaacuucuccaucaagcaagacauugucggcaucaaugaauggucuggguauucggggagcuucgugcagcaucccgagcugacgggucuggauuguauucgaccuugcuuuuggguugaacucaucagaggcaggccaaaagagaacacuauauggacauccgggucaaguaucucuuucuguggagugaauagcgacaccgucgauugguccuggcccgacggcgcagaguuaccguuuacuauugauaaguga

SEQ ID NO: 142155 - RNA, 1410 nt, Artificial Sequence; identical to SEQ ID NO: 140105
  derived and/or modified sequence opt3 from neuraminidase__InfluenzaA__ADU59847

SEQ ID NO: 142156 - RNA, 1410 nt, Artificial Sequence; identical to SEQ ID NO: 138754
  derived and/or modified sequence opt3 from neuraminidase__InfluenzaA__ADU59907

SEQ ID NO: 142157 - RNA, 1410 nt, Artificial Sequence; identical to SEQ ID NO: 138754
  derived and/or modified sequence opt3 from neuraminidase__InfluenzaA__ADU59917

SEQ ID NO: 142158 - RNA, 1410 nt, Artificial Sequence; identical to SEQ ID NO: 138754
  derived and/or modified sequence opt3 from neuraminidase__InfluenzaA__ADU59920

SEQ ID NO: 142159 - RNA, 1410 nt, Artificial Sequence; identical to SEQ ID NO: 138754
  derived and/or modified sequence opt3 from neuraminidase__InfluenzaA__ADU59941

SEQ ID NO: 142160 - RNA, 1410 nt, Artificial Sequence
  derived and/or modified sequence opt3 from neuraminidase__InfluenzaA__ADU76311
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcaaaguuaccguucacaaucgacaaauga

SEQ ID NO: 142161 - RNA, 1410 nt, Artificial Sequence
  derived and/or modified sequence opt3 from neuraminidase__InfluenzaA__ADU76313
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuauuacuacgaagagugcaguuguuauccugauagcuccgagauuacuugcgucugccgcgacaauuggcaugggucuaacagaccauggguuagcuucaaucagaaccucgaauaccagauaggauauaucuguucaggcauuuuuggcgauaauccgaggcccaacgacaaaaccgggaguugcggaccuguguccagcaauggugcgaacggcguaaagggguucucuuuuaaguacggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguauucggggagcuucgugcagcaccccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcaaaguuaccguucacaaucgacaaauga

SEQ ID NO: 142162 - RNA, 1410 nt, Artificial Sequence; identical to SEQ ID NO: 142161
  derived and/or modified sequence opt3 from neuraminidase__InfluenzaA__ADU76314

SEQ ID NO: 142163 - RNA, 1410 nt, Artificial Sequence; identical to SEQ ID NO: 142161
  derived and/or modified sequence opt3 from neuraminidase__InfluenzaA__ADU76315

SEQ ID NO: 142164 - RNA, 1410 nt, Artificial Sequence; identical to SEQ ID NO: 142161
  derived and/or modified sequence opt3 from neuraminidase__InfluenzaA__ADU76316

SEQ ID NO: 142165 - RNA, 1410 nt, Artificial Sequence
  derived and/or modified sequence opt3 from neuraminidase__InfluenzaA__ADU76317
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaccaguagccgcaauggguucgagaugaucugggauccaaacggcuggacgggaacugacaauaacuuuuccauuaagcaagacauagucggcaucaaugaauggucuggguacucggggagcuucgugcagcaucccgagcugacaggucuggauuguauucgaccuugcuucuggguugaacucaucagaggcaggccaaaagagaacaccauuuggacuuccgggucaaguaucucuuuuuguggagugaauagcgacacagucggcugguccuggcccgauggugcagaguuaccguucaccauagacaaguga

SEQ ID NO: 142166 - RNA, 1410 nt, Artificial Sequence
  derived and/or modified sequence opt3 from neuraminidase__InfluenzaA__ADU76318
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucauaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaggacaucgucggcauuaaugaauggucuggguacucggggagcuucgugcaacaccccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucacaaucgacaaguga

SEQ ID NO: 142167 - RNA, 1410 nt, Artificial Sequence; identical to SEQ ID NO: 139997
  derived and/or modified sequence opt3 from neuraminidase__InfluenzaA__ADU76319

SEQ ID NO: 142168 - RNA, 1410 nt, Artificial Sequence; identical to SEQ ID NO: 138754
  derived and/or modified sequence opt3 from neuraminidase__InfluenzaA__ADU76320

SEQ ID NO: 142169 - RNA, 1410 nt, Artificial Sequence; identical to SEQ ID NO: 138754
  derived and/or modified sequence opt3 from neuraminidase__InfluenzaA__ADU76321

SEQ ID NO: 142170 - RNA, 1410 nt, Artificial Sequence
  derived and/or modified sequence opt3 from neuraminidase__InfluenzaA__ADU76322
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaguggugaagucagucgagaugaaugcccccaacuaucauuacgaagagugcaguuguuacccugauagcuccgagaucacuugcguuugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacaauaacuuuuccauuaagcaagacauagugggcaucaaugaauggucuggguacucggggagcuucguucagcaucccgagcugacuggucuggauuguauucgaccuugcuucuggguggaacucaucagaggcaggccaaaagagaacacaauuuggaccuccgggucaaucauaaguuuuuguggagucaauucugacacugugggcuggagcuggcccgauggugcagaguuaccguucacaaucgacaaguga

SEQ ID NO: 142171 - RNA, 1410 nt, Artificial Sequence; identical to SEQ ID NO: 142160
  derived and/or modified sequence opt3 from neuraminidase__InfluenzaA__ADU76323

SEQ ID NO: 142172 - RNA, 1410 nt, Artificial Sequence; identical to SEQ ID NO: 142161
  derived and/or modified sequence opt3 from neuraminidase__InfluenzaA__ADU76324

SEQ ID NO: 142173 - RNA, 1410 nt, Artificial Sequence; identical to SEQ ID NO: 142160
  derived and/or modified sequence opt3 from neuraminidase__InfluenzaA__ADU76325

SEQ ID NO: 142174 - RNA, 1410 nt, Artificial Sequence; identical to SEQ ID NO: 142161
  derived and/or modified sequence opt3 from neuraminidase__InfluenzaA__ADU76326

SEQ ID NO: 142175 - RNA, 1410 nt, Artificial Sequence; identical to SEQ ID NO: 142161
  derived and/or modified sequence opt3 from neuraminidase__InfluenzaA__ADU76327

SEQ ID NO: 142176 - RNA, 1410 nt, Artificial Sequence; identical to SEQ ID NO: 142160
  derived and/or modified sequence opt3 from neuraminidase__InfluenzaA__ADU76328

SEQ ID NO: 142177 - RNA, 1410 nt, Artificial Sequence; identical to SEQ ID NO: 142161
  derived and/or modified sequence opt3 from neuraminidase__InfluenzaA__ADU76329

SEQ ID NO: 142178 - RNA, 1410 nt, Artificial Sequence; identical to SEQ ID NO: 142161
  derived and/or modified sequence opt3 from neuraminidase__InfluenzaA__ADU76330

SEQ ID NO: 142179 - RNA, 1410 nt, Artificial Sequence; identical to SEQ ID NO: 142161
  derived and/or modified sequence opt3 from neuraminidase__InfluenzaA__ADU76331

SEQ ID NO: 142180 - RNA, 1410 nt, Artificial Sequence; identical to SEQ ID NO: 142161
  derived and/or modified sequence opt3 from neuraminidase__InfluenzaA__ADU76332

SEQ ID NO: 142181 - RNA, 1410 nt, Artificial Sequence; identical to SEQ ID NO: 138754
  derived and/or modified sequence opt3 from neuraminidase__InfluenzaA__ADU76333

SEQ ID NO: 142182 - RNA, 1410 nt, Artificial Sequence; identical to SEQ ID NO: 138754
  derived and/or modified sequence opt3 from neuraminidase__InfluenzaA__ADU76334

SEQ ID NO: 142183 - RNA, 1410 nt, Artificial Sequence; identical to SEQ ID NO: 138754
  derived and/or modified sequence opt3 from neuraminidase__InfluenzaA__ADU76335

SEQ ID NO: 142184 - RNA, 1410 nt, Artificial Sequence; identical to SEQ ID NO: 142161
  derived and/or modified sequence opt3 from neuraminidase__InfluenzaA__ADU76336

SEQ ID NO: 142185 - RNA, 1410 nt, Artificial Sequence; identical to SEQ ID NO: 139521
  derived and/or modified sequence opt3 from neuraminidase__InfluenzaA__ADU76337

SEQ ID NO: 142186 - RNA, 1410 nt, Artificial Sequence; identical to SEQ ID NO: 140656
  derived and/or modified sequence opt3 from neuraminidase__InfluenzaA__ADU76338

SEQ ID NO: 142187 - RNA, 1410 nt, Artificial Sequence; identical to SEQ ID NO: 142160
  derived and/or modified sequence opt3 from neuraminidase__InfluenzaA__ADU76339

SEQ ID NO: 142188 - RNA, 1410 nt, Artificial Sequence; identical to SEQ ID NO: 138754
  derived and/or modified sequence opt3 from neuraminidase__InfluenzaA__ADU76341

SEQ ID NO: 142189 - RNA, 1410 nt, Artificial Sequence; identical to SEQ ID NO: 138754
  derived and/or modified sequence opt3 from neuraminidase__InfluenzaA__ADU76342

SEQ ID NO: 142190 - RNA, 1410 nt, Artificial Sequence; identical to SEQ ID NO: 138754
  derived and/or modified sequence opt3 from neuraminidase__InfluenzaA__ADU76343

SEQ ID NO: 142191 - RNA, 1410 nt, Artificial Sequence; identical to SEQ ID NO: 142161
  derived and/or modified sequence opt3 from neuraminidase__InfluenzaA__ADU76344

SEQ ID NO: 142192 - RNA, 1410 nt, Artificial Sequence; identical to SEQ ID NO: 142161
  derived and/or modified sequence opt3 from neuraminidase__InfluenzaA__ADU76345

SEQ ID NO: 142193 - RNA, 1410 nt, Artificial Sequence
  derived and/or modified sequence opt3 from neuraminidase__InfluenzaA__ADU76346
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccgaaacggacaauaacuuuuccauaaagcaagacaucgucggaauuaaugaguggucuggcuacucggggagcuucgugcagcaucccgaacugacuggacuggauuguauccgaccuugcuucuggguugagcucauuagagguaggccaaaagagaacacaaucuggaccuccggcucaaguauaucuuuuuguggggugaauagcgacacugucggaugguccuggcccgauggcgcagaauuaccguucacaaucgacaaguga

SEQ ID NO: 142194 - RNA, 1410 nt, Artificial Sequence; identical to SEQ ID NO: 139521
  derived and/or modified sequence opt3 from neuraminidase__InfluenzaA__ADU76347

SEQ ID NO: 142195 - RNA, 1410 nt, Artificial Sequence
  derived and/or modified sequence opt3 from neuraminidase__InfluenzaA__ADV17285
augaaccccaaucaggagaucauuaccauaggcagcgugugcaugacaaucgggauggccaaccugauucuccaaaucggaaauauuaucuccauauggaucucucacucaauucagcuugguaaccagaaucagaucgaaacuuguaaccaaagugucauuacguacgagaauaacaccuggguuaaucagacauaugugaacaucagcaauacuaacuucgcugcaggccaguccguagugucugucaagcuggccggaaauucgucauugugcccugugagcggaugggcgauauacaguaaagacaacuccauuagaaucggcucuaagggugauguuuuugugauuagggaaccauucaucagcuguuccccguuagagugccggaccuuuuuccugacacagggggcucuacucaaugacaaacauucaaacggaaccaucaaggaucgcagucccuaucgaacucugaugagcuguccuauuggcgaagucccaucucccuacaacucccguuuugagucaguggccuggagcgcaagugccugccacgacggcauaaauuggcuuacaaucgggauuucuggaccugauaacggugcuguagcaguucugaaauauaauggcaucauaaccgacacgauuaaguccuggagaaacaauaucuugaggacucaagagagcgaaugugccugcgugaacgggucguguuucaccgucaugacagauggaccaucugacggccaggcuuccuacaagaucuuucggauugagaaagguaagaucgugaaaucaguggaaaugaaugcccccaacuaucauuacgaggagugcaguuguuacccugauagcuccgaaauuacuugcgucugccgcgacaauuggcacgggucuaacagaccauggguuagcuucaaucagaaccucgaguaucagauaggauacaucuguucaggcauuuuuggcgauaauccgaggcccaacgacaagaccgggaguugcggaccuguguccagcaauggugcgaacggcguaaaaggguucucuuuucgguauggaaacggcguguggaucggucgcacaaagucaaucaguagccgaaauggguucgaaaugauuugggauccaaacggcuggaccggaacggacaauaacuuuuccauaaagcaagacaucgucggcauuaaugaguggucuggguacucggggagcuucgugcagcaucccgaacugacuggucuggauuguaucagaccuugcuucuggguugagcucauuaggggccggccaaaagagaacacaaucuggaccuccgggucaaguauaucuuuuuguggagugaauagcgacacugucggcugguccuggcccgauggugcagaauuaccguucacaaucgacaaguga

SEQ ID NO: 142196 - RNA, 1410 nt, Artificial Sequence; identical to SEQ ID NO: 138754
  derived and/or modified sequence opt3 from neuraminidase__InfluenzaA__ADV17295

SEQ ID NO: 142197 - RNA, 1410 nt, Artificial Sequence
  derived and/or modified sequence opt3 from neuraminidase__InfluenzaA__ADV17305
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccucauuagaaugccggaccuuuuuccugacacagggggcucuacucaaugacaagcauaguaacggaaccaucaaagaucgcagcccguaucgaacucugaugucuugucccauuggcgaggucccuuccccauacaacucacguuuugaaagcguggccuggagugcaucugccugccacgacggcauaaauuggcuuacaaucgggauuuccggaagcgauaacggugcuguagcaguucugaaguauaauggcaucauaaccgacacgauuaagucguggagaaacaauaucuugaggacucaagagucugagugugccugcgugaacggguccuguuucaccaucaugacagauggacccucagacggccaggcuaguuacaaaauuuuucggaucgaaaaggguaaaauugucaagagcguggagaugaaugccccuaacuaucauuacgaagagugcuccuguuacccagauucuagcgagauaacuugcgugugccgcgacaauuggcacgggucaaacagacccugggucaguuucaaucagaaccucgaauaucagaucggauacauuuguuccggcaucuuuggcgauaauccuaggccaaacgacaaaaccgggagcugcggaccgguuucuucaaauggugcgaacggcgugaagggguucaguuuuaaguauggaaacggcguauggaucggucggacaaaaagcauuuccucucgcaauggguucgagaugauaugggaucccaacggcuggaccggaacggacaauaacuuuucgaucaagcaagacauugugggcaucaaugaauggagcggguacuccggaucauucguccagcauccugagcugacuggucuggauuguauucgaccaugcuucuggguggaacucaucagaggcaggcccaaagagaacacaauauggaccagugggucuagcaucuccuuuuguggaguuaauucagacacugugggcuggagcuggccugauggugcagaguuaccauucacaauugacaaguga

SEQ ID NO: 142198 - RNA, 1410 nt, Artificial Sequence; identical to SEQ ID NO: 138754
  derived and/or modified sequence opt3 from neuraminidase__InfluenzaA__ADV17315

SEQ ID NO: 142199 - RNA, 1410 nt, Artificial Sequence; identical to SEQ ID NO: 140185
  derived and/or modified sequence opt3 from neuraminidase__InfluenzaA__ADV17325

SEQ ID NO: 142200 - RNA, 1410 nt, Artificial Sequence
  derived and/or modified sequence opt3 from neuraminidase__InfluenzaA__ADV17335
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcguguuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacaauaacuuuuccauuaagcaagacauagugggcaucaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcagagugcccguucacaauagacaaguga

SEQ ID NO: 142201 - RNA, 1410 nt, Artificial Sequence; identical to SEQ ID NO: 138754
  derived and/or modified sequence opt3 from neuraminidase__InfluenzaA__ADV19022

SEQ ID NO: 142202 - RNA, 1410 nt, Artificial Sequence
  derived and/or modified sequence opt3 from neuraminidase__InfluenzaA__ADV41679
augaaccccaaucagaagaucauuaccauaggcagcgugugcaugacaaucgggauggccaaccugauucuccaaaucggaaauauuaucuccauauggaucucucacucaauucagcuuagaaaccagaaucagaucgagacuuguaaccaaagugucauuacguacgaaaauaacaccuggguuaaucagacauaugugaacaucagcaauacuaacuucgcugcaggucaguccguagugucugucaaacuggccggcaauucgucauugugcccugugagcgggugggcgauauacaguaaggacaacuccauuaggaucggaucuaaaggcgauguuuuugugauucgggagccauucaucagcuguuccccguuagaaugccgcaccuuuuuccugacacagggugcucuacucaaugacaagcauucaaacgggaccaucaaagaucgaagucccuaucguacucugaugagcuguccuauuggagaggucccaucucccuacaacuccagauuugaaucaguggccuggagcgcaagugccugccacgacggcauaaauuggcuuacaaucggcauuucugggccugauaacggagcuguagcaguucugaaguauaaugguaucauaaccgacacgauuaaguccuggaggaacaauaucuugcggacucaagagagcgagugugccugcgugaacggcucguguuucaccgucaugacagaugggccaucugacggacaggcuuccuacaaaaucuuucgcauugaaaagggcaaaaucgugaagucaguggagaugaaugcccccaacuaucauuacgaagagugcaguuguuacccugauagcuccgagauuacuugcgucugcagagacaauuggcacgguucuaacaggccauggguuagcuucaaucagaaccucgaauaucagauaggguacaucuguucaggaauuuuuggcgauaauccgcggcccaacgacaaaaccggcaguugcgggccuguguccagcaauggagcgaacgguguaaagggcuucucuuuuaaguaugggaacggaguguggaucggccgcacaaaaucaaucaguagccgaaaugguuucgagaugauuugggauccaaacggguggaccggcacggacaauaacuuuuccauaaagcaagacaucgucggaauuaaugaauggucuggcuacucggggagcuucgugcagcaucccgagcugacuggacuggauuguaucagaccuugcuucuggguugaacucauuaggggucggccaaaagagaacacaaucuggaccuccggcucaaguauaucuuuuuguggggugaauagcgacacugucggaugguccuggcccgauggcgcagaguuaccguucacaaucgacaaguga

SEQ ID NO: 142203 - RNA, 1410 nt, Artificial Sequence
  derived and/or modified sequence opt3 from neuraminidase__InfluenzaA__ADV76582
augaaccccaaucagaagaucauuaccauaggcagcgugucccugacaaucucuacugucugcuucuuuaugcaaauugccauccucauuacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaauuagcugaguacaggaauuggaguaagccucagugugacaucacaggguucgcaccauuuagcaaagauaacuccauacggcugucugccggaggugacauuugggugacccgcgagcccuaugucucgugcgauccugacaaguguuaccaauucgcgcuaggccaggggacgacucucaauaacgugcauucaaauaacaccguucgagaucguacaccauauagaacucugcuuaugaaugaacugggagugcccuuucacuugggcaccaagcaggucugcaucgcuuggagcaguuccucuugucaugacgguaaagccuggcuccacgugugcauuacaggggaugacaagaacgcaaccgccagcuucaucuacaauggaaggcugguagauuccguugugucauggaguaaagagauccugcggacgcaggaaagcgagugugucugcauuaacggcacuuguacaguggugaugaccgacggcucugcuuccgggaaggcagauacuaaaauacucuuuaucgaggaaggaaagauuguccauacaucaaccuuaagcgguagugcccaacacguugaggaaugcucuugcuauccucgcuacccaggcgugagauguguaugcagggacaacuggaagggguccaaucggccgaucguggauauaaacauuaaagaccacagcaucgucucgucuuacguguguuccggacugguuggcgacacgccccgcaagaaugauucaaguagcuccucucauugccuugacccuaacaaugaggaaggugggcacggagugaaaggcugggcuuucgaugacggcaacgaugucuggauggggcgaaccaucaaugagacaagcagauugggauaugagacuuuuaaggugauugaagguuggucaaacccaaaaaguaagcugcagaucaauaggcagguaauuguugacaaaggcaaccgguccggguacagcggaauauucucuguggagggcaagucauguaucaaucguugcuuuuaugucgaacuaauucgcgguagaaaggaggaaaccgaggugcucuggacaaguaacagcaucgucguguucugugggacuuccggcaccuacggaacaggcucuuggcccgauggggccgaccugaaucuuaugccuaucuga

SEQ ID NO: 142204 - RNA, 1410 nt, Artificial Sequence; identical to SEQ ID NO: 138615
  derived and/or modified sequence opt3 from neuraminidase__InfluenzaA__ADV76590

SEQ ID NO: 142205 - RNA, 1410 nt, Artificial Sequence; identical to SEQ ID NO: 138615
  derived and/or modified sequence opt3 from neuraminidase__InfluenzaA__ADV76601

SEQ ID NO: 142206 - RNA, 1410 nt, Artificial Sequence; identical to SEQ ID NO: 139608
  derived and/or modified sequence opt3 from neuraminidase__InfluenzaA__ADV76612

SEQ ID NO: 142207 - RNA, 1410 nt, Artificial Sequence; identical to SEQ ID NO: 138615
  derived and/or modified sequence opt3 from neuraminidase__InfluenzaA__ADV76623

SEQ ID NO: 142208 - RNA, 1410 nt, Artificial Sequence; identical to SEQ ID NO: 138615
  derived and/or modified sequence opt3 from neuraminidase__InfluenzaA__ADV76634

SEQ ID NO: 142209 - RNA, 1410 nt, Artificial Sequence; identical to SEQ ID NO: 141482
  derived and/or modified sequence opt3 from neuraminidase__InfluenzaA__ADV76645

SEQ ID NO: 142210 - RNA, 1410 nt, Artificial Sequence
  derived and/or modified sequence opt3 from neuraminidase__InfluenzaA__ADV76667
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugaaauuguguauuugaacaauaccacaaucgagaaggaaauuugucccaaagucguggaguacaggaacuggaguaagccucagugccaaaucaccggguucgccccauuuagcaaagauaauuccauacgguuaucugcgggaggugacauuuggguuacucgcgagcccuaugugucgugugaucauggcaagugcuaccaguucgcucuggggcagggaacaacccuagacaacaagcacucaaaugauacgauccaugaccguauuccucaccgaacucuccugaugaacgaacuuggcgucccauuucaucuggguaccagacagguguguaucgccuggagcaguuccucuugccacgaugggaaagcaugguugcacguauguaucacaggagacgauaagaaugccacugcuagcuucauuuaugacggcaggcucguugauuccauaggcucauggagucaaaacauccugcggacccaggagagcgaaugcguguguauuaaugggacaugcaccgucgugaugacggacggaucugcauccggucgcgccgauacuagaauccuguuuauagaggagggcaaaauugugcauaucucaccccucagcgggagugcucagcacgucgaagagugcucuuguuacccuagguauccaggaguucggugcaucugucgcgacaacuggaagggcuccaaucgaccggugguagacauuaacauggaagauuacagcaucgacucgucuuacgugugcuccgguuuagucggggauacacccagaaacgacgauaggucaaguaauagcaaaucccggaacccuaauaacgagcguggaaaucagggcgugaagggcugggccuucgacaacggggaugacguuuggaugggacgcaccauuucuagagaucugaggagcgguuaugaaacuuuuaaggugauaggcggguggucaacaccaaauaguaaaucccaaaucaaccggcaggucauuguggacagcgauaaucgaucuggauacucaggcaucuucaguguagaggguaagagcuguaucaaccgcugcuuuuauguugagcuuauuagagggaggaaacaggaaacccgggugugguggacguccaauucuauagucguguucuguggcaccucgggaacauacggcacugggagcuggcccgacggagcgaacaucaauuuuaugccuauuuga

SEQ ID NO: 142211 - RNA, 1410 nt, Artificial Sequence; identical to SEQ ID NO: 141484
  derived and/or modified sequence opt3 from neuraminidase__InfluenzaA__ADV76676

SEQ ID NO: 142212 - RNA, 1410 nt, Artificial Sequence; identical to SEQ ID NO: 140625
  derived and/or modified sequence opt3 from neuraminidase__InfluenzaA__ADV76697

SEQ ID NO: 142213 - RNA, 1410 nt, Artificial Sequence
  derived and/or modified sequence opt3 from neuraminidase__InfluenzaA__ADV76708
augaaccccaaucagaagaucauuaccauaggcagcgugucccugacaaucucuacuauuugcuucuuuaugcagacggccauccucauuaccacagucacucuucacuucaaacagugugaguuuaacucaccuccaaauaaccagguuaugcugugcgaaccgaccaucauagagagaaauaucacagaaauuguguacuugaccaacaucacuauugagaaggaaaucugucccaaauuagcugaguauaggaauuggaguaagccucagugcgacauaacaggguucgcaccauuuagcaaagauaacuccauucggcugucugccggaggugacaucuggguaacccgcgagcccuacgugucgugugauccugacaagugcuaucaauucgcgcuaggccaggggacgacucucaauaacguccauucaaauaacaccgugcgagaucguacaccauacagaacucugcuuaugaaugaacugggaguucccuuucacuugggcaccaaacagguguguauugcuuggagcaguuccucuugccaugacgguaaggccuggcuccacgucuguaucacaggggaugacaagaacgcaaccgccagcuucaucuauaauggaaggcugguggauuccguaguuucauggaguaaagagauucugcggacgcaggaaagcgagugcguguguauaaacggcacuugcacagucgugaugaccgacggcucugcuuccgggaaggcagauacuaaaauccucuuuauugaggaaggaaagaucgugcauacaucaaccuuaagcgguagugcccaacacgucgaggaaugcucuuguuacccucgcuauccaggcguuagaugcguguguagggacaacuggaagggguccaaucggccgauaguagauauuaacaucaaagaccacagcaucgugucgucuuacgucugcuccggacuggugggcgacacgccccgcaagaaugauucaaguagcuccucucauugucuugacccuaacaaugaggaaggugggcacggaguuaaaggcugggcuuucgaugacggcaacgauguguggauggggcgaaccauuagcgagaagucaagauugggauacgagacauuuaaagucaucgaagguuggaguaauccaaaguccaaacugcagauuaacaggcaagugauaguagaccggggcaaucguagcggguauucuggaaucuucucaguugagggcaagaguugcauuaaccgcuguuuuuacguggaacuaaucagagguaggaaggaggaaacugagguccucuggaccagcaauuccaucguggucuucugcgggacaucuggcacuuauggaaccggcucguggcccgauggggccgacauuaaccugaugccuauauga

SEQ ID NO: 142214 - RNA, 1410 nt, Artificial Sequence
  derived and/or modified sequence opt3 from neuraminidase__InfluenzaA__ADV76719
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagaagaauauuaccgaaaucguguauuugacaaacaccacuauugagaaagaaaucugccccaaguuagcugaguacagaaauuggaguaaaccucagugugacauaacaggguucgcaccauuuagcaaggauaacuccauuaggcugucugccggaggugacaucuggguaacccgggagcccuaugugucgugcgauccugacaaguguuaccaauucgcgcuaggccaggggacgacucucaauaacguccauucaaauaacaccgugcgcgaucgaacaccauaucguacucugcuuaugaaugaacugggaguucccuuucacuugggcaccaaacaggugugcauugcuuggagcaguuccucuugucaugacgguaaggccuggcuccacgucugcaucacaggggaugacaaaaacgcaaccgccagcuucaucuacaauggaagacugguggauuccguaguuucauggaguaaggagauucugaggacgcaggaaagcgagugugugugcauaaacggcacuuguacagucgugaugaccgacggcucugcuuccgggaaagcagauacuaagauccucuuuauugaggaaggaaagaucgugcauacaucaaccuuaagcgguagugcccaacacgucgaggaaugcucuugcuauccucgguacccaggcguucgcugugugugcagagacaacuggaaaggguccaauaggccgauaguagauauuaacaucaaggaccacagcaucgugucgucuuacgucuguuccggacuggugggcgacacgccccggaaaaaugauucaaguagcuccucucauugccuugacccuaacaaugaggaaggugggcacggaguuaagggcugggcuuucgaugacggcaacgauguguggauggggcgcaccauuagcgagaaaucacgauugggauaugagacauuuaaggucaucgaagguuggaguaauccaaaauccaagcugcagaugaacagacaggugauuguagacaggggcaaucggagcggguacucuggaauauucucaguugagggcaagaguuguaucaaccguugcuuuuauguggaacuaauucgcgguagaaaagaggaaacugagguccucuggaccagcaauuccaucguggucuucugugggacaucuggcacuuacggaaccggcucguggcccgauggggccgacaucaaccugaugccuauuuga

SEQ ID NO: 142215 - RNA, 1410 nt, Artificial Sequence
  derived and/or modified sequence opt3 from neuraminidase__InfluenzaA__ADV76730
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagacgcugcggacucaggaaagcgagugugugugcauuaacggcacauguaccgucgugaugacugacggcucugcuuccgggaaggcagauacaaaaauacucuuuaucgaggaaggaaagauugugcauaccucaacguuaagcgguagugcccaacacgucgaggaaugcucuugcuauccucgcuacccaggcguuagaugugugugcagggacaacuggaagggguccaaucggccgaucguagauauaaacauuaaagaccacagcaucgugucgucuuacgucuguuccggacuggugggcgacacccccaggaaggaugacucaaguagcuccucucauugccuugauccuaauaacgaggaaggugggcacggaguuaaaggcugggcuuucgacgauggcaaugacguguggauggggcgaacaaucagcgagaagucaagauugggauaugagacuuuuaaagucauugaagguuggaguaacccaaaguccaaacugcagaucaaucgccaggugauuguagaucggggcaaccguagcggguacucuggaauauucucaguugagggcaagaguuguaucaaucgcugcuuuuauguggaacuaauuagagguaggaaggaggaaaccgagguccucuggacaagcaacuccaucguggucuucugugggacuucuggcaccuacggaacaggcucguggcccgacggggccgauaucaaucugaugccuauuuga

SEQ ID NO: 142216 - RNA, 1410 nt, Artificial Sequence
  derived and/or modified sequence opt3 from neuraminidase__InfluenzaA__ADV78132
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggcugaaccagacauauguuaauaucuccaacacuaauuucgcugcaggccagucugugguaucggugaaauuggccgggaacucaucauuaugcccugucaguggaugggcgauauacuccaaggacaauucuauuagaaucggcagcaaaggugauguguuuguuauuagggagccauucaucuccuguucaccgagugaaugccggaccuuuuuccugacacagggggcucuacucaacgacaagcauagcaauggaaccaucaaagaucgcucucccuaucgaacucugauguccuguccuauuggcgaggugccaucacccuacaacagccguuuugaaagugucgccuggucugcauccgccugccacgacggcauaaacuggcuuacaaucgggauuagcggaccugauaauggugcuguggcaguacugaaguauaacggcaucauaaccgacacgauuaagucguggagaaauaacaucuugaggacucaagagucugagugugccugcguuaauggguccuguuucaccaucaugacagauggaccaucagacggccaggcuaguuacaaaauuuuucggaucgaaaaggguaaaauugucaagagcguggggaugaacgcccccaauuaucauuacgaggaaugcuccuguuacccugauucuagcgagauaacuugcgugugccgcgacaacuggcacggaucaaauagaccaugggugaguuucaaccagaaucucgaguaucagaucggcuacauuuguuccggcaucuuuggggauaacccgaggcccaaugacaaaaccggaagcugcgguccugucucuucaaacggcgcgaaugggguuaagggauucaguuuuaaguauggcaacgguguguggaucgggcggacaaaaagcauuuccucucgcaagggcuucgaaaugauaugggauccaaacggauggaccggcacggacaauaacuuuucgaucaaacaagacauuguagggaucaaugaguggagcggauacuccgguucauucgugcagcaucccgaacugacuggccuggauuguauucgaccuugcuucugggucgagcucaucagagggaggccaaaggaaaacacaauaugggcaaguggaucuagcaucuccuuuuguggcgugaauagcgacaccguugguuggagcuggcccgauggggccgaguuaccguucauuaucgacaaauga

SEQ ID NO: 142217 - RNA, 1413 nt, Artificial Sequence
  derived and/or modified sequence opt3 from neuraminidase__InfluenzaA__ADW09104
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccaauaacaaggccgcguccuacaaaaucuucaagauugaaaagggaaaaguaacaaagucaauagagcucaaugcaccuaacuuuuauuacgaagaguguaguugcuacccagacaccggcaucguuaugugugugugcagggauaauuggcauggcagcaaccggcccugggucuccuucaaucagaaccuggacuaucaaauuggguacaucugcucuggaguguuuggugauaauccucgcccagaggacggcgaagggagcuguaacccggugacggucgauggagccaauggcguuaaagguuucucauauaaguacgggaacggcguguggaucggaagaacuaaaaguaauaggcugcggaagggcuuugagaugauuugggaccccaacggguggacaaacaccgacuccgauuucagcguaaaacaggacguggucgcuauaacugauuggucuggauauucagguaguuuugugcagcacccugaacucacaggcuuagacugcauccgcccauguuucuggguugagcuggugcgagggcuucccagagaaaauaccacgauuuggaccagcggauccucuaucucguucugcggcgucaacagcgauacagccaauugguccuggccugacggugcagaguugccauuuacuauugauaaguga

SEQ ID NO: 142218 - RNA, 1413 nt, Artificial Sequence; identical to SEQ ID NO: 139477
  derived and/or modified sequence opt3 from neuraminidase__InfluenzaA__ADW09114

SEQ ID NO: 142219 - RNA, 1413 nt, Artificial Sequence
  derived and/or modified sequence opt3 from neuraminidase__InfluenzaA__ADW09123
augaaccccaaucagaagaucauuaccauaggcagcaucuccauugccaucgggauuacaucucugaugcuccaaaucggaaacauaaucucaauuugggcuagucacagcauccagacugguucccagaauaacacgggcauuugcaaucagagaaucauaaccuacgagaacucuacaugggugaaucauacuuaugucaacauuaauaacaccaauguuguggcaggggaagacaaaacaucgguaacccuugccggaaacucaagccuguguaguaucuccggcugggcgauuuacacuaaggauaauucuaucaggaucgguagcaaaggggacguguucgucauucgggagccuuuuauauccugcucacacuuggaaugucgcacauucuuuuuaacccaaggagcucugcuaaacgauaagcauaguaauggcacggugaaagaccgaagcccauaucgugcccucaugucuugcccgcugggcgaggcacccuccccuuacaacucaaaguucgaaagcguugccuggagugcuucugcaugucacgaugggaugggauggcuuacuaucgguauuuccggcccagacaacggggccguggcuguccugaaguauaauggaaucauaaccggcacaauuaaaagcuggaagaaacagaucuugagaacucaggagucggagugcguguguaugaacgguucuugcuuuaccaucaugacagaugggcccuccaauaaggccgcgucauacaaaauuuucaagaucgaaaagggaaaaguaaccaagaguauugagcucaacgcaccuaauuuuuauuacgaagaguguagcugcuacccagacacgggcauaguuaugugugugugcagggauaacuggcauggcuccaaucggcccugggucucuuucaaccagaaucuggacuaucaaaucggguacauuugcagcggaguguuuggugauaacccucgcccagaggacggcgaagggucauguaauccggugacugucgauggagccgacggcguuaaagguuucaguuauaaguacgggaacggcguguggaucggaagaacaaaauccaauaggcugcggaagggcuuugagaugaucugggaccccaacggguggaccaauacugauagcgacuucucuguaaaacaggauguggucgcuauuacagacuggucaggauauagugguagcuuugugcagcacccugaacucaccggcuuagauugcauacgcccauguuucuggguugagcuggugcgagggcuucccagagaaaacacgaccaucuggacauccggaucuucgauuagcuucugcggcgucaacuccgacacugccaauuggucauggccugauggugcagaguugccauuuaccaucgacaaguga

SEQ ID NO: 142220 - RNA, 1413 nt, Artificial Sequence
  derived and/or modified sequence opt3 from neuraminidase__InfluenzaA__ADW09156
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucgauggagccgacggcguuaaagguuucaguuauaaguacgggaacggcguguggaucggaagaacuaaauccaauaggcugcggaagggcuuugagaugauuugggaccccaacggguggacaaauaccgauagcgacuucucuguaaaacaggauguggucgcuauaacugacuggucaggauauagugguagcuuugugcagcacccugaacucacaggcuuagauugcauccgcccauguuucuggguugagcuggugcgagggcuucccagagaaaacaccacgauuuggaccuccggaucuucgaucagcuucugcggcgucaacuccgacacagccaauuggucauggccugauggugcagaguugccauuuacuauugacaaguga

SEQ ID NO: 142221 - RNA, 1413 nt, Artificial Sequence
  derived and/or modified sequence opt3 from neuraminidase__InfluenzaA__ADW09167
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucaacggagccgauggcguuaaagguuucaguuauaaguacgggaauggcguguggaucggaagaacuaaauccaacaggcugcggaagggcuuugagaugauuugggaccccaauggguggacaaacaccgacagcgauuucucuguaaaacaggacguggucgcuauaacugauuggucaggauauagugguagcuuugugcagcacccugaacucacaggcuuagacugcauccgcccauguuucuggguugagcuggugcgagggcuucccagagaaaacaccacgauuuggaccuccggaucuucgaucagcuucugcggcgucaauuccgauacagccaacuggucauggccugacggugcagaguugccauuuacuauugauaaguga

SEQ ID NO: 142222 - RNA, 1413 nt, Artificial Sequence; identical to SEQ ID NO: 139477
  derived and/or modified sequence opt3 from neuraminidase__InfluenzaA__ADW09178

SEQ ID NO: 142223 - RNA, 1413 nt, Artificial Sequence; identical to SEQ ID NO: 139477
  derived and/or modified sequence opt3 from neuraminidase__InfluenzaA__ADW09189

SEQ ID NO: 142224 - RNA, 1413 nt, Artificial Sequence; identical to SEQ ID NO: 142221
  derived and/or modified sequence opt3 from neuraminidase__InfluenzaA__ADW09211

SEQ ID NO: 142225 - RNA, 1413 nt, Artificial Sequence
  derived and/or modified sequence opt3 from neuraminidase__InfluenzaA__ADW09222
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauagugugacggucgauggagccgacggcguuaaagguuucuccuauaaguacgggaacggcguguggaucggaagaacuaaaagcaauaggcugcggaagggcuuugagaugauuugggacccgaacggguggacaaauaccgauucugacuucucaguaaaacaggauguggucgcuauaacugacuggaguggauauagcgguuccuuugugcagcaccccgaacucacaggcuuagauugcauccgcccuuguuucuggguugagcuggugcgagggcuuccaagagaaaacaccacgauuuggaccucuggaucgagcaucuccuucugcggcgucaacucagacacagccaauuggaguuggcccgauggugcagaguugccuuuuacuauugacaaguga

SEQ ID NO: 142226 - RNA, 1413 nt, Artificial Sequence
  derived and/or modified sequence opt3 from neuraminidase__InfluenzaA__ADW09233
augaaccccaaucagaagaucauuaccauaggcagcaucuccauugccaucgggacaauuucucugaugcuccaaaucggaaacauaaucucaauuugggcuagucacagcauccagacugguucccagaauaacacgggcauuugcaaucagagaaucauaaccuacgagaacucuacaugggugaaucauacuuaugucaacauuaauaacaccaauguuguggcaggggaagacaaaacaucgguaacccuugccggaaacucaagccuguguaguaucuccggcugggcgauuuacacuaaggauaauucuaucaggaucgguagcaaaggggacguguucgucauucgggagccuuuuauauccugcucacacuuggaaugucgcacauucuuuuuaacccaaggagcucugcuaaacgauaagcauaguaauggcacggugaaagaccgaagcccauaucgugcccucaugucuugcccgcugggcgaggcacccuccccuuacaacucaaaguucgaaagcguugccuggagugcuucugcaugucacgaugggaugggauggcuuacuaucgguauuuccggcccagacaacggggccguggcuguccugaaguauaauggaaucauaaccggcacaauuaaaagcuggaagaaacagaucuugagaacucaggagucggagugcguguguaugaacgguucuugcuuuaccaucaugacagaugggcccuccaauaaggccgcgucauacaaaauuuucaagaucgaaaagggaaaaguaaccaagaguauugagcucaacgcaccuaauuuuuauuacgaagaguguagcugcuacccagacacgggcauaguuaugugugugugcagggauaacuggcauggcuccaaucggcccugggucucuuucaaccagaaucuggacuaucaaaucggguacauuugcagcggaguguuuggugauaacccucgcccagaggacggcgaagggucauguaauccggugacugucgauggagccaacggcguuaaagguuucaguuauaaguacgggaauggcguguggaucggaagaacaaaauccaacaggcugcggaagggcuuugagaugaucugggaccccaauggguggaccaacacugacagcgauuucucuguaaaacaggacguggucgcuauuacagauuggucaggauauagugguagcuuugugcagcacccugaacucaccggcuuagacugcauacgcccauguuucuggguugagcuggugcgagggcuucccagagaaaacacgaccaucuggacauccggaucuucgauuagcuucugcggcgucaauuccgauacugccaacuggucauggccugacggugcagaguugccauuuaccaucgauaaguga

SEQ ID NO: 142227 - RNA, 1413 nt, Artificial Sequence; identical to SEQ ID NO: 142220
  derived and/or modified sequence opt3 from neuraminidase__InfluenzaA__ADW09244

SEQ ID NO: 142228 - RNA, 1413 nt, Artificial Sequence; identical to SEQ ID NO: 142220
  derived and/or modified sequence opt3 from neuraminidase__InfluenzaA__ADW09255

SEQ ID NO: 142229 - RNA, 1413 nt, Artificial Sequence; identical to SEQ ID NO: 142220
  derived and/or modified sequence opt3 from neuraminidase__InfluenzaA__ADW09266

SEQ ID NO: 142230 - RNA, 1413 nt, Artificial Sequence; identical to SEQ ID NO: 142220
  derived and/or modified sequence opt3 from neuraminidase__InfluenzaA__ADW09277

SEQ ID NO: 142231 - RNA, 1413 nt, Artificial Sequence; identical to SEQ ID NO: 139477
  derived and/or modified sequence opt3 from neuraminidase__InfluenzaA__ADW09288

SEQ ID NO: 142232 - RNA, 1413 nt, Artificial Sequence; identical to SEQ ID NO: 142221
  derived and/or modified sequence opt3 from neuraminidase__InfluenzaA__ADW09299

SEQ ID NO: 142233 - RNA, 1413 nt, Artificial Sequence; identical to SEQ ID NO: 139477
  derived and/or modified sequence opt3 from neuraminidase__InfluenzaA__ADW09310

SEQ ID NO: 142234 - RNA, 1413 nt, Artificial Sequence; identical to SEQ ID NO: 139477
  derived and/or modified sequence opt3 from neuraminidase__InfluenzaA__ADW09330

SEQ ID NO: 142235 - RNA, 1413 nt, Artificial Sequence; identical to SEQ ID NO: 142220
  derived and/or modified sequence opt3 from neuraminidase__InfluenzaA__ADW10475

SEQ ID NO: 142236 - RNA, 1413 nt, Artificial Sequence; identical to SEQ ID NO: 142221
  derived and/or modified sequence opt3 from neuraminidase__InfluenzaA__ADW10486

SEQ ID NO: 142237 - RNA, 1413 nt, Artificial Sequence; identical to SEQ ID NO: 139477
  derived and/or modified sequence opt3 from neuraminidase__InfluenzaA__ADW10497

SEQ ID NO: 142238 - RNA, 1413 nt, Artificial Sequence
  derived and/or modified sequence opt3 from neuraminidase__InfluenzaA__ADW10508
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugugaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucuggugaacgauaagcauaguaauggcaccguuaaagaccgaagcccauaucgugcccuaaugucuugcccgcucggcgaggcacccuccccuuacaacucaaaguucgaaagcguggccuggagugcuucugcaugucacgaugggaugggauggcugacgauugguaucuccggcccagacaacggggccgucgcugugcuuaaguauaauggaauaauuacuggcaccaucaaaagcuggaagaaacagauccugagaacacaggagucggagugcguauguaugaacgguucuugcuuuacuauuaugaccgaugggcccuccaauaaggccgcgucauacaaaaucuucaagauugaaaagggaaaaguuacaaagaguauagaguugaacgcaccuaauuuuuauuacgaagaguguagcugcuacccagacaccggcaucgugaugugugucugcagggauaacuggcauggcuccaaucggcccugggugucuuucaaccagaaucucgacuaucaaauuggguacaucugcagcggaguguuuggugauaacccucgcccagaggacggcgaagggucauguaauccggucacgguuaacggagccgauggcgugaaagguuucaguuauaaguacgggaauggcguauggaucggaagaacuaaauccaacaggcugcggaagggcuuugagaugauuugggaccccaauggguggacaaacaccgacagcgauuucucugugaaacaggacgucguggcuauaacugauuggucaggauauagugguagcuuuguucagcacccugaacugacaggccucgacugcauccgcccauguuucuggguggaguuaguccgagggcugcccagagaaaacaccacgauuuggaccuccggaucuucgaucagcuucugcggcgucaauuccgauacagccaacuggucauggccugacggugcagagcuuccauuuacuauugauaaguga

SEQ ID NO: 142239 - RNA, 1413 nt, Artificial Sequence; identical to SEQ ID NO: 139477
  derived and/or modified sequence opt3 from neuraminidase__InfluenzaA__ADW10519

SEQ ID NO: 142240 - RNA, 1413 nt, Artificial Sequence; identical to SEQ ID NO: 139477
  derived and/or modified sequence opt3 from neuraminidase__InfluenzaA__ADW10530

SEQ ID NO: 142241 - RNA, 1413 nt, Artificial Sequence
  derived and/or modified sequence opt3 from neuraminidase__InfluenzaA__ADW10541
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguauggaugguucuugcuuuacuauuaugaccgacgggcccuccaacaaggccgcgucauacaaaaucuucaagauugaaaagggaaaaguaacaaagaguauagagcucaaugcaccuaacuuuuauuacgaagaguguagcugcuacccagauaccggcaucguuaugugugugugcagggacaauuggcauggcuccaaccggcccugggucucuuucaaucagaaccuggauuaucaaauuggguacaucugcagcggaguguuuggugacaauccucgcccagaggauggcgaagggucauguaacccggugacggucgacggagccaauggcguuaaagguuucaguuauaaguacgggaacggcguguggaucggaagaacuaaauccaauaggcugcggaagggcuuugagaugauuugggaccccaacggguggacaaauaccgauagcgacuucucuguaaaacaggauguggucgcuauaacugacuggucaggauauagugguagcuuugugcagcacccugaacucacaggcuuagauugcauccgcccauguuucuggguugagcuggugcgagggcuucccagagaaaacaccacgauuuggaccuccggaucuucgaucagcuucugcggcgucaacuccgacacagccaauuggucauggccugauggugcagaguugccauuuacuauugacaaguga

SEQ ID NO: 142242 - RNA, 1413 nt, Artificial Sequence
  derived and/or modified sequence opt3 from neuraminidase__InfluenzaA__ADW10552
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccugacuuuuauuacgaagaguguagcugcuacccagauaccggcaucguuaugugugugugcagggacaauuggcauggcuccaaccggcccugggucucuuucaaucagaaccuggauuaucaaauuggguacaucugcagcggaguguuuggugacaauccucgcccagaggauggcgaagggucauguaacccggugacggucaauggagccgacggcguuaaagguuucaguuauaaguacgggaacggcguguggaucggaagaacuaaauccaauaggcugcggaagggcuuugagaugauuugggaccccaacggguggacaaauaccgauagcgacuucucuguaaaacaggauguggucgcuauaacugacuggucaggauauagugguagcuuugugcagcacccugaacucacaggcuuagauugcauccgcccauguuucuggguugagcuggugcgagggcuucccagagaaaacaccacgauuuggaccuccggaucuucgaucagcuucugcggcgucaacuccgacacagccaauuggucauggccugauggugcagaguugccauuuacuauugacaaguga

SEQ ID NO: 142243 - RNA, 1413 nt, Artificial Sequence; identical to SEQ ID NO: 141953
  derived and/or modified sequence opt3 from neuraminidase__InfluenzaA__ADW10563

SEQ ID NO: 142244 - RNA, 1413 nt, Artificial Sequence; identical to SEQ ID NO: 139477
  derived and/or modified sequence opt3 from neuraminidase__InfluenzaA__ADW10574

SEQ ID NO: 142245 - RNA, 1413 nt, Artificial Sequence
  derived and/or modified sequence opt3 from neuraminidase__InfluenzaA__ADW10585
augaaccccaaucagaagaucauuaccauaggcagcaucuccauugccaucgggauuaucucucugaugcuccaaauaggaucaaucauuaguaucugggcuagccacuccauucagacagguucucagaacaauacuggcaucugcaaccagagaauaauuacguacgagaauagcaccugggugaaccauacauaugucaauaucaacaauacuaacguuguggcaggggaagacaaaaagucaguaacccuugccggaaauagcagucuguguuccauuucuggcugggcgaucuacacaaaagauaacagcaucaggauugguuccaagggggacguguucgucauacgggagccuuuuaucucaugcagucacuuggaaugucgcaccuucuuuuuaacucaaggagcucugcuaaaugauaaacauagcaacggcacagugaaggaccgaucuccauaucgugcccucauguccugcccgcugggcgaggcacccucaccuuacaauagcaaguucgaaaguguugccuggucugcuuccgcaugucacgaugggaugggauggcuuaccauugguaucagcggcccagacaacggggccguggcuguccugaaauauaacggaauaauuacgggcacuaucaagucguggaaaaagcagaucuugagaacccaggagucugagugcguguguaugaaugguuccugcuuuacaauuaugacugaugggcccucaaacaaagccgcgaguuacaagaucuucaagauugaaaaaggaaagguaaccaaaagcauagagcucaaugcaccuaacuuuuauuacgaagaguguuccugcuacccagacacaggcaucguuaugugugugugcagggauaauuggcauggcucuaaccggcccugggucagcuucaaucagaaccuggaguaucaaauuggguacaucugcucaggaguguuuggugacaauccucgcccagaagauggcgaggggaguuguaacccggugaccgucgacggagccaauggcguuaaggguuucuccuauaaauacgggaacggcguguggaucggaagaacgaagucgaauaggcugcggaaaggcuuugaaaugauuugggaucccaacggguggacuaauacagacucugacuucucaguaaagcaggauguggucgcuauaaccgacuggaguggauauagcgguuccuuugugcagcacccugagcucacuggcuuagauugcauccgcccauguuucuggguugaacuggugcgagggcuucccagagagaacacaaccauuuggacgucuggaucgagcaucuccuucugcggcgucaacucagacaccgccaauuggaguuggccugauggugcagaguugccauuuacaauugacaaguga

SEQ ID NO: 142246 - RNA, 1413 nt, Artificial Sequence; identical to SEQ ID NO: 142221
  derived and/or modified sequence opt3 from neuraminidase__InfluenzaA__ADW10596

SEQ ID NO: 142247 - RNA, 1413 nt, Artificial Sequence; identical to SEQ ID NO: 142220
  derived and/or modified sequence opt3 from neuraminidase__InfluenzaA__ADW10607

SEQ ID NO: 142248 - RNA, 1413 nt, Artificial Sequence; identical to SEQ ID NO: 142220
  derived and/or modified sequence opt3 from neuraminidase__InfluenzaA__ADW10618

SEQ ID NO: 142249 - RNA, 1413 nt, Artificial Sequence; identical to SEQ ID NO: 142220
  derived and/or modified sequence opt3 from neuraminidase__InfluenzaA__ADW10629

SEQ ID NO: 142250 - RNA, 1413 nt, Artificial Sequence; identical to SEQ ID NO: 142220
  derived and/or modified sequence opt3 from neuraminidase__InfluenzaA__ADW10724

SEQ ID NO: 142251 - RNA, 1413 nt, Artificial Sequence; identical to SEQ ID NO: 142221
  derived and/or modified sequence opt3 from neuraminidase__InfluenzaA__ADW10735

SEQ ID NO: 142252 - RNA, 1413 nt, Artificial Sequence; identical to SEQ ID NO: 142221
  derived and/or modified sequence opt3 from neuraminidase__InfluenzaA__ADW10746

SEQ ID NO: 142253 - RNA, 1413 nt, Artificial Sequence
  derived and/or modified sequence opt3 from neuraminidase__InfluenzaA__ADW10757
augaaccccaaucagaagaucauuaccauaggcagcaucuccauugccaucgggauuaucucucugaugcuccaaauaggaaacaucauuucaaucugggcuagucacagcauucagacaagaucccagaauaacacugguaucugcaaucagaggauaauuacguacgagaacucuaccugggugaaucauacauaugucaacaucaauaacacuaauguuguggcaggcggggacaaaaccucgguaacacuugccggaaacucaagccuguguaguauuuccggcugggcgaucuacaccaaggauaauucuauccggauugguagcaaaggggacguguucgucauacgcgaaccuuuuaucuccugcucacacuuggagugucgaacuuucuuuuuaacacaaggagcucugcuaaacgauaagcauaguaauggcaccgugaaagaccguagcccauauagagcccucaugucuugcccgcugggcgaagcacccuccccuuacaacucaaaguucgagagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugaggacacaggaaucggagugcguguguaugaacgguucuugcuuuacucucaugaccgaugggcccuccaauaaggccgcgucauacaaaauuuucaagaucgagaagggaaaaguaacaaagaguauugaacugaacgcaccuaauuuuuauuacgaggaauguagcugcuacccagacaccggcauaguuaugugugugugccgggauaacuggcauggcuccaaucgccccugggucucuuucaaccagaaucuggacuaucaaaucggguacauuugcagcggaguguuuggugauaacccuagaccagaggacggcgaggggucauguaauccggugacggucgauggagccaacggcguuaaagguuucaguuauaaguacgggaauggcguguggaucggaaggacuaaauccaaccggcuccgcaagggcuuugaaaugaucugggaccccaauggguggacaaacaccgacagcgauuucucuguaaaacaggacguggucgcuauuacugauuggucaggauauagugguagcuuugugcagcacccugaguuaacaggccuggacugcauacgaccauguuucuggguugaacuugugagaggguugcccagggagaacaccacgaucuggaccuccggaucuucgauuagcuucugcggcgucaauuccgauacagccaacuggucauggccugacggugcagaacugccauuuacuaucgauaaguga

SEQ ID NO: 142254 - RNA, 1413 nt, Artificial Sequence; identical to SEQ ID NO: 142220
  derived and/or modified sequence opt3 from neuraminidase__InfluenzaA__ADW10768

SEQ ID NO: 142255 - RNA, 1413 nt, Artificial Sequence; identical to SEQ ID NO: 139477
  derived and/or modified sequence opt3 from neuraminidase__InfluenzaA__ADW10779

SEQ ID NO: 142256 - RNA, 1413 nt, Artificial Sequence
  derived and/or modified sequence opt3 from neuraminidase__InfluenzaA__ADW10790
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucgauggagccaacggcguuaaagguuucaguuauaaguacgggaauggcguguggaucggaagaacuaaauccaacaggcugcggaagggcuuugagaugauuugggaccccaauggguggacaaacaccgacagcgauuucucuguaaaacaggacguggucgcuauaacugauuggucaggauauagugguagcuuugugcagcacccugaacucacaggcuuagacugcaucauuccauguuucuggguugagcuggugcgcgggcuuccccgagaaaacgccaccaucuggacguccggaucuucgauuagcuucugcggcgucaauuccgauaccgcaaacuggucauggccugacggugcugaguugccauuuacaaucgauaaguga

SEQ ID NO: 142257 - RNA, 1413 nt, Artificial Sequence; identical to SEQ ID NO: 140946
  derived and/or modified sequence opt3 from neuraminidase__InfluenzaA__ADW10801

SEQ ID NO: 142258 - RNA, 1413 nt, Artificial Sequence; identical to SEQ ID NO: 142220
  derived and/or modified sequence opt3 from neuraminidase__InfluenzaA__ADW10812

SEQ ID NO: 142259 - RNA, 1413 nt, Artificial Sequence; identical to SEQ ID NO: 141972
  derived and/or modified sequence opt3 from neuraminidase__InfluenzaA__ADW10823

SEQ ID NO: 142260 - RNA, 1413 nt, Artificial Sequence
  derived and/or modified sequence opt3 from neuraminidase__InfluenzaA__ADW10834
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaauaaagaguaucgagcucaacgcaccuaauuuuuauuacgaagaguguagcugcuacccagacacaggcauuguuaugugugugugcagggauaacuggcauggcuccaaucggcccugggucucuuucaaccagaaucuggacuaucaaaucggguacaucugcagcggaguguuuggugauaacccucgcccagaggacggcgaagggucauguaauccggugaccgucgauggagccaacggcguuaaagguuucaguuauaaguacgggaauggcguguggauuggaagaacgaaauccaacaggcugcggaagggcuuugagaugauaugggaccccaauggguggacuaacacagacagcgauuucucuguaaaacaggacguggucgcuaucaccgauuggucaggauauagugguagcuuugugcagcacccugaacucacuggcuuagacugcauucgcccauguuucuggguugagcuggugcgagggcuucccagagaaaacacaaccaucuggacguccggaucuucgauuagcuucugcggcgucaauuccgauaccgccaacuggucauggccugacggugcagaguugccauuuacaaucgauaaguga

SEQ ID NO: 142261 - RNA, 1413 nt, Artificial Sequence; identical to SEQ ID NO: 142221
  derived and/or modified sequence opt3 from neuraminidase__InfluenzaA__ADW10845

SEQ ID NO: 142262 - RNA, 1413 nt, Artificial Sequence
  derived and/or modified sequence opt3 from neuraminidase__InfluenzaA__ADW10856
augaaccccaaucagagaaucauuaccauaggcagcaucuccauugccaucgggauuaucucucugaugcuccaaauaggaaacaucauuucaaucugggcuagucacagcauucagacagguucccagaauaacacuggcaucugcaaucagaggauaauuacguacgagaacucuaccugggugaaucauacauaugucaacaucaauaacacuaauguuguggcaggggaagacaagaccucgaugacacuugccggaaacucaagccuguguaguauuuccggcugggcgaucuacaccaaagauaauucuauccggauugguagcaagggggacguauucgugauacgcgagccuuuuaucuccugcucacacuuggaaugucgaacuuucuuuuuaacacaaggagcucugcuaaacgauaaacauaguaauggcaccgccaaggaccguagcccauauagagcacucaugucuugcccgcugggcgaggcccccuccccuuacaacucaaaauucgaaagcgucgcuuggagugcaucugccugucacgaugggaugggauggcuuacgauugguaucuccggcccagacaacggggcuguggccguucugaaguauaauggaauaauuacuggcaccaucaagagcuggaaaaagcagaucuugaggacacaggagucggagugcguguguaugaacgguucuugcuuuacuauuaugaccgaugggcccuccaauaaagcggcaucauacaagaucuucaaaauugaaaagggaaaggucacaaaaaguauagagcucaacgccccuaauuuuuauuacgaagaguguagcugcuacccagacaccggcaucgugauguguguaugccgggauaacuggcauggcuccaaucgccccuggguuucuuucaaccagaaucuggacuaucaaauuggguacaucugcagcggaguguuuggugauaacccuagaccagaggacggcgaagggucauguaauccggucacgguggauggagcuaacggcgugaaggguuucaguuauaaauacgggaauggcgucuggaucggaaggacuaaguccaaccggcugcgcaaaggcuuugagaugauuugggaccccaauggguggacaaacaccgacagcgauuucucuguuaagcaggacgugguagccauaacugauuggucaggauauagugguagcuuugugcagcacccugaacucacaggcuuagacugcauccgaccauguuucugggucgagcuggugagagggcuucccagggaaaacaccacgauuuggaccuccggaucuucgaucagcuucugcggcguuaauuccgauacagcaaacuggucauggccugacggugcugaguugccauuuacuauugauaaauga

SEQ ID NO: 142263 - RNA, 1413 nt, Artificial Sequence; identical to SEQ ID NO: 142220
  derived and/or modified sequence opt3 from neuraminidase__InfluenzaA__ADW10867

SEQ ID NO: 142264 - RNA, 1413 nt, Artificial Sequence; identical to SEQ ID NO: 142220
  derived and/or modified sequence opt3 from neuraminidase__InfluenzaA__ADW10878

SEQ ID NO: 142265 - RNA, 1413 nt, Artificial Sequence; identical to SEQ ID NO: 142220
  derived and/or modified sequence opt3 from neuraminidase__InfluenzaA__ADW10889

SEQ ID NO: 142266 - RNA, 1413 nt, Artificial Sequence; identical to SEQ ID NO: 139477
  derived and/or modified sequence opt3 from neuraminidase__InfluenzaA__ADW10900

SEQ ID NO: 142267 - RNA, 1410 nt, Artificial Sequence; identical to SEQ ID NO: 140500
  derived and/or modified sequence opt3 from neuraminidase__InfluenzaA__ADW11155

SEQ ID NO: 142268 - RNA, 1410 nt, Artificial Sequence; identical to SEQ ID NO: 138754
  derived and/or modified sequence opt3 from neuraminidase__InfluenzaA__ADW23530

SEQ ID NO: 142269 - RNA, 1410 nt, Artificial Sequence
  derived and/or modified sequence opt3 from neuraminidase__InfluenzaA__ADW54483
augaaccccaaucagaagaucauuaccauaggcagcgugugcaugacaaucgggauggccaaccugaugcuccaaauuggaaauaucauuuccaucuggauaucucacucaauccagcuugguaaccagagucagauugagacuuguaaucaaagcgucaucacguacgaaaacaauaccuggguuaaccagacauaugugaauauuuccaacacuaauuucgcugcaggccagucuguagugucggucaaacuggccgggaacagcagcuugugcccugugaguggaugggcgaucuacuccaaggacaauucuauaagaauuggcagcaaaggugauguuuuugugaucagggagccauucauuuccuguucaccguuagaaugccggaccuuuuuccugacacagggggcucuacucaacgacaagcauaguaauggaaccaucaaagaucgcagccccuaucgaacucugaugucuuguccuaucggcgaggucccaucccccuacaacucacguuuugaaagcguggccuggagugcaucugccugccacgacggcauuaacuggcuuacaauagggaucuccggaccugauaauggugcuguagcaguucugaaguauaacggcauuaucaccgacacgauaaagagcuggagaaauaacauuuugaggacucaagagucggagugugccugcgugaaugggucuuguuucaccaucaugacagauggaccauccgacggccaggcuucauacaaaaucuuucggauugaaaaggguaaaaucgucaagaguguggagaugaacgcccccaauuaucauuacgaagagugcagcuguuacccugauuccucugagauuacuugcgugugccgcgacaacuggcacgggagcaauagaccaugggucucauucaaccagaaucucgaauaucagauaggauacaucuguaguggcauuuuuggcgauaacccgaggcccaaugacaaaaccggguccugcggaccuguuagcucuaacggugcgaauggcgugaagggguucucauuuaaguauggaaacggcguauggaucggucggacaaaaaguaucagcucccgcaagggguucgagaugauuugggauccaaacggcuggaccggaacggacaauaacuuuucuauaaaacaagacaucgugggcauuaaugaauggucgggguacagcggauccuucguccagcaucccgagcugacuggucuggauuguauccgaccuugcuucuggguggaacucauuagaggcaggccaaaggagaacacaaucuggaccucagggaguucuauaucauuuuguggaguuaauuccgacacugugggcuggucauggcccgauggugcagaguuaccguucacaaucgacaaauga

SEQ ID NO: 142270 - RNA, 1410 nt, Artificial Sequence
  derived and/or modified sequence opt3 from neuraminidase__InfluenzaA__ADW54494
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauauaggauaggauacaucuguucaggcauuuuuggcgauaauccgcggcccaacgacaaaaccgggaguugcggaccuguguccagcaauggugcgaacggcguaaagggguucucuuuuaaguauggaaacggcguguggaucggucgcacaaaaucaaucaguagccgaaauggguucgagaugauuugggauccaaacggcuggaccggaacggacaauaacuuuuccauaaagcaggacaucauuggcaucaaugaauggucuggguacucggggagcuucguccaacaucccgagcugacuggucuggauuguauuagaccuugcuucuggguggaacucaucaggggccggccaaaagagaacacaauauggaccuccgggucaaguaucucuuuuuguggaguuaauagcgacacugugggcugguccuggcccgauggugcagaguuaccguucacaauugacaaguga

SEQ ID NO: 142271 - RNA, 1410 nt, Artificial Sequence
  derived and/or modified sequence opt3 from neuraminidase__InfluenzaA__ADW54514
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggaaaaacaauaucuugagaacucaagagagcgagugugccugcgugaacgggucguguuucaccgucaugacagauggaccaucugacggccaggcuuccuacaagaucuuuaggauugaaaaagguaagaucgugaaaucaguggagaugaaugcccccaacuaucauuacgaagagugcaguuguuacccugauagcuccgagauuacuugcgucugccgggacaauuggcacgggucuaaccgcccauggguuagcuucaaucagaaccucgaauauagaauaggauacaucuguucaggcauuuuuggcgauaauccgaggcccaacgacaagaccgggaguugcggaccuguguccagcaauggugcgaacggcguaaagggguucucuuuuaaauauggaaacggcguguggaucggucggacaaagucaaucaguagccgcaauggguucgagaugauuugggauccaaacggcuggaccggaacggacaauaacuuuuccaaaaagcaggacauaaucggcauuaaugaauggucuggguacucggggagcuucguccaacaucccgagcugacuggucuggauuguauccgaccuugcuucuggguggaacucauuagaggcaggccaaaagagaacacaaucuggaccuccgggucaaguauaucuuuuuguggaguuaauagcgacacugugggcugguccuggcccgauggugcagaguuaccguucacaaucgacaaguga

SEQ ID NO: 142272 - RNA, 1410 nt, Artificial Sequence
  derived and/or modified sequence opt3 from neuraminidase__InfluenzaA__ADW54522
augaaccccaaucagaagaucauuaccauaggcagcgugugcaugaucauugggauggccaaccugauccuccaaauuggaaauaucauauccaucuggauuucucacucaauccagcuugguaaccagaaucagauugagacauguaaccaaagugucaucacuuacgaaaauaacacguggguuaaucagaccuaugugaacauaagcaauacaaacuucgcugcaggccaguccguagugucugucaaacuggccggaaauucgucauugugcccugugagcggaugggcgauuuacaguaaggacaacuccaucagaauuggcucuaaaggugauguuuuugugaucagggagccauucaucagcuguuccccguuagaaugccggaccuuuuuccugacucagggggcucuacucaaugacaagcauucaaacggaacaauuaaagaucgcagucccuaucgaacccugaugagcuguccuauaggcgaggucccaucucccuacaacucccguuuugaaucaguggccuggagcgcaagugccugccacgacggcaucaauuggcuuacuauugggaucucuggaccugauaacggugcuguagcaguucugaaguauaauggcauaauuacagacaccaucaaguccuggagaaacaauagguugcggacgcaagagagcgagugugccugcgugaacgggucguguuucacugucaugaccgauggaccaucugacggccaggcuuccuacaaaaucuuucgcauugaaaaggguaaaaucgugaagucaguggagaugaaugcccccaacuaucauuacgaagagugcaguuguuacccugauagcuccgagauuacaugcgucugcagagacaauuggcacgggucuaacaggccauggguuagcuucaaucagaaccucgaauaucagauaggauacaucuguucaggcauuuuuggcgauaauccgcggcccaacgacaaaacugggaguugcggaccuguguccagcaauggugcgaacggcguaaagggguucucuuuuaaguauggaaacggcguguggaucggucgcaccaaaucaaucaguagccgaaagggguucgagaugauuugggauccaaauggcuggacaggaaccgacaacaauuuuuccauaaaacaagacaucgucggcauuaacgaauggucuggguacucggggagcuucgugcagcaucccgagcugacgggucuggauuguaucagaccuugcuucuggguugaacucauuaggggccggccaaaggagaauacuaucuggacauccgggucaaguauaucuuuuuguggagugaacagcgacaccgucggcugguccuggcccgauggugcagaguuaccguucacuaucgacaaauga

SEQ ID NO: 142273 - RNA, 1410 nt, Artificial Sequence
  derived and/or modified sequence opt3 from neuraminidase__InfluenzaA__ADW65826
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucggucggacaaaaaguauuagcucccgcaagggguucgagaugauaugggauccaaacggcuggaccggaacggacaauaacuuuucuaucaaacaagacauugugggcaucaaugaauggucgggguacagcggauccuucguccagcaucccgagcugacuggucuggauuguauucgaccuugcuucuggguggaacucaucagaggcaggccaaaggagaacacaauauggaccucagggaguucuaucagcuuuuguggaguuaauuccgacacugugggcuggucauggcccgauggugcagaguuaccguucacaauugacaaauga

SEQ ID NO: 142274 - RNA, 1410 nt, Artificial Sequence; identical to SEQ ID NO: 138615
  derived and/or modified sequence opt3 from neuraminidase__InfluenzaA__ADW80519

SEQ ID NO: 142275 - RNA, 1410 nt, Artificial Sequence; identical to SEQ ID NO: 138615
  derived and/or modified sequence opt3 from neuraminidase__InfluenzaA__ADW82127

SEQ ID NO: 142276 - RNA, 1410 nt, Artificial Sequence; identical to SEQ ID NO: 138615
  derived and/or modified sequence opt3 from neuraminidase__InfluenzaA__ADW82138

SEQ ID NO: 142277 - RNA, 1410 nt, Artificial Sequence; identical to SEQ ID NO: 138615
  derived and/or modified sequence opt3 from neuraminidase__InfluenzaA__ADW82149

SEQ ID NO: 142278 - RNA, 1410 nt, Artificial Sequence; identical to SEQ ID NO: 138615
  derived and/or modified sequence opt3 from neuraminidase__InfluenzaA__ADW82158

SEQ ID NO: 142279 - RNA, 1410 nt, Artificial Sequence; identical to SEQ ID NO: 138615
  derived and/or modified sequence opt3 from neuraminidase__InfluenzaA__ADW82169

SEQ ID NO: 142280 - RNA, 1410 nt, Artificial Sequence; identical to SEQ ID NO: 138615
  derived and/or modified sequence opt3 from neuraminidase__InfluenzaA__ADW82180

SEQ ID NO: 142281 - RNA, 1410 nt, Artificial Sequence; identical to SEQ ID NO: 138754
  derived and/or modified sequence opt3 from neuraminidase__InfluenzaA__ADW82191

SEQ ID NO: 142282 - RNA, 1410 nt, Artificial Sequence; identical to SEQ ID NO: 138754
  derived and/or modified sequence opt3 from neuraminidase__InfluenzaA__ADW82201

SEQ ID NO: 142283 - RNA, 1410 nt, Artificial Sequence; identical to SEQ ID NO: 138754
  derived and/or modified sequence opt3 from neuraminidase__InfluenzaA__ADW82211

SEQ ID NO: 142284 - RNA, 1410 nt, Artificial Sequence; identical to SEQ ID NO: 138754
  derived and/or modified sequence opt3 from neuraminidase__InfluenzaA__ADW82221

SEQ ID NO: 142285 - RNA, 1410 nt, Artificial Sequence; identical to SEQ ID NO: 138754
  derived and/or modified sequence opt3 from neuraminidase__InfluenzaA__ADW82231

SEQ ID NO: 142286 - RNA, 1410 nt, Artificial Sequence; identical to SEQ ID NO: 138754
  derived and/or modified sequence opt3 from neuraminidase__InfluenzaA__ADW82241

SEQ ID NO: 142287 - RNA, 1410 nt, Artificial Sequence; identical to SEQ ID NO: 138754
  derived and/or modified sequence opt3 from neuraminidase__InfluenzaA__ADW82251

SEQ ID NO: 142288 - RNA, 1410 nt, Artificial Sequence; identical to SEQ ID NO: 138754
  derived and/or modified sequence opt3 from neuraminidase__InfluenzaA__ADW82261

SEQ ID NO: 142289 - RNA, 1410 nt, Artificial Sequence; identical to SEQ ID NO: 138754
  derived and/or modified sequence opt3 from neuraminidase__InfluenzaA__ADW82271

SEQ ID NO: 142290 - RNA, 1410 nt, Artificial Sequence; identical to SEQ ID NO: 142273
  derived and/or modified sequence opt3 from neuraminidase__InfluenzaA__ADW95306

SEQ ID NO: 142291 - RNA, 1410 nt, Artificial Sequence; identical to SEQ ID NO: 142273
  derived and/or modified sequence opt3 from neuraminidase__InfluenzaA__ADW95313

SEQ ID NO: 142292 - RNA, 1410 nt, Artificial Sequence; identical to SEQ ID NO: 142273
  derived and/or modified sequence opt3 from neuraminidase__InfluenzaA__ADW95320

SEQ ID NO: 142293 - RNA, 1410 nt, Artificial Sequence; identical to SEQ ID NO: 142273
  derived and/or modified sequence opt3 from neuraminidase__InfluenzaA__ADW95327

SEQ ID NO: 142294 - RNA, 1410 nt, Artificial Sequence
  derived and/or modified sequence opt3 from neuraminidase__InfluenzaA__ADW95333
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucgguagugcaaaaagcauuuccucucggaaggccuucgagaugauaugggauccaaacggguggacaggcaccgacaauaacuuuucgaucaaacaauacauugugggaaucaaugaauggagcggcuauuccgggucauucgucgagcaucccgaacugacgggacuggacuguauucgcccuugcuucuggguggagcucauccgagguagaccaaaggagaacacuauauggacaaguggcucuagcaucuccuuuugugggguuaauucagauaccgugggauggagcuggcccgacggcgcugaauuaccguucacuauugauaaauga

SEQ ID NO: 142295 - RNA, 1410 nt, Artificial Sequence
  derived and/or modified sequence opt3 from neuraminidase__InfluenzaA__ADX20813
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaacuuguggccuggucagcaagcgccugccacgacggcauaaauuggcugacaaucgggauuaguggaccugauaacggugcuguagcaguuuugaaguauaauggcaucauaaccgacacgauuaagucuuggagaaacaauauccucaggacucaagaguccgagugugccugcgugaacgggagcuguuucaccgucaugacagauggaccaucggacggccagacuucuuacaaaaucuuucggauugaaaaggguaaaaucgugaaguccguggagaugaaugcucccaacuauuacuacgaagagugcucauguuauccugauaguagcgagauuaccugcgucugccgcgacaauuggcauggguccaacagaccauggguuucuuucaaucagaaccuggaauaccagauaggauauaucuguagcggcauuuuuggcgauaauccgaggcccaacgacaaaacagggucaugcggaccugugaguuccaauggugccaacggcguaaagggguucagcuuuaaguacggaaacggcguguggaucggucggaccaaaucuaucucaagucgcaagggguucgagaugauuugggauccaaauggcuggacgggaacugacaacaauuuuagcauaaaacaagacaucgucggcauuaacgaaugguccggguauucuggaucguucgugcagcaccccgagcugacaggucucgauuguauccgaccuugcuucuggguugaauuaauuagaggcaggccaaaggagaauaccaucuggacuagcggguccucaauaaguuuuuguggagugaacucugacacagucggcuggagcuggcccgauggugcggagcugccguucaccaucgacaaauga

SEQ ID NO: 142296 - RNA, 1410 nt, Artificial Sequence
  derived and/or modified sequence opt3 from neuraminidase__InfluenzaA__ADX20814
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuauuacuacgaagagugcagcuguuauccugauuccucugagauaacuugcgugugccgcgacaacuggcaugggagcaauagaccaugggucucauucaaccagaaucucgaauaccagaucggauauauuuguaguggcaucuuuggcgauaacccgaggcccaaugacaaaaccggguccugcggaccuguuagcucuaacggugcgaauggcgugaagggguucucauuuaaguacggaaacggcguauggaucggucggacaaaaaguauuagcucccgcaagggguucgagaugauaugggauccaaacggcuggaccggaacggacaauaacuuuucuaucaaacaagacauugugggcaucaaugaauggucgggguauagcggauccuucguccagcaccccgagcugacuggucuggauuguauucgaccuugcuucuggguggaacucaucagaggcaggccaaaggagaacacaauauggaccucagggaguucuaucagcuuuuguggaguuaauuccgacacugugggcuggucauggcccgauggugcagaguuaccguucacaauugacaaauga

SEQ ID NO: 142297 - RNA, 1410 nt, Artificial Sequence; identical to SEQ ID NO: 138615
  derived and/or modified sequence opt3 from neuraminidase__InfluenzaA__ADX21091

SEQ ID NO: 142298 - RNA, 1410 nt, Artificial Sequence; identical to SEQ ID NO: 138754
  derived and/or modified sequence opt3 from neuraminidase__InfluenzaA__ADX21101

SEQ ID NO: 142299 - RNA, 1410 nt, Artificial Sequence; identical to SEQ ID NO: 139621
  derived and/or modified sequence opt3 from neuraminidase__InfluenzaA__ADX36112

SEQ ID NO: 142300 - RNA, 1410 nt, Artificial Sequence
  derived and/or modified sequence opt3 from neuraminidase__InfluenzaA__ADX87386
augaaccccaaucagagaaucauuaccauaggcagcgugucccugacaaucucuacuauuugcuucuuuaugcaaaucgccauucucaucacgaccgucacacuucacuucaagcaguacgaguuuaacucaccuccaaauaaccagguuaugcugugugaaccgacuauaaucgagaggaauauuaccgaaaucguguauuugacaaacaccacuauugagaaagaaaucugccccaaguuagcugaguaccggaauuggaguaaaccucagugugacauaacaggguucgcaccauuuagcaaggauaacuccauucgccugucugccggaggugacaucuggguaacccgagagcccuaugugucgugcgauccugacaaauguuaccaauucgcgcuaggccaggggacgacucucaauaacguccauucaaauaacaccgugcgugauagaacaccauauaggacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggacggcugguggauuccguaguuucauggaguaaggagauucugcgcacgcaggaaagcgagugugugugcauaaacggcacuuguacagucgugaugaccgacggcucugcuuccgggaaagcagauacuaagauccucuuuauugaggaaggaaaaaucgugcauacaucaaccuuaagcgguagugcccaacacgucgaggaaugcucuugcuauccuagauacccaggcguuaggugugugugccgggacaacuggaagggguccaaucgcccgauaguagauauuaacaucaaggaccacagcaucgugucgucuuacgucuguuccggacuggugggcgacacgccccggaaaaaugauucaaguagcuccucucauugccuugacccuaacaaugaggaaggugggcacggaguuaagggcugggcuuucgaugacggcaacgauguguggauggggagaaccauuagcgagaaaucaagguugggauaugagacauuuaaggucaucgaagguuggaguaauccaaaauccaagcugcagauuaaccgacaggugauaguagaccguggcaaucgcagcggguacucuggaaucuucucaguugagggcaaaaguuguauuaacagaugcuuuuauguggaacuaaucaggggucggaaggaggaaacugagguccucuggaccagcaauuccaucguggucuucugugggacaucuggcacuuacggaaccggcucguggcccgauggggccgacauuaaccugaugccuguguga

SEQ ID NO: 142301 - RNA, 1410 nt, Artificial Sequence
  derived and/or modified sequence opt3 from neuraminidase__InfluenzaA__ADX96270
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaaguauuaucacguacgaaaauaacaccugggucaaucagacauauguuaacauaagcaauacuaacuucgcugcaggccaguccguggccucuguaaaacuggcgggaaauucgucauugugcccugugagcggaugggcuauuuacaguaaggacaacuccgucagaaucggcucuaaaggugauguguuuguuauuagggagccauucaucagcuguuccccguuagaaugccggaccuuuuuccugacacagggggcccuacucaaugacaagcauucaaacggaaccaucaaagaucgcagucccuaucgaacucugaugagcuguccuauuggcgaggugccaucucccuacaacucccguuuugaaucagucgcauggagcgccagugcuugccacgacggcauaaauuggcuuacaaucgggauuucuggaccugauaacggugcaguggccguacugaaguauaauggcaucauaaccgacacgauuaaguccuggagaaacaauaucuugaggacucaagagagcgagugugcuugcguuaacgggucguguuucaccgugaugacagauggaccaucugacggccaggccuccuacaaaaucuuucggauugaaaaggguaaaaucgucaagucaguggagaugaaugcgcccaacuaucauuacgaagagugcaguuguuacccugauagcuccgagauuacuugcgugugccgcgacaauuggcacgggucuaacagaccaugggucagcuucaaucagaaccucgaauaucagauaggauacaucuguucaggcauuuuuggcgauaauccgaggcccaacgacaaaaccgggaguugcggaccuguuuccagcaauggugcaaacggcgugaagggguucucuuuuaaguauggaaacggcguauggaucggucggacaaaaucaaucaguagccgcaauggguucgagaugauuugggauccaaacggcuggaccggaacggacaauaacuuuuccauaaagcaagacaucgugggcauuaaugaauggucuggguacucggggagcuucguccagcaucccgagcugacuggucuggauuguauccgaccuugcuucuggguggaacucauuagaggcaggccaaaagagaacacaaucuggaccuccgggucaaguauaucuuuuuguggaguuaauagcgacacugugggcugguccuggcccgauggugccgaguuaccguucacaaucgacaaguga

SEQ ID NO: 142302 - RNA, 1410 nt, Artificial Sequence; identical to SEQ ID NO: 142301
  derived and/or modified sequence opt3 from neuraminidase__InfluenzaA__ADX96280

SEQ ID NO: 142303 - RNA, 1410 nt, Artificial Sequence; identical to SEQ ID NO: 139337
  derived and/or modified sequence opt3 from neuraminidase__InfluenzaA__ADX96290

SEQ ID NO: 142304 - RNA, 1410 nt, Artificial Sequence; identical to SEQ ID NO: 138754
  derived and/or modified sequence opt3 from neuraminidase__InfluenzaA__ADX96300

SEQ ID NO: 142305 - RNA, 1410 nt, Artificial Sequence; identical to SEQ ID NO: 138754
  derived and/or modified sequence opt3 from neuraminidase__InfluenzaA__ADX96310

SEQ ID NO: 142306 - RNA, 1410 nt, Artificial Sequence
  derived and/or modified sequence opt3 from neuraminidase__InfluenzaA__ADX96330
augaaccccaaucagaagaucauuaccauaggcagcgugugcaugacaaucgggauggccaaccugauucuccaaaucggaaaugguauuuccaucuggauaucucacucaauccagcuuggcaaccagaaucagauugagacuuguaaccaaagugucaucacguacgaaaauaacaccuggguuaaucagacauaugugaacauuagcaauacuaacuucgcugcagggcaguccguagugucugucaaacuggccggaaauucgucauugugcccugugagcggcugggcgaucuacaguaaggacaacuccauaagaauugguucuaaaggggauguuuuugugaucagggagccauucauuagcuguuccccguuagaaugccggaccuuuuuccugacacagggagcucuacucaaugacaagcauucaaacggcaccaucaaagaucgcagucccuaucgaacucugaugagcuguccuaucggcgaggucccaucucccuacaacucccguuuugaaucaguggccuggagcgcaagugccugccacgacgggauuaauuggcuuacaauaggaaucucugguccugauaacggcgcuguagcaguucugaaguauaaugggauuaucaccgacacgauaaaguccuggagaaacaauauuuugaggacucaagagagcgagugugccugcgugaacggaucguguuucaccgucaugacagauggcccaucugacggucaggcuuccuacaaaaucuuucggaucgaaaaggggaaaauugugaagucaguggagaugaaugcccccaacuaucauuacgaagagugcaguuguuacccugauagcaaugagaucacuugcgucugccgcgacaacuggcacggauccaauagaccauggguuucuuucaaccagaaucucgaauaucagauuggcuacauauguagcggcaucuuuggggauaacccgaggcccaaugacaaaaccggaucaugcgguccugugaguuccaacggcgcgaacgggguaaagggauucagcuuuaaguauggcaaugguguguggauugggcggacaaaaucuaucucaagucgcaacggcuucgagaugaucugggauccaaauggauggaccggcacggacaacaauuuuagcauuaagcaagacauagucgggaucaacgaaugguccggauacucugguucguucgugcagcaucccgagcugacuggccuggauuguauucgaccuugcuucuggguugaacucaucagagggaggccaaaagagaauacaauuuggaccagcggauccucaaucaguuuuuguggcgugaacucugacacugucgguuggagcuggcccgauggggcagaguuaccguucacaauagacaaguga

SEQ ID NO: 142307 - RNA, 1410 nt, Artificial Sequence; identical to SEQ ID NO: 138754
  derived and/or modified sequence opt3 from neuraminidase__InfluenzaA__ADX96339

SEQ ID NO: 142308 - RNA, 1410 nt, Artificial Sequence
  derived and/or modified sequence opt3 from neuraminidase__InfluenzaA__ADX96349
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcaaugagauuacuugcgucugccgcgacaacuggcacggguccaauagaccauggguuucuuucaaccagaaucucgaauaucagauaggauacaucuguagcggcauuuuuggcgauaacccgaggcccaaugacaaaaccgggucaugcggaccugugaguuccaacggugcgaacggcguaaagggguucagcuuuaaguauggaaauggcguguggaucggucggacaaaaucuaucucaagucgcaacggguucgagaugauuugggauccaaauggcuggaccggaacggacaacaauuuuagcauaaagcaagacaucgucggcauuaacgaaugguccggguacucuggaucguucgugcagcaucccgagcugacuggucuggauuguauccgaccuugcuucuggguugaacucauuagaggcaggccaaaagagaauacaaucuggaccagcggguccucaauaaguuuuuguggagugaacucugacacugucggcuggagcuggcccgauggugcagaguuaccguucacaaucgacaaguga

SEQ ID NO: 142309 - RNA, 1410 nt, Artificial Sequence; identical to SEQ ID NO: 138754
  derived and/or modified sequence opt3 from neuraminidase__InfluenzaA__ADX96359

SEQ ID NO: 142310 - RNA, 1410 nt, Artificial Sequence; identical to SEQ ID NO: 138754
  derived and/or modified sequence opt3 from neuraminidase__InfluenzaA__ADX96369

SEQ ID NO: 142311 - RNA, 1410 nt, Artificial Sequence
  derived and/or modified sequence opt3 from neuraminidase__InfluenzaA__ADX96380
augaaccccaaucagaagaucauuaccauaggcagcgugugcaugacaaucgggauggccaaccugauucuccaaaucggaaauauuaucuccauauggccuguccacucuauccagcuugguaaccagaaucagauugagacuuguaaccaaucaguuaucacguacgaaaauaacaccugggugaaucagacauauguaaacauuaguaauacuaacuucgcugcaggccagagcguggucuccaugaaacuggccgggaacucuucguugugcccagugggaggcugggcgaucuacucaaaggacaauagcguuagaauagguaguaaaggggauguguuugucauuagggagccguucaucuccuguucucccuuagaaugccggaccuuuuuccugacacagggagcucuacucaaugacaagcauagcaacggcaccauuaaagaucgcuccccuuaucgaacucugaugucauguccaaucggcgaggugcccaguccuuacaacagccguuuugaaucuguagccugguccgcaucagccugccacgacgggaucaauuggcuuacaauuggaauaagcgguccagauaacggcgcuguugcagugcugaaguauaaugggaucauuaccgacacgaucaagaguuggagaaacaauauauugaggacucaagagucugagugugccugcgucaacggauccuguuucaccgugaugacagauggccccagcgacggucaggcuucguacaaaauuuuucggaucgaaaaggggaaaaucguggagucugucgaaaugaaugccccuaacuaucauuacgaggagugcuccuguuacccagauucaagugaaauuacuugcguuugccgcgacaauuggcacggaagcaacagaccguggguguccuucaaucagaaccucgaguaucagaucggcuacauuuguucuggcauauuuggggauaaucccaggccuaacgacaagaccggaagcugcgguccaguaucaaguaauggcgcgaacggggugaaaggauucuccuuuaaguauggcaacggugucuggaucgggcggacaaagagcauuucuucacgcaauggcuucgaaaugaucugggaucccaacggauggaccggcacggacaauaacuuuaguaucaaacaagacauuguggggauaaaugaguggagcggauacuccgguucuuucguucagcauccugaacugacuggccuggauuguauccgaccaugcuucuggguggagcucauuagagggaggcccaaggagaacacaaucuggaccucgggaagcuccauuucauuuuguggcgucaauagugacacuguggguuggucuuggccggauggggcagaauuaccuuucacaaucgacaaauga

SEQ ID NO: 142312 - RNA, 1410 nt, Artificial Sequence
  derived and/or modified sequence opt3 from neuraminidase__InfluenzaA__ADX96390
augaaccccaaucagaagaucauuaccauaggcagcgugugcaugacaaucgggauggccaaccugauucuccaaaucggaaauauuaucuccauauggcuuucucacucaauccagcuggguaaccagaaucagauugagacuuguaaccaaagugucaucacguacgaaaauaacaccuggguuaaucagacauaugugaacauuagcaauacuaacuucgcugcaggccaguccguagugucugucaaauuggccggaaauucgucauuaugcccugugagcggaugggcgaucuacaguaaggacaacuccauaagaauuggcucuaaaggugauguuuuugugaucagggagccauucauuagcuguuccccgcuggaaugccggaccuuuuuccuaacacagggggcucuccugaaugacaagcauucaaacggaaccaucaaagaucgcagucccuaucgaacucuuaugagcuguccuaucggcgaggucccaucucccuacaacucccguuuugaaucaguggccuggagcgcaagugccugccacgacggcauuaauuggcugacaauagggaucucuggaccugauaacggugcuguagcaguuuugaaguauaauggcauuaucaccgacacgauaaaguccuggagaaacaauauucucaggacucaagagagcgagugugccugcgugaacgggucguguuucaccgucaugacagauggaccaucugacggccaggcuuccuacaaaaucuuucggaucgaaaaggguaaaauugugaagucaguggagaugaaugcccccaacuaucauuacgaagagugcaguuguuacccugauagcuccgagaucacuugcgucugccgcgacaauuggcacgggucuaacagaccauggguuagcuucaaucagaaccuggaauaucagauuggauacauauguucaggcaucuuuggcgauaauccgaggcccaacgacaaaaccgggaguugcggaccuguguccagcaauggugcgaacggcguaaagggguucucuuuuaaguauggaaacggcguguggauuggucggacaaaaucaaucaguagccgcaauggguucgagaugaucugggauccaaacggcuggaccggaacggacaauaacuuuuccauuaagcaagacauagucggcaucaaugaauggucuggguacucggggagcuucgugcagcaucccgagcugacuggucucgauuguauucgaccuugcuucuggguugaauuaaucagaggcaggccaaaagagaacacaauuuggaccuccgggucaaguaucucuuuuuguggagugaauagcgacacugucggcugguccuggcccgauggugcagagcugccguucacaauagacaaguga

SEQ ID NO: 142313 - RNA, 1410 nt, Artificial Sequence; identical to SEQ ID NO: 138754
  derived and/or modified sequence opt3 from neuraminidase__InfluenzaA__ADX96400

SEQ ID NO: 142314 - RNA, 1410 nt, Artificial Sequence; identical to SEQ ID NO: 138754
  derived and/or modified sequence opt3 from neuraminidase__InfluenzaA__ADX96410

SEQ ID NO: 142315 - RNA, 1410 nt, Artificial Sequence; identical to SEQ ID NO: 138754
  derived and/or modified sequence opt3 from neuraminidase__InfluenzaA__ADX96419

SEQ ID NO: 142316 - RNA, 1410 nt, Artificial Sequence
  derived and/or modified sequence opt3 from neuraminidase__InfluenzaA__ADX96429
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucuaauggccaggcuuccuacaaaaucuuucggaucgaaaaggguaaaauugugaagucagucgagaugaacgcccccaauuaucauuacgaagagugcaguuguuacccugacagcuccgagaucacuugcguuugccgcgauaacuggcacgggucuaauagaccaugggugagcuucaaccagaaucucgaauaucagauuggauacauauguucaggcaucuuuggcgacaacccgaggcccaaugauaaaaccgggaguugcggaccuguauccagcaacggugcgaacggcgugaagggguucucuuuuaaguauggaaauggcgucuggauuggucggacaaaaucaaucaguagccgcaacggguucgagaugaucugggacccaaauggcuggaccggaacggauaacaauuuuuccauuaagcaagacauagugcgaaucaacgaauggucuggcuacucggggagcuucguucagcaucccgagcugacuggacuggacuguauuagaccuugcuucuggguggaacucaucaggggucggccaaaagagaauacaauuuggaccuccggcucaaguaucucuuuuuguggggucaacagcgauacugugggaugguccuggcccgacggcgcagaguuaccguucacaauagauaaguga

SEQ ID NO: 142317 - RNA, 1410 nt, Artificial Sequence; identical to SEQ ID NO: 138754
  derived and/or modified sequence opt3 from neuraminidase__InfluenzaA__ADX96449

SEQ ID NO: 142318 - RNA, 1410 nt, Artificial Sequence; identical to SEQ ID NO: 138754
  derived and/or modified sequence opt3 from neuraminidase__InfluenzaA__ADX96469

SEQ ID NO: 142319 - RNA, 1410 nt, Artificial Sequence; identical to SEQ ID NO: 138754
  derived and/or modified sequence opt3 from neuraminidase__InfluenzaA__ADX96489

SEQ ID NO: 142320 - RNA, 1410 nt, Artificial Sequence; identical to SEQ ID NO: 138754
  derived and/or modified sequence opt3 from neuraminidase__InfluenzaA__ADX96499

SEQ ID NO: 142321 - RNA, 1410 nt, Artificial Sequence
  derived and/or modified sequence opt3 from neuraminidase__InfluenzaA__ADX96509
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaauggugauguuuuugugauuagggagccauucaucagcuguuccccguuagaaugccggaccuuuuuccugacacagggggcucuacucaacgacaaacauucaaacggaaccaucaaggaucgcagucccuaucgaacucugaugagcuguccuauuggcgaggucccaucucccuacaauucccguuuugaaucaguggccuggagcgcaagugccugccacgacggcauaaacuggcuuacaaucgggauuucuggaccugauaauggugcuguagcaguucugaaauauaacggcaucauaaccgacacgauuaaguccuggagaaauaacaucuugaggacucaagagagcgagugugccugcgugaaugggucguguuucaccgucaugacagauggaccaucugacggccaggcuuccuacaagaucuuucggauugaaaaagguaagaucgugaaaucaguggagaugaacgcccccaauuaucauuacgaagagugcaguuguuacccugauagcuccgagauuacuugcgucugccgcgacaacuggcacgggucuaauagaccauggguuagcuucaaccagaaucucgaauaucagauaggauacaucuguucaggcauuuuuggcgauaacccgaggcccaaugacaagaccgggaguugcggaccuguguccagcaacggugcgaacggcguaaaaggguucucuuuuaaguauggaaauggcguguggaucggucggacaaagucaaucaguagccgcaacggguucgagaugauuugggauccaaauggcuggaccggaacggacaacaauuuuuccauaaaacaagacaucgucggcauuaacgaauggucuggguacucggggagcuucgugcagcaucccgagcugacuggucuggauuguauccgaccuugcuucuggguugaacucauuagaggcaggccaaaggagaauacaaucuggaccuccgggucaaguauaucuuuuuguggagugaacagcgacacugucggcugguccuggcccgauggugcagaguuaccguucacaaucgacaaauga

SEQ ID NO: 142322 - RNA, 1410 nt, Artificial Sequence; identical to SEQ ID NO: 138754
  derived and/or modified sequence opt3 from neuraminidase__InfluenzaA__ADX96519

SEQ ID NO: 142323 - RNA, 1410 nt, Artificial Sequence; identical to SEQ ID NO: 138754
  derived and/or modified sequence opt3 from neuraminidase__InfluenzaA__ADX96529

SEQ ID NO: 142324 - RNA, 1410 nt, Artificial Sequence; identical to SEQ ID NO: 138754
  derived and/or modified sequence opt3 from neuraminidase__InfluenzaA__ADX96539

SEQ ID NO: 142325 - RNA, 1410 nt, Artificial Sequence; identical to SEQ ID NO: 138754
  derived and/or modified sequence opt3 from neuraminidase__InfluenzaA__ADX96549

SEQ ID NO: 142326 - RNA, 1410 nt, Artificial Sequence; identical to SEQ ID NO: 138754
  derived and/or modified sequence opt3 from neuraminidase__InfluenzaA__ADX96559

SEQ ID NO: 142327 - RNA, 1410 nt, Artificial Sequence; identical to SEQ ID NO: 138754
  derived and/or modified sequence opt3 from neuraminidase__InfluenzaA__ADX96569

SEQ ID NO: 142328 - RNA, 1410 nt, Artificial Sequence; identical to SEQ ID NO: 138744
  derived and/or modified sequence opt3 from neuraminidase__InfluenzaA__ADX96579

SEQ ID NO: 142329 - RNA, 1410 nt, Artificial Sequence; identical to SEQ ID NO: 138754
  derived and/or modified sequence opt3 from neuraminidase__InfluenzaA__ADX96589

SEQ ID NO: 142330 - RNA, 1410 nt, Artificial Sequence; identical to SEQ ID NO: 138754
  derived and/or modified sequence opt3 from neuraminidase__InfluenzaA__ADX96599

SEQ ID NO: 142331 - RNA, 1410 nt, Artificial Sequence
  derived and/or modified sequence opt3 from neuraminidase__InfluenzaA__ADX96609
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaacucgucauugugcccugugggaggcugggcgauauacagcaaggacaauaguguuagaauugguuccaaaggggauguguuugucaucagggagccauucauuucuuguagcccguuagaaugccggaccuuuuuccugacacagggagcucuacucaaugacaagcauuccaacggcaccaucaaagaucgcucacccuaucgaacucugaugaguuguccuaucggcgaggugccaagccccuacaacucucguuuugaauccguagccuggucagcaagcgccugccacgacgggauuaauuggcuuacaauaggaaucagugguccugauaacggcgcuguugcagugcugaaguauaaugggauuaucaccgacacgauaaagucuuggagaaacaauauuuugaggacucaagaguccgagugugccugcgucaacggaagcuguuucaccgugaugacagauggcccaucgaauggucaggcuucuuacaaaaucuuucggaucgaaaaggggaaaauugugaaguccgucgagaugaacgcccccaauuaucauuacgaagagugcucauguuacccugacaguagcgagaucacuugcguuugccgcgauaacuggcacggauccaauagaccaugggugucuuucaaccagaaucucgaauaucagauuggcuacauauguagcggcaucuuuggggacaacccgaggcccaaugauaaaaccggaucaugcgguccuguaaguuccaacggcgcgaacggggugaagggauucagcuuuaaguauggcgacggugucuggauugggcggacaaaaucuaucucaagucgcaauggcuucgagaugaucugggauccaaacggauggaccggcacggacaauaacuuuagcauuaagcaagacauaguggggaucaaugaaugguccggauacucugguucguucguucagcaucccgagcugacuggccuggauuguauucgaccuugcuucuggguggaacucaucagagggaggccaaaagagaacacaauuuggaccagcggauccucaaucaguuuuuguggcgucaauucugacacuguggguuggagcuggcccgauggggcagaguuaccguucacaauagacaaguga

SEQ ID NO: 142332 - RNA, 1410 nt, Artificial Sequence; identical to SEQ ID NO: 138744
  derived and/or modified sequence opt3 from neuraminidase__InfluenzaA__ADX96619

SEQ ID NO: 142333 - RNA, 1410 nt, Artificial Sequence; identical to SEQ ID NO: 138754
  derived and/or modified sequence opt3 from neuraminidase__InfluenzaA__ADX96629

SEQ ID NO: 142334 - RNA, 1410 nt, Artificial Sequence; identical to SEQ ID NO: 138754
  derived and/or modified sequence opt3 from neuraminidase__InfluenzaA__ADX96639

SEQ ID NO: 142335 - RNA, 1410 nt, Artificial Sequence; identical to SEQ ID NO: 138754
  derived and/or modified sequence opt3 from neuraminidase__InfluenzaA__ADX96649

SEQ ID NO: 142336 - RNA, 1410 nt, Artificial Sequence; identical to SEQ ID NO: 138744
  derived and/or modified sequence opt3 from neuraminidase__InfluenzaA__ADX96659

SEQ ID NO: 142337 - RNA, 1410 nt, Artificial Sequence; identical to SEQ ID NO: 138754
  derived and/or modified sequence opt3 from neuraminidase__InfluenzaA__ADX96669

SEQ ID NO: 142338 - RNA, 1410 nt, Artificial Sequence; identical to SEQ ID NO: 138754
  derived and/or modified sequence opt3 from neuraminidase__InfluenzaA__ADX96679

SEQ ID NO: 142339 - RNA, 1410 nt, Artificial Sequence; identical to SEQ ID NO: 138754
  derived and/or modified sequence opt3 from neuraminidase__InfluenzaA__ADX96689

SEQ ID NO: 142340 - RNA, 1410 nt, Artificial Sequence; identical to SEQ ID NO: 138754
  derived and/or modified sequence opt3 from neuraminidase__InfluenzaA__ADX96699

SEQ ID NO: 142341 - RNA, 1410 nt, Artificial Sequence
  derived and/or modified sequence opt3 from neuraminidase__InfluenzaA__ADX96709
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagauuaaugcccccaacuaucauuacgaagagugcaguuguuacccugauagcuccgagauaacuugcgucugccgcgacaauuggcacgggucuaacagaccauggguuagcuucaaucagaaccucgaauaucagaucggauacauuuguucaggcaucuuuggcgauaauccgaggcccaacgacgagaccgggaguugcggaccuguguccagcaauggugcgaacggcguaaaaggguucucuuuuaaguauggaaacggcguguggaucggucggacaaagucaauuaguagccgcaauggguucgaaaugauaugggauccaaacggcuggaccggaacggacaauaacuuuuccaucaaacaagacauugucggcaucaaugaguggucuggguacucggggagcuucgugcagcaucccgaacugacuggucuggauuguauucgaccuugcuucuggguugagcucaucagaggcaggccaaaggagaacacaauauggaccuccgggucaaguaucucuuuuuguggagugaauagcgacacugucggcugguccuggcccgauggugcagaauuaccguucacaauugacaaauga

SEQ ID NO: 142342 - RNA, 1410 nt, Artificial Sequence
  derived and/or modified sequence opt3 from neuraminidase__InfluenzaA__ADX96719
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaauuugccggaaauucgucacugugcccugugagcggaugggcgauauacaguaaggacaacuccauuagaaucggcucuaaaggugauguuuucgugauuagggagccauuuaucagcuguuccccguuggaaugccggaccuucuuuuuaacacagggggcucugcuaaaugacaagcauucaaacggaaccaucaaagaucgcagucccuaucgaacucucaugagcuguccuauuggcgaggucccaucucccuacaacucccguuucgaaucaguggccuggagcgcaagugccugccacgacggcauaaauuggcugacaaucgggauuucuggaccugauaacggugcuguagcaguucuuaaguauaauggcaucauaaccgacacgauuaaguccuggagaaacaauauccugaggacucaagagagcgagugugccugcgugaacgggucguguuuuaccgucaugacagauggaccaucugacggccaggcuuccuacaaaaucuuccggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuuuaaucagaacuuggaauaucagauaggauacaucuguucaggcauuuucggcgauaauccgaggcccaacgacaaaaccgggaguugcggaccuguguccagcaauggugcgaacggcguaaagggguuuucuuucaaguauggaaacggcguguggaucggucggacaaaaucaaucaguagccgcaauggguuugagaugauuugggauccaaacggcuggaccggaacggacaauaacuucuccauaaagcaagacaucgucggcauuaaugaauggucuggguacucggggagcuucgugcagcaucccgagcucacuggucuggauuguauccgaccuugcuuuuggguugaacugauuagaggcaggccaaaagaguccacaguguggaccucagggaguucuaucagcuucuguggagucaacuccgacacugugggcuggucauggcccgauggugcagagcucccguuuacaauagacaaguga

SEQ ID NO: 142343 - RNA, 1410 nt, Artificial Sequence; identical to SEQ ID NO: 138754
  derived and/or modified sequence opt3 from neuraminidase__InfluenzaA__ADX96729

SEQ ID NO: 142344 - RNA, 1410 nt, Artificial Sequence
  derived and/or modified sequence opt3 from neuraminidase__InfluenzaA__ADX96739
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagucaagagcgacacugugggcugguccuggcccgauggugcagaguuaccguucacaaucgacaaauga

SEQ ID NO: 142345 - RNA, 1410 nt, Artificial Sequence; identical to SEQ ID NO: 138754
  derived and/or modified sequence opt3 from neuraminidase__InfluenzaA__ADX96749

SEQ ID NO: 142346 - RNA, 1410 nt, Artificial Sequence; identical to SEQ ID NO: 138754
  derived and/or modified sequence opt3 from neuraminidase__InfluenzaA__ADX96759

SEQ ID NO: 142347 - RNA, 1410 nt, Artificial Sequence; identical to SEQ ID NO: 139728
  derived and/or modified sequence opt3 from neuraminidase__InfluenzaA__ADX96769

SEQ ID NO: 142348 - RNA, 1410 nt, Artificial Sequence; identical to SEQ ID NO: 138754
  derived and/or modified sequence opt3 from neuraminidase__InfluenzaA__ADX96779

SEQ ID NO: 142349 - RNA, 1410 nt, Artificial Sequence
  derived and/or modified sequence opt3 from neuraminidase__InfluenzaA__ADX96789
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucucugaaauuggccggaaauucgucauuaugcccugucagcggaugggcgauauacaguaaggacaacuccauuagaaucggcucuaaaggugauguguuuguuauuagggagccauucaucagcuguuccccgcuggaaugccggaccuuuuuccuaacacagggggcucuccugaaugacaagcauucaaacggaaccaucaaagaucgcagucccuaucgaacucuuaugagcuguccuauuggcgaggugccaucucccuacaacucccguuuugaaucagucgccuggagcgcaagugccugccacgacggcauaaauuggcugacaaucgggauuucuggaccugauaacggugcuguggcaguauugaaguauaauggcaucauaaccgacacgauuaaguccuggagaaacaauauccucaggacucaagagagcgagugugccugcguuaacgggucguguuucaccgugaugacagauggaccaucugacggccaggcuuccuacaaaaucuuucggauugaaaaggguaaaaucgucaagucaguggagaugaaugcccccaacuaucauuacgaagagugcaguuguuacccugauagcuccgagauuacuugcgugugccgcgacaauuggcacgggucuaacagaccaugggucagcuucaaucagaaccuggaauaucagauaggauacaucuguucaggcauuuuuggcgauaauccgaggcccaacgacaaaaccgggaguugcggaccuguuuccagcaauggugcgaacggcgugaagggguucucuuuuaaguauggaaacggcguauggaucggucggacaaaaucaaucaguagccgcaauggguucgagaugauuugggauccaaacggcuggaccggaacggacaauaacuuuuccauaaagcaagacaucgugggcauuaaugaauggucuggguacucggggagcuucguccagcaucccgagcugacuggucucgauuguauccgaccuugcuucuggguggaauuaauuagaggcaggccaaaagagaacacaaucuggaccuccgggucaaguauaucuuuuuguggaguuaauagcgacacugugggcugguccuggcccgauggugcagagcugccguucacaaucgacaaguga

SEQ ID NO: 142350 - RNA, 1410 nt, Artificial Sequence; identical to SEQ ID NO: 138754
  derived and/or modified sequence opt3 from neuraminidase__InfluenzaA__ADX96799

SEQ ID NO: 142351 - RNA, 1410 nt, Artificial Sequence; identical to SEQ ID NO: 138909
  derived and/or modified sequence opt3 from neuraminidase__InfluenzaA__ADX96809

SEQ ID NO: 142352 - RNA, 1410 nt, Artificial Sequence; identical to SEQ ID NO: 138754
  derived and/or modified sequence opt3 from neuraminidase__InfluenzaA__ADX96819

SEQ ID NO: 142353 - RNA, 1410 nt, Artificial Sequence; identical to SEQ ID NO: 139977
  derived and/or modified sequence opt3 from neuraminidase__InfluenzaA__ADX96829

SEQ ID NO: 142354 - RNA, 1410 nt, Artificial Sequence
  derived and/or modified sequence opt3 from neuraminidase__InfluenzaA__ADX96839
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacaauguuagaauuggcuccaaaggugauguguuugucaucagggagccauucauuucuuguagcccguuagaaugccggaccuuuuuccugacacagggggcucuacucaacgacaagcauuccaacggaaccaucaaagaucgcucacccuaucgaacucugaugaguuguccuaucggcgaggugccaagccccuacaauucucguuuugaauccguagccuggucagcaagcgccugccacgacggcauuaacuggcuuacaauagggaucaguggaccugauaauggugcuguugcagugcugaaguauaacggcauuaucaccgacacgauaaagucuuggagaaauaacauuuugaggacucaagaguccgagugugccugcgucaaugggagcuguuucaccgugaugacagauggaccaucggacggccaggcuucuuacaaaaucuuucggaucgaaaaggguaaaauugugaaguccgucgagaugaacgcccccaauuaucauuacgaagagugcucauguuacccugauaguagcgagaucacuugcguuugccgcgacaacuggcacggguccaauagaccaugggugucuuucaaccagaaucucgaauaucagauuggauacauauguagcggcaucuuuggcgauaacccgaggcccaaugacaaaaccgggucaugcggaccuguaaguuccaacggugcgaacggcgugaagggguucagcuuuaaguauggaaauggcgucuggauuggucggacaaaaucuaucucaagucgcaacggguucgagaugaucugggauccaaauggcuggaccggaacggacaacaauuuuagcauuaagcaagacauagugggcaucaacgaaugguccggguacucuggaucguucguucagcaucccgagcugacuggucuggauuguauucgaccuugcuucuggguggaacucaucagaggcaggccaaaagagaauacaauuuggaccagcggguccucaaucaguuuuuguggagucaacucugacacugugggcuggagcuggcccgauggugcagaguuaccguucacaauagacaaguga

SEQ ID NO: 142355 - RNA, 1410 nt, Artificial Sequence; identical to SEQ ID NO: 138754
  derived and/or modified sequence opt3 from neuraminidase__InfluenzaA__ADX96849

SEQ ID NO: 142356 - RNA, 1410 nt, Artificial Sequence; identical to SEQ ID NO: 138754
  derived and/or modified sequence opt3 from neuraminidase__InfluenzaA__ADX96859

SEQ ID NO: 142357 - RNA, 1410 nt, Artificial Sequence; identical to SEQ ID NO: 139977
  derived and/or modified sequence opt3 from neuraminidase__InfluenzaA__ADX96869

SEQ ID NO: 142358 - RNA, 1410 nt, Artificial Sequence; identical to SEQ ID NO: 138754
  derived and/or modified sequence opt3 from neuraminidase__InfluenzaA__ADX96879

SEQ ID NO: 142359 - RNA, 1410 nt, Artificial Sequence; identical to SEQ ID NO: 138754
  derived and/or modified sequence opt3 from neuraminidase__InfluenzaA__ADX96899

SEQ ID NO: 142360 - RNA, 1410 nt, Artificial Sequence
  derived and/or modified sequence opt3 from neuraminidase__InfluenzaA__ADX96909
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacgauaucuugaggacucaagagagcgagugugccugcgugaaugggucguguuucaccgucaugacagacggaccaucugauggccaggcuuccuacaaaaucuuucggauugaaaaggguaaaaucgugaagucaguggagauuaacgcccccaauuaucauuacgaagagugcaguuguuacccugacagcuccgagauaacuugcgucugccgcgauaacuggcacgggucuaauagaccauggguuagcuucaaccagaaucucgaauaucagaucggauacauuuguucaggcaucuuuggcgacaacccgaggcccaaugauaaaaccgggaguugcggaccuguguccagcaacggugcgaauggcguaaagggguucucuuuuaaguauggaaacggcguguggaucggucggacaaaaucaauuaacagucgcaauggguucgagaugauaugggacccaaacggcuggaccggaacggacaauaacuuuagcaucaagcaagauauugucggcaucaaugaaugguccggguacucuggaucguucgugcagcaucccgagcugacuggucuggacuguauucgaccuugcuucuggguugaacucaucagaggcaggccaaaagagaacacaauauggaccagcggguccucaaucaguuuuuguggagucaauucugauacugugggcuggagcuggcccgacggugcagaguuaccguucacaauugauaaguga

SEQ ID NO: 142361 - RNA, 1410 nt, Artificial Sequence; identical to SEQ ID NO: 138754
  derived and/or modified sequence opt3 from neuraminidase__InfluenzaA__ADX96919

SEQ ID NO: 142362 - RNA, 1410 nt, Artificial Sequence; identical to SEQ ID NO: 138754
  derived and/or modified sequence opt3 from neuraminidase__InfluenzaA__ADX96929

SEQ ID NO: 142363 - RNA, 1410 nt, Artificial Sequence; identical to SEQ ID NO: 138754
  derived and/or modified sequence opt3 from neuraminidase__InfluenzaA__ADX96939

SEQ ID NO: 142364 - RNA, 1410 nt, Artificial Sequence; identical to SEQ ID NO: 139337
  derived and/or modified sequence opt3 from neuraminidase__InfluenzaA__ADX96949

SEQ ID NO: 142365 - RNA, 1410 nt, Artificial Sequence; identical to SEQ ID NO: 138754
  derived and/or modified sequence opt3 from neuraminidase__InfluenzaA__ADX96959

SEQ ID NO: 142366 - RNA, 1410 nt, Artificial Sequence
  derived and/or modified sequence opt3 from neuraminidase__InfluenzaA__ADX96969
augaaccccaaucagaugaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaagcuggccggaaauucgucauugugcccugugagcggaugggcgauauacaguaaagacaacuccguuagaauuggcucuaagggugauguguuugucaucagggagccauucauuagcuguuccccguuagaaugccggaccuuuuuccugacacagggggcucuacucaaugacaaacauucaaacggaaccaucaaggaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaauauaauggcauuaucaccgacacgauaaaguccuggagaaacaauauuuugaggacucaagagagcgagugugccugcgucaacgggucguguuucaccgugaugacagauggaccaucuaauggccaggcuuccuacaagaucuuucggaucgaaaaagguaagauugugaaaucagucgagaugaacgcccccaauuaucauuacgaagagugcaguuguuacccugacagcuccgagaucacuugcguuugccgcgauaacuggcacgggucuaauagaccaugggugagcuucaaccagaaucucgaauaucagauuggauacauauguucaggcaucuuuggcgacaacccgaggcccaaugauaagaccgggaguugcggaccuguauccagcaacggugcgaacggcgugaaaggguucucuuuuaaguauggaaauggcgucuggauuggucggacaaagucaaucaguagccgcaacggguucgagaugaucugggacccaaauggcuggaccggaacggauaacaauuuuuccauuaaacaagacauagugggcaucaacgaauggucuggguacucggggagcuucguucagcaucccgagcugacuggucuggacuguauucgaccuugcuucuggguggaacucaucagaggcaggccaaaggagaauacaauuuggaccuccgggucaaguaucucuuuuuguggagucaacagcgauacugugggcugguccuggcccgacggugcagaguuaccguucacaauagauaaauga

SEQ ID NO: 142367 - RNA, 1410 nt, Artificial Sequence; identical to SEQ ID NO: 139977
  derived and/or modified sequence opt3 from neuraminidase__InfluenzaA__ADX96979

SEQ ID NO: 142368 - RNA, 1410 nt, Artificial Sequence; identical to SEQ ID NO: 139977
  derived and/or modified sequence opt3 from neuraminidase__InfluenzaA__ADX96989

SEQ ID NO: 142369 - RNA, 1407 nt, Artificial Sequence
  derived and/or modified sequence opt3 from neuraminidase__InfluenzaA__ADX96999
augaaccccaaucagaagaucauuaccauaggcagcgugugcaugacaaucgggauggccaaccugauucuccaaaucggaauuaucuccauauggaucucucacucaauucagcuugguaaucagaaccagaucgagacuuguaaucaaagugucauuacguacgaaaacaauaccuggguuaaccagacauaugugaauaucagcaacacuaauuucgcugcaggccaguccguagugucugucaaacuggccgggaacucgucauugugcccugugagcggaugggcgauauacaguaaggacaauuccauuagaaucggcucuaaaggugauguuuuugugauuagggagccauucaucagcuguuccccguuagaaugccggaccuuuuuccugacacagggggcucuacucaacgacaagcauucaaauggaaccaucaaagaucgcagucccuaucgaacucugaugagcuguccuauuggcgaggucccaucucccuacaacucccguuuugaaucaguggccuggagcgcaagugccugccacgacggcauaaacuggcuuacaaucgggauuucuggaccugauaauggugcuguagcaguucugaaguauaacggcaucauaaccgacacgauuaaguccuggagaaauaacaucuugaggacucaagagagcgagugugccugcgugaaugggucguguuucaccgucaugacagauggaccaucuaacggccaggcuuccuacaaaaucuuucggauugaaaaggguaaaaucgugaagucaguggagaugaaugcccccaacuaucauuacgaagagugcaguuguuacccugacagcuccgagauuacuugcgucugccgcgauaauuggcacgggucuaacagaccauggguuagcuucaaucagaaccucgaauaucagauaggauacaucuguucaggcauuuuuggcgacaauccgaggcccaacgauaaaaccgggaguugcggaccuguguccagcaauggugcgaacggcguaaagggguucucuuuuaaguauggaaacggcguguggaucggucggacaaaaucaaucaguagccgcaauggguucgagaugauuugggacccaaacggcuggaccggaacggauaauaacuuuuccauaaagcaagacaucgucggcauuaaugaauggucuggguacucggguagcuucgugcagcaucccgagcugacuggacuggacuguauccgaccuugcuucuggguugaacucauuagaggcaggccaaaagagaacacaaucuggaccuccgggucaaguauaucuuuuuguggagugaauagcgauacugucggcugguccuggcccgacggugcagaguuaccguucacaaucgauaaguga

SEQ ID NO: 142370 - RNA, 1410 nt, Artificial Sequence; identical to SEQ ID NO: 138754
  derived and/or modified sequence opt3 from neuraminidase__InfluenzaA__ADX97009

SEQ ID NO: 142371 - RNA, 1410 nt, Artificial Sequence; identical to SEQ ID NO: 138909
  derived and/or modified sequence opt3 from neuraminidase__InfluenzaA__ADX97020

SEQ ID NO: 142372 - RNA, 1410 nt, Artificial Sequence
  derived and/or modified sequence opt3 from neuraminidase__InfluenzaA__ADX97030
augaaccccaaucagaagaucauuaccauaggcagcgugugcaugaucauugggauggccaaccugaugcuccaaaucggaaauauuaucuccauauggaucucucacucaauucagcuugguaaccagaaucagaucgagacauguaaccaaagugucauuacuuacgaaaauaacacguggguuaaucagaccuaugugaacaucagcaauacaaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguuccccguuagaaugccggaccuuuuuccugacucagggggcucuacucaaugacaagcauucaaacggaacaaucaaagaucgcagucccuaucgaacccugaugagcuguccuaucggcgaggugccaucucccuacaacucccguuuugaaucaguagccuggagcgcaagugccugccacgacggcauuaauuggcuuacuauagggaucucuggaccugauaacggugcuguugcagugcugaaguauaauggcauuaucacagacaccauaaaguccuggagaaacaauauuuugaggacgcaagagagcgagugugccugcgucaacgggucguguuucacugugaugaccgauggaccaucugacggccaggcuuccuacaaaaucuuucggaucgaaaaggguaaaauugugaagucagucgagaugaaugcccccaacuaucauuacgaagagugcaguuguuacccugauagcuccgagaucacaugcguuugccgcgacaauuggcacgggucuaacagaccaugggugagcuucaaucagaaccucgaauaucagauuggauacauauguucaggcaucuuuggcgauaauccgaggcccaacgacaaaacugggaguugcggaccuguauccagcaauggugcgaacggcgugaagggguucucuuuuaaguauggaaacggcgucuggauuggucggaccaaaucaaucaguagccgcaauggguucgagaugaucugggauccaaacggcuggacaggaaccgacaauaacuuuuccauuaagcaagacauagugggcaucaaugaauggucuggguacucggggagcuucguucagcaucccgagcugacgggucuggauuguauucgaccuugcuucuggguggaacucaucagaggcaggccaaaagagaacacuauuuggacauccgggucaaguaucucuuuuuguggagucaauagcgacaccgugggcugguccuggcccgauggugcagaguuaccguucacuauagacaaguga

SEQ ID NO: 142373 - RNA, 1410 nt, Artificial Sequence; identical to SEQ ID NO: 140302
  derived and/or modified sequence opt3 from neuraminidase__InfluenzaA__ADX98643

SEQ ID NO: 142374 - RNA, 1410 nt, Artificial Sequence; identical to SEQ ID NO: 138754
  derived and/or modified sequence opt3 from neuraminidase__InfluenzaA__ADX98653

SEQ ID NO: 142375 - RNA, 1410 nt, Artificial Sequence
  derived and/or modified sequence opt3 from neuraminidase__InfluenzaA__ADX98668
augaaccccaaucagaagaucauuaccauaggcagcaucugcauuacaaucgggauggccaaccugauucuccaaaucggaaauauaaucuccauuuggaucucucacucaauucagcuugguaaccagaaucagaucgagacuuguaaccaaagugugauaacguacgaaaauaacaccugggucaaucagacauauguuaacauuagcaauacuaacuucgcugcaggccaguccgugguaucugugaaacuggccggaaauucgucauugugcccugucagcggaugggcgaucuacaguaaggacaacuccauuagaaucggcucuaaaggugauguguuuguuaucagggagccauucauuagcuguuccccguuagaaugccggaccuuuuuccugacacagggggcucuacucaaugacaagcauucaaacggaaccauaaaagaucgcagucccuaucgaacucugaugagcuguccuaucggcgaggugccaucucccuacaacucccguuuugaaucagucgccuggagcgcaagugccugccacgacggcauuaauuggcuuacaaucgggauaucuggaccugauaacggugcuguggcaguacugaaguauaauggcauuaucaccgacacgaucaaguccuggagaaacaauauuuugaggacucaagagagcgagugugccugcguuaacgggucguguuucaccgugaugacagauggaccaucugacggccaggcuuccuacaaaaucuuucggauugaaaaggguaaaauagucaagucaguggagaugaaugcccccaacuaucauuacgaagagugcaguuguuacccugauagcuccgagaucacuugcgugugccgcgacaauuggcacgggucuaacagaccaugggucagcuucaaucagaaccucgaauaucagauuggauacaucuguucaggcaucuuuggcgauaauccgaggcccaacgacaaaaccgggaguugcggaccuguuuccagcaauggugcgaacggcgugaagggguucucuuuuaaguauggaaacggcguauggauuggucggacaaaaucaauaaguagccgcaauggguucgagaugaucugggauccaaacggcuggaccggaacggacaauaacuuuuccauuaagcaagacaucgugggcauuaaugaauggucuggguacucggggagcuucguccagcaucccgagcugacuggucuggauuguauccgaccuugcuucuggguggaacucauaagaggcaggccaaaagagaacacaaucuggaccuccgggucaaguauuucuuuuuguggaguuaauagcgacacugugggcugguccuggcccgauggugcagaguuaccguucacaaucgacaaguga

SEQ ID NO: 142376 - RNA, 1410 nt, Artificial Sequence; identical to SEQ ID NO: 138754
  derived and/or modified sequence opt3 from neuraminidase__InfluenzaA__ADX98678

SEQ ID NO: 142377 - RNA, 1410 nt, Artificial Sequence; identical to SEQ ID NO: 138754
  derived and/or modified sequence opt3 from neuraminidase__InfluenzaA__ADX98698

SEQ ID NO: 142378 - RNA, 1410 nt, Artificial Sequence
  derived and/or modified sequence opt3 from neuraminidase__InfluenzaA__ADX98708
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuaucuacgaaaauaacacguggguuaaucagaccuaugugaacauaagcaauacaaacuucgcugcaggccaguccguagugucugucaaacuggccggaaauucgucauugugcccugugagcggaugggcgauuuacaguaaggacaacuccaucagaauuggcucuaaaggugauguuuuugugaucagggagccauucaucagcuguuccccguuagaaugccggaccuuuuuccugacucagggggcucuacucaaugacaagcauucaaacggaacaauuaaagaucgcagucccuaucgaacccugaugagcuguccuauaggcgaggucccaucucccuacaacucccguuuugaaucaguggccuggagcgcaagugccugccacgacggcaucaauuggcuuacuauugggaucucuggaccugauaacggugcuguagcaguucugaaguauaauggcauaauuacagacaccaucaaguccuggagaaacaauaucuugaggacgcaagagagcgagugugccugcgugaacgggucguguuucacugucaugaccgauggaccaucugacggccaggcuuccuacaaaauuuuucggaucgaaaaggguaaaauugugaagucaguggagaugaaugcccccaacuaucauuacgaagagugcaguuguuacccugauagcuccgagauaacaugcgucugccgcgacaauuggcacgggucuaacagaccauggguuagcuucaaucagaaccucgaauaucagaucggauacauuuguucaggcaucuuuggcgauaauccgaggcccaacgacaaaacugggaguugcggaccuguguccagcaauggugcgaacggcguaaagggguucucuuuuaaguauggaaacggcguguggaucggucggaccaaaucaauuaguagccgcaauggguucgagaugauaugggauccaaacggcuggacaggaaccgacaauaacuuuuccaucaagcaagacauugucggcaucaaugaauggucuggguacucggggagcuucgugcagcaucccgagcugacgggucuggauuguauucgaccuugcuucuggguugaacucaucagaggcaggccaaaagagaacacuauauggacauccgggucaaguaucucuuuuuguggagugaauagcgacaccgucggcugguccuggcccgauggugcagaguuaccguucacuauugacaaguga

SEQ ID NO: 142379 - RNA, 1410 nt, Artificial Sequence; identical to SEQ ID NO: 138754
  derived and/or modified sequence opt3 from neuraminidase__InfluenzaA__ADX98722

SEQ ID NO: 142380 - RNA, 1410 nt, Artificial Sequence; identical to SEQ ID NO: 138754
  derived and/or modified sequence opt3 from neuraminidase__InfluenzaA__ADX98732

SEQ ID NO: 142381 - RNA, 1410 nt, Artificial Sequence; identical to SEQ ID NO: 138754
  derived and/or modified sequence opt3 from neuraminidase__InfluenzaA__ADX98742

SEQ ID NO: 142382 - RNA, 1410 nt, Artificial Sequence; identical to SEQ ID NO: 140105
  derived and/or modified sequence opt3 from neuraminidase__InfluenzaA__ADX98751

SEQ ID NO: 142383 - RNA, 1410 nt, Artificial Sequence; identical to SEQ ID NO: 138754
  derived and/or modified sequence opt3 from neuraminidase__InfluenzaA__ADX98761

SEQ ID NO: 142384 - RNA, 1410 nt, Artificial Sequence
  derived and/or modified sequence opt3 from neuraminidase__InfluenzaA__ADX98770
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccaugggggagcuucaaucagaaccucgaauaucagauaggcuacaucuguucaggcauuuuuggggauaauccgaggcccaacgacaaaaccggaaguugcgguccuguuuccagcaauggcgcgaacggggugaagggauucucuuuuaaguauggcaacgguguauggaucgggcggacaaaaucaaucaguagccgcaauggcuucgagaugauuugggauccaaacggauggaccggcacggacaauaacuuuuccauaaagcaagacaucguggggauuaaugaauggucuggauacucggguagcuucguccagcaucccgagcugacuggccuggauuguauccgaccuugcuucuggguggaacucauuagagggaggccaaaagagaacacaaucuggaccuccggaucaaguauaucuuuuuguggcguuaauagcgacacuguggguugguccuggcccgauggggcagaguuaccguucacaaucgacaaguga

SEQ ID NO: 142385 - RNA, 1410 nt, Artificial Sequence; identical to SEQ ID NO: 138754
  derived and/or modified sequence opt3 from neuraminidase__InfluenzaA__ADX98780

SEQ ID NO: 142386 - RNA, 1410 nt, Artificial Sequence
  derived and/or modified sequence opt3 from neuraminidase__InfluenzaA__ADX98788
augaaccccaaucagaagaucauuaccauaggcagcgugugcaugacaaucgggauggccaaccugguccuccaaauuggaaauaucauuuccaucuggauaucucacucaauccagcuugguaaccagaaucagauugagacuuguaaccaaaguguuaucacguacgaaaauaacaccugggugaaucagacauauguaaacauuagcaauacuaacuucgcugcaggccaguccguggucucugugaaacuggccggaaauucgucauugugcccuguuagcggaugggcgaucuacaguaaggacaacuccauaagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucugacggccaggcuuccuacaaaaucuuucggaucgaaaaggguaaaauugugaagucagucgagaugaaugcccccaacuaucauuacgaagagugcaguuguuacccugauagcuccgagaucacuugcguuugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacaauaaguuuuccauuaaacaagacauagugggcaucaacgaauggucuggguacucggggagcuucguucagcaucccgagcugacuggucuggauuguauucgaccuugcuucuggguggaacucaucagaggcaggccaaaggagaauacaauuuggaccuccgggucaaguaucucuuuuuguggagucaacagcgacacugugggcugguccuggcccgauggugcagaguuaccguucacaauagacaaauga

SEQ ID NO: 142387 - RNA, 1410 nt, Artificial Sequence
  derived and/or modified sequence opt3 from neuraminidase__InfluenzaA__ADX98809
augaaccccaaucagaagaucauuaccauaggcagcgugugcaugacaaucgggauggccaaccugauucuccaaaucggaaauauuauccuuauauggaucucccacucuauucagcuggguaaccagaaucagaucgagacuuguaaccaaucagucauuacguacgaaaauaacaccuggguuaaucagacauaugugaacaucaguaauacuaacuucgcugcaggccagagcguaguguccgucaaauuggccggaaauucuucguuaugcccugugucagggugggcgauauacagcaaggacaacaguauuagaaucggcuccaaaggugauguuuuugugauuagggagccauucaucucuuguagcccgcuggaaugccggaccuuuuuccuaacacagggggcucuccugaaugacaagcauuccaacggaaccaucaaagaucgcucacccuaucgaacucuuaugaguuguccuauuggcgaggucccaagccccuacaacucucguuuugaauccguggccuggucagcaagcgccugccacgacggcauaaauuggcugacaaucgggauuaguggaccugauaacggugcuguagcaguuuugaaguauaauggcaucauaaccgacacgauuaagucuuggagaaacaauauccucaggacucaagaguccgagugugccugcgugaacgggagcuguuucaccgucaugacagauggaccaucggacggccaggcuucuuacaaaaucuuucggauugaaaaggguaaaaucgugaaguccguggagaugaaugcccccaacuaucauuacgaagagugcucauguuacccugauaguagcgagauuacuugcgucugccgcgacaauuggcacggguccaacagaccauggguuucuuucaaucagaaccuggaauaucagauaggauacaucuguagcggcauuuuuggcgauaauccgaggcccaacgacaaaaccgggucaugcggaccugugaguuccaauggugcgaacggcguaaagggguucagcuuuaaguauggaaacggcguguggaucggucggacaaaaucuaucucaagucgcaauggguucgagaugauuugggauccaaacggcuggaccggaacggacaauaacuuuagcauaaagcaagacaucgucggcauuaaugaaugguccggguacucuggaucguucgugcagcaucccgagcugacuggucucgauuguauccgaccuugcuucuggguugaauuaauuagaggcaggccaaaagagaacacaaucuggaccagcggguccucaauaaguuuuuguggagucaauucugacacugugggcuggagcuggcccgauggugcagagcugccguucacaaucgacaaguga

SEQ ID NO: 142388 - RNA, 1410 nt, Artificial Sequence; identical to SEQ ID NO: 138754
  derived and/or modified sequence opt3 from neuraminidase__InfluenzaA__ADX98821

SEQ ID NO: 142389 - RNA, 1410 nt, Artificial Sequence; identical to SEQ ID NO: 138754
  derived and/or modified sequence opt3 from neuraminidase__InfluenzaA__ADX98846

SEQ ID NO: 142390 - RNA, 1410 nt, Artificial Sequence
  derived and/or modified sequence opt3 from neuraminidase__InfluenzaA__ADX98856
augaaccccaaucagaagaucaugaccauuggcagcgugugcaugacaauagggauggccaaccugauccuccaaauuggaaauaucauuuccaucuggauaucucacucaauccagcuugguauucagaaccagaucgagacuuguaaucaaagugucauuacguacgaaaacaauaccuggguuaaccagacauaugugaauaucagcaacacuaauuucgcugcaggccaguccguagugucugucaaacuggccgggaacucgucauugugcccugugagcggaugggcgauauacaguaaggacaauuccauuagaaucggcucuaaaggugauguuuuugugauuagggagccauucaucagcuguuccccguuagaaugccggaccuuuuuccugacacagggggcucuacucaacgacaagcauucaaauggaaccaucaaagaucgcagucccuaucgaacucugaugagcuguccuauuggcgaggucccaucucccuacaacucccguuuugaaucaguggccuggagcgcaagugccugccacgacggcauaaacuggcuuacaaucgggauuucuggaccugauaauggugcuguagcaguucugaaguauaacggcaucauaaccgacacgauuaaguccuggagaaauaacaucuugaggacucaagagagcgagugugccugcgugaaugggucguguuucaccgucaugacagauggaccaucugacggccaggcuuccuacaaaaucuuucggauugaaaaggguaaaaucgugaagucaguggagaugaacgcccccaauuaucauuacgaagagugcaguuguuacccugauagcuccgagauuacuugcgucugccgcgacaacuggcacgggucuaauagaccauggguuagcuucaaccagaaucucgaauaucagauaggauacaucuguucaggcauuuuuggcgauaacccgaggcccaaugacaaaaccgggaguugcggaccuguguccagcaacggugcgaauggcguaaagggguucucuuuuaaguauggaaacggcguguggaucggucggacaaaaucaaucaguagccgcaacggguucgagaugauuugggauccaaauggcuggaccggaacggacaacaauuuuuccauaaagcaagacaucgucggcauuaacgaauggucuggguacucggguagcuucgugcagcaucccgagcugacuggacuggauuguauccgaccuugcuucuggguugaacucauuagaggcaggccaaaagagaauacaaucuggaccuccgggucaaguauaucuuuuuguggagugaacagcgacacugucggcugguccuggcccgauggugcagaguuaccguucacaaucgacaaguga

SEQ ID NO: 142391 - RNA, 1410 nt, Artificial Sequence; identical to SEQ ID NO: 138754
  derived and/or modified sequence opt3 from neuraminidase__InfluenzaA__ADX98863

SEQ ID NO: 142392 - RNA, 1410 nt, Artificial Sequence; identical to SEQ ID NO: 138754
  derived and/or modified sequence opt3 from neuraminidase__InfluenzaA__ADX98873

SEQ ID NO: 142393 - RNA, 1410 nt, Artificial Sequence
  derived and/or modified sequence opt3 from neuraminidase__InfluenzaA__ADX98883
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacguagcugcaggccaguccguggucucugugaaacuggccgggaauagcucauugugcccuguuagcggaugggcgauauacaguaaggacaacuccauuagaaucggcucuaaaggugaugcuuucgugauuagggagccauuuaucagcuguuccccguuagaaugccggaccuucuuucugacacagggggcccuacucaaugacaagcauucaaacggaaccaucaaagaucgcagucccuaucgaacucugaugagcuguccuauuggcgaggucccaucucccuacaacucccguuucgaaucaguggcauggagcgccagugcuugccacgacggcauaaauuggcuuacaaucgggauuucuggaccugauaacggugcaguagccguucugaaguauaauggcaucauaaccgacacgauuaaguccuggagaaacaauaucuugaggacucaagagagcgagugugcuugcgugaacgggucguguuuuaccgucaugacagauggaccaucugacggccaggccuccuacaaaaucuuccggauugaaaaggguaaaaucgugaagucaguggagaugaaugcgcccaacuaucauuacgaagagugcaguuguuacccugauagcuccgagauuacuugcgucugccgcgacaauuggcacgggucuaacagaccauggguuagcuuuaaucagaaccucgaauaucagauaggauacaucuguucaggcauuuucggcgauaauccgaggcccaacgacaaaaccgggaguugcggaccuguguccagcaauggugcaaacggcguaaagggguuuucuuucaaguauggaaacggcguguggaucggucggacaaaaucaaucaguagccgcuccggguuugagaugauuugggauccaaauggcuggaccggaacggacaacaauuucucuauaaagcaagacaucgucggcauuaacgaauggucgggguacagcggauccuuugugcagcaucccgagcugacuggucuggauuguauccgaccuugcuucuggguugaacucauuagaggcaggccaaaagagaauacaaucuggaccucagggaguucuauaucguucuguggagugaacuccgacacugucggcuggucauggcccgauggugccgaguuaccguuuacaaucgacaaguga

SEQ ID NO: 142394 - RNA, 1410 nt, Artificial Sequence; identical to SEQ ID NO: 138754
  derived and/or modified sequence opt3 from neuraminidase__InfluenzaA__ADX98893

SEQ ID NO: 142395 - RNA, 1410 nt, Artificial Sequence; identical to SEQ ID NO: 138754
  derived and/or modified sequence opt3 from neuraminidase__InfluenzaA__ADX98903

SEQ ID NO: 142396 - RNA, 1410 nt, Artificial Sequence; identical to SEQ ID NO: 140307
  derived and/or modified sequence opt3 from neuraminidase__InfluenzaA__ADX98913

SEQ ID NO: 142397 - RNA, 1410 nt, Artificial Sequence; identical to SEQ ID NO: 140185
  derived and/or modified sequence opt3 from neuraminidase__InfluenzaA__ADX98923

SEQ ID NO: 142398 - RNA, 1410 nt, Artificial Sequence; identical to SEQ ID NO: 140191
  derived and/or modified sequence opt3 from neuraminidase__InfluenzaA__ADX98933

SEQ ID NO: 142399 - RNA, 1410 nt, Artificial Sequence; identical to SEQ ID NO: 138754
  derived and/or modified sequence opt3 from neuraminidase__InfluenzaA__ADX98943

SEQ ID NO: 142400 - RNA, 1410 nt, Artificial Sequence; identical to SEQ ID NO: 140711
  derived and/or modified sequence opt3 from neuraminidase__InfluenzaA__ADX98953

SEQ ID NO: 142401 - RNA, 1410 nt, Artificial Sequence; identical to SEQ ID NO: 138754
  derived and/or modified sequence opt3 from neuraminidase__InfluenzaA__ADX98963

SEQ ID NO: 142402 - RNA, 1410 nt, Artificial Sequence
  derived and/or modified sequence opt3 from neuraminidase__InfluenzaA__ADX98973
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugauuuguccuauaggcgaggucccaagccccuacaacucucguuuugaauccguggccuggucagcaagcgccugccacgacggcaucaauuggcuuacaauugggaucaguggaccugauaacggugcuguagcaguucugaaguauaauggcauaauuaccgacacgaucaagucuuggagaaacaauaucuugaggacucaagaguccgagugugccugcgugaacgggagcuguuucaccgucaugacagauggaccaucggacggccaggcuucuuacaaaauuuuucggaucgaaaaggguaaaauugugaaguccguggagaugaaugcccccaacuaucauuacgaagagugcucauguuacccugauaguagcgagauaacuugcgucugccgcgacaauuggcacggguccaacagaccauggguuucuuucaaucagaaccucgaauaucagaucggauacauuuguagcggcaucuuuggcgauaauccgaggcccaacgacaaaaccgggucaugcggaccugugaguuccaauggugcgaacggcguaaagggguucagcuuuaaguauggaaacggcguguggaucggucggacaaaaucuauuucaagucgcaauggguucgagaugauaugggauccaaacggcuggaccggaacggacaauaacuuuagcaucaagcaagacauugucggcaucaaugaaugguccggguacucuggaucguucgugcagcaucccgagcugacuggucuggauuguauucgaccuugcuucuggguugaacucaucagaggcaggccaaaagagaacacaauauggaccagcggguccucaaucaguuuuuguggagucaauucugacacugugggcuggagcuggcccgauggugcagaguuaccguucacaauugacaaguga

SEQ ID NO: 142403 - RNA, 1410 nt, Artificial Sequence; identical to SEQ ID NO: 138754
  derived and/or modified sequence opt3 from neuraminidase__InfluenzaA__ADX98983

SEQ ID NO: 142404 - RNA, 1410 nt, Artificial Sequence; identical to SEQ ID NO: 138754
  derived and/or modified sequence opt3 from neuraminidase__InfluenzaA__ADX98993

SEQ ID NO: 142405 - RNA, 1410 nt, Artificial Sequence; identical to SEQ ID NO: 138754
  derived and/or modified sequence opt3 from neuraminidase__InfluenzaA__ADX99003

SEQ ID NO: 142406 - RNA, 1365 nt, Artificial Sequence
  derived and/or modified sequence opt3 from neuraminidase__InfluenzaA__ADX99584
augaaccccaaucagaagaucaccacaauuggcagcauaugccugguggucgggcucaucucccuuauucugcaaaucggaaacauuaucucuauauggaucucacacaguauucagacugguagccagaaucauacgggcaucuguaaccagaauauuaucaccuacaaaaacuccacauggguuaaggacacuaccucugugauauugacaggaaauucgucauuaugcccuauuagagggugggccaucuauagcaaagauaacaguauuaggaucggcuccaagggugacguauucgugauccgggagccauuuauuucuuguagccaccuggaaugccgcaccuucuuucuaacucaaggggcucuccugaaugauaaacauuccaacggaacagucaaggaccgaucaccguaccgugcacuuaugaguugucccgugggcgaggccccuagcccauauaauucuagauucgaauccguugcguggucagcuagcgccugccacgauggcaugggguggcugaccauaggaaucaguggucccgacaacggcgcaguggccgucuugaaguacaaugggauuaucacggagacuauaaaaucuuggaggaagaaaauucuccggacccaggaauccgagugugcuugcgugaacggaagcuguuuuacaaucaugacugauggcccuucggacggucuggcaucuuauaagaucuucaaaauugagaaggggaagguaaccaaauccaucgaacugaaugccccaaacucacauuacgaggaaugcaguuguuaucccgauacaggaaagguuaugugcgugugccgcgacaacuggcacggcagcaauagaccuugggucuccuuugaucagaaccucgacuaccagauuggcuacauauguucugggguguucggagauaauccaaggccggaggacgguaccggcagcugcgggcccguguaugucgacggagcuaacggcguuaaagguuuuucauaccgguaugggaauggcguguggaucggacgcacgaagagucacuccagccgacauggcuucgagaugauuugggauccuaacggguggacugaaacagacucuaaauuuucaguaagacaagauguggucgccaugaccgacuggaguggauacagcgguuccuucgugcagcacccagaguuaacuggccuggauuguaugaggcccugcuuuuggguugaacuuauccgggggcguccuaaggagaaaacaaucuggaccucugcgucgagcauuuccuucuguggagucaauucagacacgguggauuggaguuggccagacggcgcagaauugcccuucucuauagauaaguga

SEQ ID NO: 142407 - RNA, 1365 nt, Artificial Sequence; identical to SEQ ID NO: 142406
  derived and/or modified sequence opt3 from neuraminidase__InfluenzaA__ADX99595

SEQ ID NO: 142408 - RNA, 1365 nt, Artificial Sequence; identical to SEQ ID NO: 142406
  derived and/or modified sequence opt3 from neuraminidase__InfluenzaA__ADX99606

SEQ ID NO: 142409 - RNA, 1365 nt, Artificial Sequence; identical to SEQ ID NO: 142406
  derived and/or modified sequence opt3 from neuraminidase__InfluenzaA__ADX99617

SEQ ID NO: 142410 - RNA, 1365 nt, Artificial Sequence; identical to SEQ ID NO: 142406
  derived and/or modified sequence opt3 from neuraminidase__InfluenzaA__ADX99628

SEQ ID NO: 142411 - RNA, 1365 nt, Artificial Sequence; identical to SEQ ID NO: 142406
  derived and/or modified sequence opt3 from neuraminidase__InfluenzaA__ADX99639

SEQ ID NO: 142412 - RNA, 1365 nt, Artificial Sequence; identical to SEQ ID NO: 137735
  derived and/or modified sequence opt3 from neuraminidase__InfluenzaA__ADX99650

SEQ ID NO: 142413 - RNA, 1365 nt, Artificial Sequence; identical to SEQ ID NO: 137735
  derived and/or modified sequence opt3 from neuraminidase__InfluenzaA__ADX99672

SEQ ID NO: 142414 - RNA, 1365 nt, Artificial Sequence; identical to SEQ ID NO: 137735
  derived and/or modified sequence opt3 from neuraminidase__InfluenzaA__ADX99683

SEQ ID NO: 142415 - RNA, 1365 nt, Artificial Sequence; identical to SEQ ID NO: 137735
  derived and/or modified sequence opt3 from neuraminidase__InfluenzaA__ADX99694

SEQ ID NO: 142416 - RNA, 1365 nt, Artificial Sequence; identical to SEQ ID NO: 137735
  derived and/or modified sequence opt3 from neuraminidase__InfluenzaA__ADX99705

SEQ ID NO: 142417 - RNA, 1365 nt, Artificial Sequence; identical to SEQ ID NO: 137735
  derived and/or modified sequence opt3 from neuraminidase__InfluenzaA__ADX99846

SEQ ID NO: 142418 - RNA, 1365 nt, Artificial Sequence; identical to SEQ ID NO: 137735
  derived and/or modified sequence opt3 from neuraminidase__InfluenzaA__ADX99857

SEQ ID NO: 142419 - RNA, 1365 nt, Artificial Sequence; identical to SEQ ID NO: 137735
  derived and/or modified sequence opt3 from neuraminidase__InfluenzaA__ADX99868

SEQ ID NO: 142420 - RNA, 1365 nt, Artificial Sequence; identical to SEQ ID NO: 137735
  derived and/or modified sequence opt3 from neuraminidase__InfluenzaA__ADX99879

SEQ ID NO: 142421 - RNA, 1365 nt, Artificial Sequence; identical to SEQ ID NO: 137735
  derived and/or modified sequence opt3 from neuraminidase__InfluenzaA__ADX99890

SEQ ID NO: 142422 - RNA, 1365 nt, Artificial Sequence; identical to SEQ ID NO: 137735
  derived and/or modified sequence opt3 from neuraminidase__InfluenzaA__ADX99901

SEQ ID NO: 142423 - RNA, 1365 nt, Artificial Sequence
  derived and/or modified sequence opt3 from neuraminidase__InfluenzaA__ADX99912
augaaccccaaucagaagaucauuaccauaggcagcaucugccugguggucgggcucauuucccuuauccugcaaauuggaaacaucauaucuaucuggauuucacacaguauccagacagguagccagaaucauacuggcauuuguaaccagaauaucauaacguacaaaaacuccaccuggguuaaggacacaacuucugugauuuugaccggaaauucgucauuaugcccuaucagagggugggccauuuauagcaaagauaacaguaucaggaucggcuccaagggugacguauucauuauacgggagccauuuaucucuuguagccaccuggaaugccgcacauucuuucuaacccaaggggcucuccugaaugauaaacauuccucaggaacugugaaggaccgaaguccguaccgugcacuuaugagcugucccgucggcgaggccccuucuccauauaacuccagauucgaaucaguggcguggagcgcuagugccugccacgauggcaugggguggcugacaauuggaaucucuggucccgacaauggcgcaguugccguguugaaguacaacgggauaauuaccgagacgaucaaauccuggaggaagaaaauccuccggacucaggaaagcgagugugcuugcgucaauggaucguguuuuaccauuaugacagauggcccuucugacggucuggcauccuauaagaucuucaaaauugagaaggggaaggugacuaaaucaauagaacugaacgccccaaauagucauuacgaggaaugcagcuguuaucccgauaccggaaagguaaugugcguuugccgcgacaacuggcacggcuccaacagaccuugggugucuuuugaucagaaucucgacuaccagaucggcuacauuuguagcggggucuucggagauaacccaaggccggaggacgguacaggcucaugcgggcccguguauguggacggagcuaauggcgucaaagguuuuaguuaccgguaugggaacggcguuuggaucggacgcaccaagucccacagcucucgacauggcuucgagaugaucugggauccuaauggguggacggaaacugacucaaaauuuagugugagacaagauguaguggccaugacagacuggagcggauacuccgguucuuucguccagcacccagaguuaaccggccuggauuguaugaggcccugcuuuuggguggaacuuauucgggggcguccuaaggagaaaacuauauggacaucggcgagcuccaucucauucuguggaguuaacagugacaccguggauuggucuuggccagacggcgcagaauugcccuucagcauugauaaguga

SEQ ID NO: 142424 - RNA, 1365 nt, Artificial Sequence; identical to SEQ ID NO: 137735
  derived and/or modified sequence opt3 from neuraminidase__InfluenzaA__ADX99923

SEQ ID NO: 142425 - RNA, 1365 nt, Artificial Sequence; identical to SEQ ID NO: 137735
  derived and/or modified sequence opt3 from neuraminidase__InfluenzaA__ADX99934

SEQ ID NO: 142426 - RNA, 1365 nt, Artificial Sequence; identical to SEQ ID NO: 137735
  derived and/or modified sequence opt3 from neuraminidase__InfluenzaA__ADX99956

SEQ ID NO: 142427 - RNA, 1365 nt, Artificial Sequence; identical to SEQ ID NO: 137735
  derived and/or modified sequence opt3 from neuraminidase__InfluenzaA__ADX99967

SEQ ID NO: 142428 - RNA, 1365 nt, Artificial Sequence; identical to SEQ ID NO: 137735
  derived and/or modified sequence opt3 from neuraminidase__InfluenzaA__ADX99978

SEQ ID NO: 142429 - RNA, 1365 nt, Artificial Sequence; identical to SEQ ID NO: 137735
  derived and/or modified sequence opt3 from neuraminidase__InfluenzaA__ADX99989

SEQ ID NO: 142430 - RNA, 1365 nt, Artificial Sequence; identical to SEQ ID NO: 137735
  derived and/or modified sequence opt3 from neuraminidase__InfluenzaA__ADY00001

SEQ ID NO: 142431 - RNA, 1365 nt, Artificial Sequence; identical to SEQ ID NO: 137735
  derived and/or modified sequence opt3 from neuraminidase__InfluenzaA__ADY00012

SEQ ID NO: 142432 - RNA, 1365 nt, Artificial Sequence; identical to SEQ ID NO: 137735
  derived and/or modified sequence opt3 from neuraminidase__InfluenzaA__ADY00023

SEQ ID NO: 142433 - RNA, 1413 nt, Artificial Sequence
  derived and/or modified sequence opt3 from neuraminidase__InfluenzaA__ADY04729
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucgcagggaaagacaagaccucgguaacaauggccggaaauucaagccuuuguaguauuuccggcugggcgaucuacaccaaagauaacucuaucaggauugguagcaagggggacguguucgucauacgggagccuuuuaucuccugcucacaucuggagugucgcacuuucuuuuugacacaaggagcuuuacugaaugauaaacacaguaacggcaccgugaaggaccgaagcccauaucgugcccuaaugucuugcccgcucggcgaagcacccuccccuuacaauucaaaguucgagagcguugccuggagugcuucugcaugucaugaugggaugggauggcugacgauugguaucuccggcccagacaacggggccguggcuguccuuaaauauaacggaauaauuacugaaaccaucaagagcuggaaaaagcagauccugagaacacaggagucggagugcguguguguaaauggcucuugcuuuacuauuaugaccgauggucccuccaacggggccgcgucauacaaaaucuucaagauugaaaagggaaaaguuacaaagaguauagaguugaaugcaccuaacuuucacuaugaagaguguagcugcuacccagacaccggcacggugaugugugucugcagggauaauuggcacggcuccaaccggcccugggugucuuucaaucagaaccucgacuaccaaaucggguauauuugcagcggaguguuuggugauaauccucgcccaaaagacggcgaggggucauguaacccggucacuguugauggagccaauggcgugaaggguuucaguuacaaauaugggaacggcguauggaucggaagaacaaaguccaauaggcugcggaaaggcuuugaaaugaucugggaccccaacggguggaccgacacugauagcgacuucucugugaagcaggaugucguggcuauuacagacuggucaggauacagugguagcuuuguucagcauccugagcugaccggccucgauugcauacgcccauguuucuggguggaauuaguccgagggcugcccaaggagaauacgaccaucuggacauccggaucuucgauuagcuucugcggcgugaacuccgacacugccaacuggucauggccugauggugcagaacuuccauuuaccaucgacaaauga

SEQ ID NO: 142434 - RNA, 1410 nt, Artificial Sequence; identical to SEQ ID NO: 141534
  derived and/or modified sequence opt3 from neuraminidase__InfluenzaA__ADY11828

SEQ ID NO: 142435 - RNA, 1410 nt, Artificial Sequence; identical to SEQ ID NO: 138615
  derived and/or modified sequence opt3 from neuraminidase__InfluenzaA__ADY11839

SEQ ID NO: 142436 - RNA, 1410 nt, Artificial Sequence; identical to SEQ ID NO: 138615
  derived and/or modified sequence opt3 from neuraminidase__InfluenzaA__ADY17657

SEQ ID NO: 142437 - RNA, 1410 nt, Artificial Sequence; identical to SEQ ID NO: 138615
  derived and/or modified sequence opt3 from neuraminidase__InfluenzaA__ADY17668

SEQ ID NO: 142438 - RNA, 1410 nt, Artificial Sequence; identical to SEQ ID NO: 138615
  derived and/or modified sequence opt3 from neuraminidase__InfluenzaA__ADY17679

SEQ ID NO: 142439 - RNA, 1410 nt, Artificial Sequence; identical to SEQ ID NO: 138615
  derived and/or modified sequence opt3 from neuraminidase__InfluenzaA__ADY17690

SEQ ID NO: 142440 - RNA, 1410 nt, Artificial Sequence; identical to SEQ ID NO: 138615
  derived and/or modified sequence opt3 from neuraminidase__InfluenzaA__ADY17701

SEQ ID NO: 142441 - RNA, 1410 nt, Artificial Sequence; identical to SEQ ID NO: 138754
  derived and/or modified sequence opt3 from neuraminidase__InfluenzaA__ADY38722

SEQ ID NO: 142442 - RNA, 1410 nt, Artificial Sequence; identical to SEQ ID NO: 140503
  derived and/or modified sequence opt3 from neuraminidase__InfluenzaA__ADY38723

SEQ ID NO: 142443 - RNA, 1410 nt, Artificial Sequence; identical to SEQ ID NO: 138754
  derived and/or modified sequence opt3 from neuraminidase__InfluenzaA__ADY38734

SEQ ID NO: 142444 - RNA, 1410 nt, Artificial Sequence; identical to SEQ ID NO: 140346
  derived and/or modified sequence opt3 from neuraminidase__InfluenzaA__ADY38753

SEQ ID NO: 142445 - RNA, 1410 nt, Artificial Sequence; identical to SEQ ID NO: 138754
  derived and/or modified sequence opt3 from neuraminidase__InfluenzaA__ADY38763

SEQ ID NO: 142446 - RNA, 1410 nt, Artificial Sequence; identical to SEQ ID NO: 138754
  derived and/or modified sequence opt3 from neuraminidase__InfluenzaA__ADZ04600

SEQ ID NO: 142447 - RNA, 1410 nt, Artificial Sequence; identical to SEQ ID NO: 138754
  derived and/or modified sequence opt3 from neuraminidase__InfluenzaA__ADZ04610

SEQ ID NO: 142448 - RNA, 1410 nt, Artificial Sequence; identical to SEQ ID NO: 138754
  derived and/or modified sequence opt3 from neuraminidase__InfluenzaA__ADZ04693

SEQ ID NO: 142449 - RNA, 1410 nt, Artificial Sequence; identical to SEQ ID NO: 138754
  derived and/or modified sequence opt3 from neuraminidase__InfluenzaA__ADZ04701

SEQ ID NO: 142450 - RNA, 1410 nt, Artificial Sequence; identical to SEQ ID NO: 138754
  derived and/or modified sequence opt3 from neuraminidase__InfluenzaA__ADZ04711

SEQ ID NO: 142451 - RNA, 1410 nt, Artificial Sequence
  derived and/or modified sequence opt3 from neuraminidase__InfluenzaA__ADZ05393
augaaccccaaucagaagaucauuaccauagacagcgugugcaugacaaucggcauggccaaccugauucuccaaaucgggaauauuaucuccauauggaucucucacucaauucagcuuggaaaccagaaucagaucgagacuuguaaccaaagugucauuacguacgaaaauaacaccuggguuaaucagacauaugugaacaucagcaauacuaacuucgcugcaggucaguccguagugucugucaaacuggccggcaauucgucauugugcccugugagcgggugggcgauauacaguaaggauaacuccguuagaauuggaucuaaaggcgacguguuugucaucagggagccauucauuagcuguuccccguuagaaugccggaccuuuuuccugacacagggugcucuacucaaugauaagcauucaaacgggaccaucaaagaccgcagucccuaucgaacucugaugagcuguccuaucggagaggugccaucucccuacaacucccguuuugaaucaguagccuggagcgcaagugccugccacgauggcauuaauuggcuuacaauaggcaucucugggccugacaacggagcuguugcagugcugaaguauaaugguauuaucaccgauacgauaaaguccuggagaaacaauauuuugaggacucaagagagcgagugugccugcgucaacggcucguguuucaccgugaugacagacgggccaucuaauggacaggcuuccuacaaaaucuuucggaucgaaaagggcaaaauugugaagucagucgagaugaacgcccccaauuaucauuacgaagagugcaguuguuacccugauagcuccgagaucacuugcguuugccgcgacaacuggcacgguucuaauagaccaugggugagcuucaaccagaaucucgaauaucagauuggguacauauguucaggaaucuuuggcgauaacccgaggcccaaugacaaaaccggcaguugcgggccuguauccagcaacggagcgaacggugugaagggcuucucuuuuaaguaugggaauggagucuggauuggccggacaaaaucaaucaguagccgcaacgguuucgagaugaucugggauccaaauggguggaccggcacggacaacaauuuuuccauuaagcaagacauagugggaaucaacgaauggucuggcuacucggggagcuucguucagcaucccgagcugacuggacuggauuguauucgaccuugcuucuggguggaacucaucagagguaggccaaaagagaauacaauuuggaccuccggcucaaguaucucuuuuuguggggucaacagcgacacugugggaugguccuggcccgauggcgcagaguuaccguucacaauagacaaguga

SEQ ID NO: 142452 - RNA, 1413 nt, Artificial Sequence
  derived and/or modified sequence opt3 from neuraminidase__InfluenzaA__ADZ05837
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacgugugagaacucuaccugggugaaucauacauacgucaacaucaauaacacuaauguuguggcaggggaagacaaaaccucgguaacacuugccggaaacucaagccugugcaguauuuccggcugggcgaucuauaccaaggauaauucuaucaggauugguagcaaaggggacguguucgucauacgggagccuuuuaucuccuguucacacuuggaaugccgcacuuucuuuuuaacacaaggagcucugcuaaacgauaagcauaguaauggcaccgugaaagaccgaagcccauaccgugcccucaugucuuguccgcugggcgaggcacccuccccuuauaacucaaaguucgaaagcguugccuggagugcuucugcaugccacgaugggaugggauggcuuacgauugguaucuccggcccagacaacggggccguggcuguccugaaguacaauggaauaauuacuggcaccaucaaaagcuggaagaaacagaucuugagaacacaggagucggagugugugugcaugaacgguucuuguuuuacuauuaugaccgaugggcccuccaauaaggccgcgucauauaaaaucuucaagauugaaaagggaaaaguaacaaagaguauagagcucaacgcaccuaauuuuuacuaugaagagugcagcuguuacccagacaccggcaucguuaugugcgugugcagggauaacuggcauggcuccaaucggcccugggucucuuucaaccagaaucuggacuaccaaauuggguauaucuguagcggaguguuuggugauaacccucgcccagaggacggcgaagggucaugcaauccggugacggucgauggagccaacggcguuaaagguuucaguuacaaguaugggaauggcguguggaucggaagaacuaaauccaacaggcugcggaagggcuuugagaugauuugggaccccaauggguggacaaacaccgacagcgauuucucuguaaaacaggacguggucgcuacuacagauuggucaggauacagugguagcuuugugcagcacccugaacucaccggcuuagacuguauacgcccaugcuucuggguugagcuggugcgagggcuucccagagaaaacacgaccaucuggacauccggaucuucgauuagcuucuguggcgucaauuccgauacugccaacuggucauggccugacggugcagaguugccauuuaccaucgauaaguga

SEQ ID NO: 142453 - RNA, 1413 nt, Artificial Sequence; identical to SEQ ID NO: 139477
  derived and/or modified sequence opt3 from neuraminidase__InfluenzaA__ADZ05848

SEQ ID NO: 142454 - RNA, 1410 nt, Artificial Sequence; identical to SEQ ID NO: 139921
  derived and/or modified sequence opt3 from neuraminidase__InfluenzaA__ADZ05858

SEQ ID NO: 142455 - RNA, 1410 nt, Artificial Sequence; identical to SEQ ID NO: 138754
  derived and/or modified sequence opt3 from neuraminidase__InfluenzaA__ADZ47841

SEQ ID NO: 142456 - RNA, 1410 nt, Artificial Sequence; identical to SEQ ID NO: 138754
  derived and/or modified sequence opt3 from neuraminidase__InfluenzaA__ADZ47851

SEQ ID NO: 142457 - RNA, 1410 nt, Artificial Sequence
  derived and/or modified sequence opt3 from neuraminidase__InfluenzaA__ADZ47861
augaaccccaaucagaagaucauuaccauaggcagcgugugcaugacaaucgggcuggccaaccucauucuucaaaucggaaauauuaucuccauauggaucucucacucaauucagcuggguaaccagaaucagaucgagacuuguaaccaaagugucauuacguacgaaaauaacaccuggguuaaucagacauaugugaacaucagcaauauaaacuucgcugcaggccaguccguagugucugucaaauuggccggaaauucgucauuaugcccugugagcggaugggcgauuuacaguaaggacaacuccguuagaaucggcucuaaaggugauguguuugucauuagggagccauucaucagcuguuccccgcuggaaugccggaccuuuuuccuaacucagggggcucuccugaaugacaagcauucaaacggaacaaucaaagaucgcagucccuaucgaacccuuaugagcuguccuauuggcgaggugccaucucccuacaacucccguuuugaaucaguagccuggagcgcaagugccugccacgacggcauaaauuggcugacuaucgggauuucuggaccugauaacggugcuguugcaguguugaaguauaauggcaucauaacagacaccauuaaguccuggagaaacaauauccucaggacgcaagagagcgagugugccugcgucaacgggucguguuucacugugaugaccgauggaccaucugacggccaggcuuccuacaaaaucuuucggauugaaaaggguaaaaucgugaagucagucgagaugaaugcccccaacuaucauuacgaagagugcaguuguuacccugauagcuccgagauuacaugcguuugccgcgacaauuggcacgggucuaacagaccaugggugagcuucaaucagaaccuggaauauaggauaggauacaucuguucaggcauuuuuggcgauaauccgcggcccaacgacaaaacugggaguugcggaccuguauccagcaauggugcgaacggcgugaagggguucucuuuuaaguauggaaacggcgucuggaucggucgcaccaaaucaaucaguagccgaaauggguucgagaugauuugggauccaaacggcuggacaggaaccgacaagaauuuuuccauaaaacaggacaucgugggcauuaacgaauggucuggguacucggggagcuucguucaacaucccgagcugacgggucucgauuguaucagaccuugcuucuggguggaauuaauuaggggccggccaaaggagaauacuaucuggacauccgggucaaguauaucuuuuuguggagucaacagcgacaccgugggcugguccuggcccgauggugcagagcugccguucacuaucgacaaauga

SEQ ID NO: 142458 - RNA, 1413 nt, Artificial Sequence
  derived and/or modified sequence opt3 from neuraminidase__InfluenzaA__ADZ53101
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaaaguuguggcaggggaagacaagaccucgguaacacuugccggaaauucaagccuguguaguauuuccggcugggcgaucaacaccaaagauaauucuaucaggauugguagcaagggggacguguucgucauacgggagccuuuuaucuccugcucacacuuggaaugucgcacuuucuuuuuaacacaaggagcucugcuaaacgauaaacauaguaauggcaccgugaaggaccgaagcccauaccgugcccucaugucuugcccgcugggcgaggcacccuccccuuauaacucaaaguucgaaagcguugccuggagugcuucugcaugucacgaugggaugggauggcuuacgauugguaucuccggcccagacaacggggccguggcuguccugaaauacaauggaauaauuacuggcaccaucaagagcuggaaaaagcagaucuugagaacacaggagucggagugcguguguaugaacgguucuugcuuuacuauuaugaccgaugggcccuccaauaaagccgcgucauauaagaucuucaagauugaaaaaggaaagguaacaaaaaguauagagcucaacgcaccuaauuuuuacuaugaagaguguagcugcuacccagacaccggcaucguuaugugugugugcagggauaacuggcauggcuccaaucggcccugggucucuuucaaccagaaucuggacuaccaaauuggguauaucugcagcggaguguuuggugauaacccucgcccagaggacggcgaagggucauguaauccggugacggucgauggagccaacggcguuaaggguuucaguuacaaauaugggaauggcguguggaucggaagaacuaaguccaacaggcugcggaaaggcuuugagaugauuugggaccccaauggguggacaaacaccgacagcgauuucucuguaaagcaggacguggucgcuauaacugauuggucaggauacagugguagcuuugugcagcacccugaacucacaggcuuagacugcauccgcccauguuucuggguugagcuggugcgagggcuucccagagaaaacaccacgauuuggaccuccggaucuucgaucagcuucugcggcgucaauuccgauacagccaacuggucauggccugacggugcagaguugccauuuacuauugauaaguga

SEQ ID NO: 142459 - RNA, 1410 nt, Artificial Sequence
  derived and/or modified sequence opt3 from neuraminidase__InfluenzaA__ADZ53124
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuauuacuacgaagagugcaguuguuauccugauagcuccgagauuacuugcgucugccgcgacaauuggcaugggucuaacagaccauggguuagcuucaaucagaaccucgaauaccagauaggauauaucuguucaggcauuuuuggcgauaauccgaggcccaacgacaaaaccgggaguugcggaccuguguccagcaauggugcgaacggcguaaagggguucucuuuuaaguacggaaacggcguguggaucggucggacaaaaucaaucaguagccgcaauggguucgagaugauuugggauccaaacggcuggaccggaacggacaaugacuuuuccauaaagcaagauaucgucggcauuaacgaauggucuggguauucggggagcuucgugcagcaccccgagcugacuggucuggacuguauccgaccuugcuucuggguugaacucauuagaggcaggccaaaagagaauacaaucuggaccuccgggucaaguauaucuuuuuguggagugaacagcgauacugucggcugguccuggcccgacggugcagaguuaccguucacaaucgauaaguga

SEQ ID NO: 142460 - RNA, 1410 nt, Artificial Sequence; identical to SEQ ID NO: 138754
  derived and/or modified sequence opt3 from neuraminidase__InfluenzaA__ADZ53130

SEQ ID NO: 142461 - RNA, 1410 nt, Artificial Sequence; identical to SEQ ID NO: 138744
  derived and/or modified sequence opt3 from neuraminidase__InfluenzaA__ADZ53132

SEQ ID NO: 142462 - RNA, 1410 nt, Artificial Sequence; identical to SEQ ID NO: 138754
  derived and/or modified sequence opt3 from neuraminidase__InfluenzaA__ADZ53134

SEQ ID NO: 142463 - RNA, 1410 nt, Artificial Sequence; identical to SEQ ID NO: 138754
  derived and/or modified sequence opt3 from neuraminidase__InfluenzaA__ADZ53136

SEQ ID NO: 142464 - RNA, 1410 nt, Artificial Sequence; identical to SEQ ID NO: 139108
  derived and/or modified sequence opt3 from neuraminidase__InfluenzaA__ADZ53137

SEQ ID NO: 142465 - RNA, 1410 nt, Artificial Sequence; identical to SEQ ID NO: 138754
  derived and/or modified sequence opt3 from neuraminidase__InfluenzaA__ADZ53139

SEQ ID NO: 142466 - RNA, 1410 nt, Artificial Sequence
  derived and/or modified sequence opt3 from neuraminidase__InfluenzaA__ADZ53141
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaaugacuuuuccauaaagcaagauaucgucggcauuaacgaauggucuggguacucggggagcuucgugcagcauuccgagcugacuggucuggacuguauccgacccugcuucuggguugaacucauuagaggcaggccuaaagagaauacaaucuggaccucagggaguucuaucagcuuuuguggagugaacuccgauacugucggcuggucauggccagacggugcagaguuacccuucacaauagauaaguga

SEQ ID NO: 142467 - RNA, 1410 nt, Artificial Sequence; identical to SEQ ID NO: 138615
  derived and/or modified sequence opt3 from neuraminidase__InfluenzaA__AEA03712

SEQ ID NO: 142468 - RNA, 1410 nt, Artificial Sequence; identical to SEQ ID NO: 138615
  derived and/or modified sequence opt3 from neuraminidase__InfluenzaA__AEA03722

SEQ ID NO: 142469 - RNA, 1410 nt, Artificial Sequence; identical to SEQ ID NO: 138615
  derived and/or modified sequence opt3 from neuraminidase__InfluenzaA__AEA03744

SEQ ID NO: 142470 - RNA, 1410 nt, Artificial Sequence
  derived and/or modified sequence opt3 from neuraminidase__InfluenzaA__AEA03755
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgaggacguacaccauauagaacucugcuuaugaaugaacugggcguucccuuucacuuggguaccaaacaggugugcauugcuuggagcaguuccucuugucaugaugggaaggccuggcuccacgucugcaucacaggagacgauaagaacgcaaccgccagcuucaucuacaauggcaggcugguggacuccguaguuucauggaguaaagagauucugcggacgcaggaaagcgagugugugugcauaaacggcacuuguacagucgugaugaccgaugggucugcuuccggaaaggcagacacuaaaauccucuuuauugaggaagguaagaucgugcauacaucaaccuuaagcggcagugcccaacacgucgaggaaugcucuugcuauccucgcuacccagggguuagaugugugugcagggauaacuggaagggauccaaucggccgauaguagacauuaacaucaaagaucacagcaucgugucgucuuacgucuguuccggccuggugggugacacgccccgcaagaaugacucaaguagcuccucucauugccuugauccuaacaaugaggaagggggacacggcguuaaaggcugggcuuucgacgaugggaacgacguguggaugggacgaaccauuagcgagaagucaagauuggguuaugagacauuuaaagucaucgaaggcuggaguaauccaaaguccaaacugcagauuaacaggcaagugauaguagaucgggggaaucguagcggauacucuggcaucuucucaguugaggguaagaguuguauuaaccgcugcuuuuauguggaacuaaucagagggaggaaggaggaaacugagguccucuggaccagcaauuccaucguggucuucuguggcacaucuggaacuuacggcaccgggucguggcccgacggagccgauauuaaccugaugccuauauga

SEQ ID NO: 142471 - RNA, 1410 nt, Artificial Sequence; identical to SEQ ID NO: 138615
  derived and/or modified sequence opt3 from neuraminidase__InfluenzaA__AEA03766

SEQ ID NO: 142472 - RNA, 1410 nt, Artificial Sequence; identical to SEQ ID NO: 138615
  derived and/or modified sequence opt3 from neuraminidase__InfluenzaA__AEA03796

SEQ ID NO: 142473 - RNA, 1410 nt, Artificial Sequence; identical to SEQ ID NO: 138615
  derived and/or modified sequence opt3 from neuraminidase__InfluenzaA__AEA03806

SEQ ID NO: 142474 - RNA, 1410 nt, Artificial Sequence
  derived and/or modified sequence opt3 from neuraminidase__InfluenzaA__AEA03817
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugaccgauguuaccaauucgcgcuaggccaggggacgacucucaauaacguccauucaaauaacaccgugcgugauagaacaccauauaggacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggacggcugguggauuccguaguuucauggaguaaggagauucugcgcacgcaggaaagcgagugugugugcauaaacggcacuuguacagucgugaugaccgacggcucugcuuccgggaaagcagauacuaagauccucuuuauugaggaaggaaaaaucgugcauacaucaaccuuaagcgguagugcccaacacgucgaggaaugcucuugcuauccuagauacccaggcguuaggugugugugccgggacaacuggaagggguccaaucgcccgauaguagauauuaacaucaaggaccacagcaucgugucgucuuacgucuguuccggacuggugggcgacacgccccggaaaaaugauucaaguagcuccucucauugccuugacccuaacaaugaggaaggugggcacggaguuaagggcugggcuuucgaugacggcaacgauguguggauggggagaaccauuagcgagaaaucaagguugggauaugagacauuuaaggucaucgaagguuggaguaauccaaaauccaagcugcagauuaaccgacaggugauaguagaccguggcaaucgcagcggguacucuggaaucuucucaguugagggcaaaaguuguauuaacagaugcuuuuauguggaacuaaucaggggucggaaggaggaaacugagguccucuggaccagcaauuccaucguggucuucugugggacaucuggcacuuacggaaccggcucguggcccgauggggccgacauuaaccugaugccuauauga

SEQ ID NO: 142475 - RNA, 1410 nt, Artificial Sequence; identical to SEQ ID NO: 138615
  derived and/or modified sequence opt3 from neuraminidase__InfluenzaA__AEA03828

SEQ ID NO: 142476 - RNA, 1410 nt, Artificial Sequence; identical to SEQ ID NO: 138615
  derived and/or modified sequence opt3 from neuraminidase__InfluenzaA__AEA03838

SEQ ID NO: 142477 - RNA, 1410 nt, Artificial Sequence; identical to SEQ ID NO: 141771
  derived and/or modified sequence opt3 from neuraminidase__InfluenzaA__AEA03849

SEQ ID NO: 142478 - RNA, 1410 nt, Artificial Sequence; identical to SEQ ID NO: 138615
  derived and/or modified sequence opt3 from neuraminidase__InfluenzaA__AEA03860

SEQ ID NO: 142479 - RNA, 1410 nt, Artificial Sequence
  derived and/or modified sequence opt3 from neuraminidase__InfluenzaA__AEA03871
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaucaccgacggcucugcuuccgggaaggcagauacuaaaauucucuuuaucgaggaaggaaagauagugcauacaucaaccuuaagcgguagugcccaacacgucgaggaaugcucuugcuauccucgcuacccaggcguuagaugugugugcagggacaacuggaagggguccaaucggccgauuguagauaucaacaucaaagaccacagcauugugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccaucagcgagaagucaagauugggauaugagacauuuaaagucauugaagguuggaguaauccaaaguccaaacugcagauaaacaggcaagugaucguagaccggggcaaucguagcggguacucuggaauuuucucaguugagggcaagaguuguaucaaccgcugcuuuuauguggaacuaaucagagguaggaaggaggaaacugagguccucuggaccagcaauuccauuguggucuucugugggacaucuggcacuuacggaaccggcucguggcccgauggggccgacauaaaccugaugccuaucuga

SEQ ID NO: 142480 - RNA, 1410 nt, Artificial Sequence; identical to SEQ ID NO: 138615
  derived and/or modified sequence opt3 from neuraminidase__InfluenzaA__AEA03879

SEQ ID NO: 142481 - RNA, 1410 nt, Artificial Sequence
  derived and/or modified sequence opt3 from neuraminidase__InfluenzaA__AEA03889
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaaggugcgagaucguaccccauauagaacacugcuuaugaaugaacugggaguucccuuucacuugggcacuaaacaggugugcauugcuuggagcaguuccucuugucaugacgguaaggccuggcuccacgucugcaucaccggggaugacaaaaacgcaacagccagcuucaucuacaauggaaggcugguggauuccguaguuucauggaguaaggagauucugcggacccaggaaagcgagugugugugcauaaacggcacguguacugucgugaugacagacggcucugcuuccgggaaagcagauaccaagauccucuuuauugaggaaggaaagaucgugcauacuucaacauuaagcgguagugcccaacacgucgaggaaugcucuugcuauccucgcuacccaggcguuagaugugugugcagggacaacuggaaaggguccaaucggccgauaguagauauuaacaucaaggaccacagcaucgugucgucuuacgucuguuccggacuggugggcgacacccccaggaaaaaugauucaaguagcuccucucauugccuugacccuaacaaugaggaaggugggcacggaguuaagggcugggcuuucgaugacggcaacgauguguggauggggcgaacgauuagcgagaaaucaagauugggauaugagaccuuuaaggucaucgaagguuggaguaauccaaaauccaagcugcagauuaaccgccaggugauaguagaccggggcaaucguagcggguacucuggaaucuucucaguugagggcaagaguuguauuaaccgcugcuuuuauguggaacuaaucagagguaggaaagaggaaacagagguccucuggacuagcaauuccaucguggucuucugugggaccucuggcacauacggaacuggcucguggcccgauggggccgacauuaaccugaugccuauauga

SEQ ID NO: 142482 - RNA, 1410 nt, Artificial Sequence
  derived and/or modified sequence opt3 from neuraminidase__InfluenzaA__AEA03898
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagucagauaguagcuccucuagccauugccuugacccuaauaacgaggaaggugggcacggaguuaaaggcugggcuuucgaugacggcaaugauguguggauggggcgaaccauuucagagaagaguagauugggauaugagacauuuaaagucaucgaagguugguccaacccaaagagcaaacugcagauuaauaggcaagugauaguagaccggggcaaccguucuggguacucaggaaucuucaguguugagggcaagagcuguauuaaucgcugcuuuuauguggaacuaaucagagguaggaaggaggaaacugagguccucuggaccuccaacucuaucguggucuucugugggacaucgggcacuuacggaaccggcagcuggcccgauggggccgacauuaaucugaugccuauauga

SEQ ID NO: 142483 - RNA, 1410 nt, Artificial Sequence; identical to SEQ ID NO: 138615
  derived and/or modified sequence opt3 from neuraminidase__InfluenzaA__AEA03909

SEQ ID NO: 142484 - RNA, 1410 nt, Artificial Sequence
  derived and/or modified sequence opt3 from neuraminidase__InfluenzaA__AEA03924
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucauacauacaucaaccuuaagcgguagugcccaacacguggaggaaugcucuugcuauccucgcuacccaggcgucagauguguuugcagggacaacuggaagggguccaaucggccgauuguggauaucaacaucaaagaccacagcauuguaucgucuuacguguguuccggacuggucggcgacacgccccgcaagaaugauucaaguagcuccucucauugccuugacccuaacaaugaggaaggugggcacggagugaaaggcugggcuuucgaugacggcaacgauguuuggauggggcgaaccaucagcgagaagucaagauugggauaugagacauuuaaagugauugaagguuggaguaauccaaaguccaaacugcagauaaacaggcaggucaucguggaccggggcaaucguagcggguacucuggaauuuucucaguagagggcaagaguuguaucaaccgcugcuuuuauguugaacuaaucagagguaggaaggaggaaacugaggugcucuggaccagcaauuccauugucguguucugugggacaucuggcacuuacggaaccggcucguggcccgauggggccgacauaaaccugaugccuaucuga

SEQ ID NO: 142485 - RNA, 1410 nt, Artificial Sequence; identical to SEQ ID NO: 138615
  derived and/or modified sequence opt3 from neuraminidase__InfluenzaA__AEA03935

SEQ ID NO: 142486 - RNA, 1410 nt, Artificial Sequence
  derived and/or modified sequence opt3 from neuraminidase__InfluenzaA__AEA03946
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggagugaggaaauucugcggacgcaggagagcgagugugugugcauaaacggcacuuguacagucgugaugaccgacggcucugcuuccgggaaagcagauacuaagauccucuuuauugaagagggaaaaaucgugcauacaucaaccuuaagcgguagugcccaacacgucgaagagugcucuugcuauccucgcuacccaggcguuagaugugugugcagggacaacuggaagggguccaaucggccgauaguagauauuaacaucaaggaccacagcaucgugucgucuuacgucuguuccggacuggugggcgacacgccccgcaaaaaugauucaaguagcuccucucauugccuugacccuaacaaugaagagggugggcacggaguuaagggcugggcuuucgaugacggcaacgauguguggauggggcgaaccauuagcgagaaaucaagauugggauaugaaacauuuaaggucaucgaggguuggaguaauccaaaauccaagcugcagauuaacaggcaagugauaguagaccggggcaaucguagcggguacucuggaaucuucucaguugaaggcaaaaguuguauuaaccgcugcuuuuauguggagcuaaucagagguaggaaggaagagacugagguccucuggaccagcaauuccaucguggucuucugugggacaucuggcacuuacggaaccggcucguggcccgauggggccgacauuaaccugaugccuauauga

SEQ ID NO: 142487 - RNA, 1410 nt, Artificial Sequence
  derived and/or modified sequence opt3 from neuraminidase__InfluenzaA__AEA03957
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaagucaagauugggauaugagacauuuaaagucaucgaagguuggaguaauuccaagagcaaacugcagauuaacaggcaagugauaguagaccggggcaaucguucuggguacucaggaaucuucaguguugagggcaagagcuguauuaaccgcugcuuuuauguggaacuaaucagagguaggaaggaggaaacugagguccucuggaccuccaauucuaucguggucuucugugggacaucgggcacuuacggaaccggcagcuggccagauggggccgacauuaaccugaugcccauauga

SEQ ID NO: 142488 - RNA, 1410 nt, Artificial Sequence; identical to SEQ ID NO: 138615
  derived and/or modified sequence opt3 from neuraminidase__InfluenzaA__AEA03989

SEQ ID NO: 142489 - RNA, 1410 nt, Artificial Sequence; identical to SEQ ID NO: 141771
  derived and/or modified sequence opt3 from neuraminidase__InfluenzaA__AEA04000

SEQ ID NO: 142490 - RNA, 1410 nt, Artificial Sequence; identical to SEQ ID NO: 138615
  derived and/or modified sequence opt3 from neuraminidase__InfluenzaA__AEA04011

SEQ ID NO: 142491 - RNA, 1410 nt, Artificial Sequence; identical to SEQ ID NO: 141771
  derived and/or modified sequence opt3 from neuraminidase__InfluenzaA__AEA04022

SEQ ID NO: 142492 - RNA, 1410 nt, Artificial Sequence; identical to SEQ ID NO: 138615
  derived and/or modified sequence opt3 from neuraminidase__InfluenzaA__AEA04033

SEQ ID NO: 142493 - RNA, 1410 nt, Artificial Sequence; identical to SEQ ID NO: 138615
  derived and/or modified sequence opt3 from neuraminidase__InfluenzaA__AEA04044

SEQ ID NO: 142494 - RNA, 1410 nt, Artificial Sequence; identical to SEQ ID NO: 138615
  derived and/or modified sequence opt3 from neuraminidase__InfluenzaA__AEA04049

SEQ ID NO: 142495 - RNA, 1410 nt, Artificial Sequence; identical to SEQ ID NO: 138615
  derived and/or modified sequence opt3 from neuraminidase__InfluenzaA__AEA04059

SEQ ID NO: 142496 - RNA, 1410 nt, Artificial Sequence; identical to SEQ ID NO: 138615
  derived and/or modified sequence opt3 from neuraminidase__InfluenzaA__AEA04070

SEQ ID NO: 142497 - RNA, 1410 nt, Artificial Sequence; identical to SEQ ID NO: 141771
  derived and/or modified sequence opt3 from neuraminidase__InfluenzaA__AEA04081

SEQ ID NO: 142498 - RNA, 1410 nt, Artificial Sequence; identical to SEQ ID NO: 138615
  derived and/or modified sequence opt3 from neuraminidase__InfluenzaA__AEA04092

SEQ ID NO: 142499 - RNA, 1410 nt, Artificial Sequence; identical to SEQ ID NO: 138615
  derived and/or modified sequence opt3 from neuraminidase__InfluenzaA__AEA04103

SEQ ID NO: 142500 - RNA, 1410 nt, Artificial Sequence; identical to SEQ ID NO: 138615
  derived and/or modified sequence opt3 from neuraminidase__InfluenzaA__AEA04125

SEQ ID NO: 142501 - RNA, 1410 nt, Artificial Sequence; identical to SEQ ID NO: 138615
  derived and/or modified sequence opt3 from neuraminidase__InfluenzaA__AEA04133

SEQ ID NO: 142502 - RNA, 1410 nt, Artificial Sequence
  derived and/or modified sequence opt3 from neuraminidase__InfluenzaA__AEA04144
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucauacauacaucaaccuuaagcgguagugcccaacacguggaggaaugcucuugcuauccucgcuacccaggcgucagauguguuugcagggacaacuggaagggguccaaucggccgauuguggauaucaacaucaaagaccacagcauuguaucgucuuacguguguuccggacuggucggcgacacgccccgcaagaaugauucaaguagcuccucucauugccuugacccuaacaaugaggaaggugggcacggagugaaaggcugggcuuucgaugacggcaacgauguuuggauggggcgaaccaucagcgagaagucaagauugggauaugagacauuuaaagugauugaagguuggaguaauccaaaguccaaacugcagauaaacaggcaggucaucguggaccggggcaaucguagcggguacucuggaauuuucucaguagagggcaagaguuguaucaaccgcugcuuuuauguugaacuaaucagagguaggaaggaggaaacugaggugcucuggaccagcaauuccauuauagucuucugugggacaucuggcacuuacggaaccggcucguggcccgauggggccgacaucaaccugaugccuauuuga

SEQ ID NO: 142503 - RNA, 1410 nt, Artificial Sequence; identical to SEQ ID NO: 138615
  derived and/or modified sequence opt3 from neuraminidase__InfluenzaA__AEA04155

SEQ ID NO: 142504 - RNA, 1410 nt, Artificial Sequence; identical to SEQ ID NO: 138615
  derived and/or modified sequence opt3 from neuraminidase__InfluenzaA__AEA04166

SEQ ID NO: 142505 - RNA, 1410 nt, Artificial Sequence
  derived and/or modified sequence opt3 from neuraminidase__InfluenzaA__AEA04177
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgaaaucguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaacggcacuuguacagucgugaugaccgauggcucugcuuccgggaaggcagacacuaaaauccucuuuauugaggaaggaaagaucgugcauacaucaaccuuaagcgguagugcccaacacgucgaggaaugcucuugcuauccucgcuacccaggcguuagaugugugugcagggauaauuggaagggguccaaccggccgauaguagacauuaauaucaaagaucacagcaucgugucgucuuacgucuguuccggacuggugggcgacacgccccgcaagaacgacucaaguagcuccucucauugccuugauccuaauaacgaggaaggugggcacggaguuaaaggcugggcuuucgacgauggcaaugacguguggauggggcgaaccauuagcgagaagucaagauugggauaugagacauuuaaagucaucgaagguuggaguaacccaaaguccaaacugcagauuaauaggcaagugauaguagaucggggcaaccguagcggguacucuggaaucuucucaguugagggcaagaguuguauuaaucgcugcuuuuauguggaacuaaucagagguaggaaggaggaaacugagguccucuggaccagcaacuccaucguggucuucugugggacaucuggcacuuacggaaccggcucguggcccgacggggccgauauuaaucugaugccuauauga

SEQ ID NO: 142506 - RNA, 1410 nt, Artificial Sequence; identical to SEQ ID NO: 138615
  derived and/or modified sequence opt3 from neuraminidase__InfluenzaA__AEA04188

SEQ ID NO: 142507 - RNA, 1410 nt, Artificial Sequence; identical to SEQ ID NO: 139608
  derived and/or modified sequence opt3 from neuraminidase__InfluenzaA__AEA04199

SEQ ID NO: 142508 - RNA, 1410 nt, Artificial Sequence; identical to SEQ ID NO: 138615
  derived and/or modified sequence opt3 from neuraminidase__InfluenzaA__AEA04210

SEQ ID NO: 142509 - RNA, 1410 nt, Artificial Sequence; identical to SEQ ID NO: 139608
  derived and/or modified sequence opt3 from neuraminidase__InfluenzaA__AEA04229

SEQ ID NO: 142510 - RNA, 1410 nt, Artificial Sequence; identical to SEQ ID NO: 139608
  derived and/or modified sequence opt3 from neuraminidase__InfluenzaA__AEA04239

SEQ ID NO: 142511 - RNA, 1410 nt, Artificial Sequence
  derived and/or modified sequence opt3 from neuraminidase__InfluenzaA__AEA04250
augaaccccaaucagaagaucauuaccauaggcagcgugucccugacaaucucuacuauuugcuucuuuaugcaaacggccauccucauuaccacagucacucuucacuucaaacagugugaguuuaacucaccuccaaauaaccagguuaugcugugcgaaccgaccaucauagagagaaauaucacagaaauuguguacuugaccaacacuacaaucgagaaggaaauuugucccaaauuagcugaguauaggaauuggaguaagccucagugcgacaucaccggguucgcaccauuuagcaaagauaacuccauacggcugucugccggaggugacauuuggguaacgcgcgagcccuacgugucgugugauccugacaagugcuaucaauucgcgcuaggccaggggacuacccucaauaacguccauucaaauaacacagugcgaguucguacuccauacagaacccugcuuaugaaugaacugggagugcccuuucacuugggcacaaagcaggucuguaucgcuuggagcaguuccucuugccaugaugguaaagccuggcuccacguguguauuaccggggacgauaagaacgcaacggccagcuucaucuauaauggaaggcugguagacuccguugugucauggaguaaagagauccugcggacucaggaaagcgagugcgucuguauuaacggcacaugcaccguggugaugacugauggcucugcuuccgggaaggcagacacaaaaauacucuuuaucgaggaaggaaagauuguccauaccucaacguuaagcgguagugcccaacacguugaggaaugcucuuguuacccucgcuauccaggcgugagaugcguauguagggauaacuggaagggguccaaucggccgaucguggacauaaacauuaaagaucacagcaucgucucgucuuacgugugcuccggacugguuggcgacacaccccgcaagaaugacucaaguagcuccucucauugucuugauccuaacaaugaggaaggugggcacggagugaaaggcugggcuuucgacgauggcaacgacgucuggauggggcgaaccaucagcgagaagucaagauugggauacgagacuuuuaaagugauugaagguuggaguaauccaaaguccaaacugcagaucaacaggcagguaauuguugaucggggcaaucguagcggguauucuggaauauucucaguggagggcaagaguugcaucaaccgcuguuuuuacgucgaacuaauuagagguaggaaggaggaaaccgaggugcucuggacaagcaauuccaucgucguguucugcgggacuucuggcaccuauggaacaggcucguggcccgacggggccgauaucaaccugaugccuauuuga

SEQ ID NO: 142512 - RNA, 1410 nt, Artificial Sequence; identical to SEQ ID NO: 139608
  derived and/or modified sequence opt3 from neuraminidase__InfluenzaA__AEA04260

SEQ ID NO: 142513 - RNA, 1410 nt, Artificial Sequence
  derived and/or modified sequence opt3 from neuraminidase__InfluenzaA__AEA04268
augaaccccaaucagaagaucauuaccauaggcagcgugucccugacaaucucuacuauuugccucuucaugcaaacggccauccuuauuaccacagucacucugcacuuuaaacagugugaguucaacucaccuccaaauaaccaggcuauguugugcgaaccgaccaucauagagagaaauaucacagaaauuguuuacuuaaccaacacuacaaucgagaaggaaauuugucccaaacuggcagaguauaggaauuggaguaagccucagugcgacaucaccggguuugccccauucagcaaagauaacuccauacggcuaucugcgggaggugacauuugggugacgcgcgagcccuacguaucgugugauccugacaagugcuaucaauuugcucucggccaggggacuacccugaauaacgugcauucaaauaacacaguccgagaucguacuccauacagaacccuucugaugaaugaauugggagugcccuuccaccucggcacaaagcagguuuguaucgccuggagcaguuccucuugccaugacgguaaagcauggcugcacguguguauuaccggggaugacaagaacgccacggcuagcuuuaucuauaauggaaggcuggucgauuccgugguaucauggaguaaagagauccuccggacucaggaaagcgagugcguuuguauuaacggcacaugcaccguggucaugacugacggcucugcauccgggaaggccgauacaaaaauauuauucaucgaggaaggaaagauugugcauaccucaacgcugagcgguagugcucaacacguggaggaaugcucuuguuacccucgcuauccaggcgucagaugcguuuguagggacaacuggaagggguccaaucggccgaucguggauauaaacauuaaagaccacagcaucguaucgucuuacgugugcuccggacuugucggcgacacaccccgcaagaaugauucaaguagcuccucucauuguuuggacccuaacaaugaggaaggugggcacggagugaaaggcugggccuuugaugacggcaacgauguuuggauggggcgaaccaucagcgagaagucaagacugggauacgagacuuucaaagugauugaagguuggaguaauccaaaguccaaacuacagaucaacaggcaggucauuguggaccggggcaaucguagcggguauucuggaauauuuucaguagagggcaagaguugcaucaaccgcuguuucuacguugaacucauuagagguaggaaggaggaaaccgaggugcuguggacaagcaauuccaucgucguguuuugcgggacuucuggcaccuauggaacaggcucguggcccgauggggcggacaucaaccuuaugccuauuuga

SEQ ID NO: 142514 - RNA, 1410 nt, Artificial Sequence; identical to SEQ ID NO: 139608
  derived and/or modified sequence opt3 from neuraminidase__InfluenzaA__AEA04276

SEQ ID NO: 142515 - RNA, 1410 nt, Artificial Sequence; identical to SEQ ID NO: 139608
  derived and/or modified sequence opt3 from neuraminidase__InfluenzaA__AEA04287

SEQ ID NO: 142516 - RNA, 1410 nt, Artificial Sequence; identical to SEQ ID NO: 139608
  derived and/or modified sequence opt3 from neuraminidase__InfluenzaA__AEA04298

SEQ ID NO: 142517 - RNA, 1410 nt, Artificial Sequence
  derived and/or modified sequence opt3 from neuraminidase__InfluenzaA__AEA04307
augaaccccaaucagaagaucauuaccauaggcagcgugucccugacaaucucuacuauuugcuucuuuaugcaaacggccauccucauuaccacagucacucuucacuucaaacagugugaguuuaacucaccuccaaauaaccagguuaugcugugcgaaccgaccaucauagagagaaauaucacagaaauuguguacuugaccaacacuacaaucgagaaggaaauuugucccaaauuagcugaguauaggaauuggaguaagccucagugcgacaucaccggguucgcaccauuuagcaaagauaacuccauacggcugucugccggaggugacauuuggguaacgcgcgagcccuacgugucgugugauccugacaagugcuaucaauucgcgcuaggccaggggacuacccucaauaacguccauucaaauaacacagugcgagaucguacuccauacagaacccugcuuaugaaugaacugggaguucccuuucacuugggcacaaaacagguguguaucgcuuggagcaguuccucuugccaugacgguaaggccuggcuccacgucuguauuaccggggaugacaagaacgcaacggccagcuucaucuauaauggaaggcugguggauuccguaguuucauggaguaaagagauccugcggacucaggaaagcgagugcguguguauuaacggcacaugcaccgucgugaugacugacggcucugcuuccgggaaggcagauacaaaaauacucuuuaucgaggaaggaaagauugugcauaccucaacguuaagcgguagugcccaacacgucgaggaaugcucuuguuacccucgcuauccagacguuagaugcguguguagggauaacuggaagggcuccaaucggccgaucguagacauaaacauuaaagaccacagcaucgugucgucuuacgucugcuccgggcuggugggagauacccccaggaagaaugacucaaguagcuccucucauugucuugauccuaacaaugaggaaggcggucacgggguuaaaggaugggcuuucgacgauggcaacgacguguggaugggccgaacaaucagcgagaagucaagauugggguacgagacuuuuaaagucauugaaggauggaguaauccaaaguccaaacugcagaucaaccgccaggugauuguagaucgggguaaucguagcggcuauucugggauauucucaguugagggaaagaguugcaucaaccgcuguuuuuacguggaacuaauuagaggcaggaaggaggaaaccgagguccucuggacaagcaauuccaucguggucuucugcgguacuucugggaccuauggcacaggaucguggcccgacggcgccgauaucaaccugaugccuauuuga

SEQ ID NO: 142518 - RNA, 1395 nt, Artificial Sequence
  derived and/or modified sequence opt3 from neuraminidase__InfluenzaA__AEA04357
augaaccccaaucagaagaucauuaccauaggcagcaucugcaugguggucgggauuaucucccugauucuccaaaucggaaacauaguuucuaucuggauuucacacaguauccagacagguaaucagaaccauacuggcacgugugaccagagcauuaucaccuacaaaaauuccacaugggugaaccaaacuuauguaaauguggucgccgggaaggauaccacaucugugauacuugcuggaaacucgucacugugcccuauuagaggcugggcaaucuacagcaaagacaaugguguuaggauugggaguaagggagauguguucgucauccgggagccauuuaucuccuguucucacuuggaaugccgcaccuucuuuuuaacucagggcgcccugcuaaacgacaaacauagcaauggcacagugaaggaucgauccccguaucgugcgcucaugucaugucccguaggggaggcuccuaguccauacaacagcagauucgaaucuguugccugguccgcaucagccugccacgacggaauggguuggcugaccauuggcauaagcgggcccgaugacggagcuguggcaguccuuaaguauaauggcaucauuacggagacuaucaaaaguuggaggaaggaaauacugcggacccaggagucugagugugugugcgugaacgguuccuguuuuacaauuaugacugaugggccuagcggaggcccagccucguacaaaaucuucaagaucgaaaaaggcaaggucaccaagucuauugaguuggacgcucccaauucccauuaugaagagugcucauguuacccugauacaaguaaaguuaugugcgugugccgcgacaacuggcacgggagcaacagaccauggguauccuuugaucagaaucucgacuaccaaaugggauauaucuguucugguguguucggcgacaacccgaggcccaaggaugggaaaggaagcugcggcccugucuacguggacggugccaaugggguuaagggcuuuucauauaaauacggaaacggcguguggauugggcggaccaagaguauauccagccgccagggauucgagaugaucugggauccaaaugguuggacggaaacugacucuaacuuuuucacaaaacaggaugucguggcgguaaccgacuggucaggcuauagugggagcuuuguucagcaccccgagcugacuggacuggauuguaugcgaccuugcuucuggguggaacucauuagaggcaggccaaaggagaauacaaucuggaccuccgguucuucgaucagcuucuguggggucaacuccgacacgguggauuggucauggcccgacggcgcagaauuaccguuuaccauugauaaguga

SEQ ID NO: 142519 - RNA, 1410 nt, Artificial Sequence; identical to SEQ ID NO: 138483
  derived and/or modified sequence opt3 from neuraminidase__InfluenzaA__AEA04368

SEQ ID NO: 142520 - RNA, 1410 nt, Artificial Sequence
  derived and/or modified sequence opt3 from neuraminidase__InfluenzaA__AEA04379
augaaccccaaucagaagaccaucacaauuggcagcgugucccugacuauagagacggucugcuuccucaugcaaaucgccauucuugcuaccacaguuacucugcacuuuaaacagcaugaaugugacucuccugcaucaaaccaggugaugccaugcgagccgaucauuaucgaaagaaauauaaccgagaucguauacuugaacaauacaaccauugaaaaggagaucugucccgagguggucgaauauaggaacuggaguaaaccucagugccaaauuacuggguucgccccauuuagcaaggauaauuccauccgguuaucugcgggaggugacauaugggugacacgcgagcccuacguuucgugugauccuggcaaaugcuaucaguucgcucuggggcagggaaccacgcuagacaacaagcacucaaauggcacuauucaugaucgaaucccacaccguacccuccugaugaacgaacuuggugugcccuuucaucuggggacaaagcaggucuguguggccuggagcaguuccucuugccacgacggaaaagcaugguugcacguauguguuacuggcgaugacagaaaugccaccgcuagcuucauuuacgauggcaggcucguggacuccaucgggucauggagucaaaacauccugcggacacaggagagcgagugcgucuguauuaauggaaccugcacgguggugaugacugaugguucugcauccggccgcgccgacacaagaauacuguuuaucaaggaagggaaaauuguccauaucucaccucucagcggaagugcucagcacauagaggaaugcucuuguuauccaagguacccggauguucggugcauuugucgcgacaacuggaagggcuccaaucgacccgugaucgacaucaacauggaggauuauagcauugacucgucuuacguaugcuccgguuuagugggggauaccccuagaaacgacgauucaaguagcaauuccaaaucuagggacccaaacaaugaacggggaaaccccggcgucaagggcugggccuucgauaauggggacgauguguggaugggacguacuaucagcaaggacucacgcagugguuacgagacauuuaaaguuauuggcgggugguccaccccuaacagcaagucucaggugaauagacaagucauaguggauaacaauaacuggucaggauauaguggcaucuucagcguagaggguaaauccuguauuaauaggugcuuuuacguugaacugauccgggggcgaccacaggagacgcgcgugugguggaccucuaacucgaucgucguguucuguggcacaagcggaacuuauggcaccggguccuggcccgacggagcgaauauuaacuuuaugccgauauga

SEQ ID NO: 142521 - RNA, 1413 nt, Artificial Sequence; identical to SEQ ID NO: 142220
  derived and/or modified sequence opt3 from neuraminidase__InfluenzaA__AEA10295

SEQ ID NO: 142522 - RNA, 1410 nt, Artificial Sequence; identical to SEQ ID NO: 138754
  derived and/or modified sequence opt3 from neuraminidase__InfluenzaA__AEA10306

SEQ ID NO: 142523 - RNA, 1410 nt, Artificial Sequence; identical to SEQ ID NO: 142107
  derived and/or modified sequence opt3 from neuraminidase__InfluenzaA__AEA10316

SEQ ID NO: 142524 - RNA, 1410 nt, Artificial Sequence; identical to SEQ ID NO: 138754
  derived and/or modified sequence opt3 from neuraminidase__InfluenzaA__AEA10326

SEQ ID NO: 142525 - RNA, 1410 nt, Artificial Sequence; identical to SEQ ID NO: 140042
  derived and/or modified sequence opt3 from neuraminidase__InfluenzaA__AEA10335

SEQ ID NO: 142526 - RNA, 1410 nt, Artificial Sequence; identical to SEQ ID NO: 138754
  derived and/or modified sequence opt3 from neuraminidase__InfluenzaA__AEA10342

SEQ ID NO: 142527 - RNA, 1410 nt, Artificial Sequence
  derived and/or modified sequence opt3 from neuraminidase__InfluenzaA__AEA10352
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcaucaacgggucguguuucaccgugaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcuccccuguuagcucuaauggagcgaacggugugaagggcuucucauuuaaguaugggaacggaguauggaucggccggacaaaaaguauuagcucccgcaaugguuucgagaugauaugggauccaaacggguggaccggcacggacaauaacuuuucuaucaagcaagacauugugggaaucaaugaauggucgggcuacagcggguccuucguccagcaucccgagcugacuggacuggauuguauucgaccuugcuucuggguggaacucaucagagguaggccaaaagagaacacaauauggaccucaggcaguucuaucagcuuuugugggguuaauuccgacacugugggauggucauggcccgauggcgcagaguuaccguucacaauugacaaguga

SEQ ID NO: 142528 - RNA, 1410 nt, Artificial Sequence; identical to SEQ ID NO: 138754
  derived and/or modified sequence opt3 from neuraminidase__InfluenzaA__AEA48991

SEQ ID NO: 142529 - RNA, 1410 nt, Artificial Sequence; identical to SEQ ID NO: 141426
  derived and/or modified sequence opt3 from neuraminidase__InfluenzaA__AEA72707

SEQ ID NO: 142530 - RNA, 1410 nt, Artificial Sequence; identical to SEQ ID NO: 141426
  derived and/or modified sequence opt3 from neuraminidase__InfluenzaA__AEA72718

SEQ ID NO: 142531 - RNA, 1410 nt, Artificial Sequence; identical to SEQ ID NO: 141426
  derived and/or modified sequence opt3 from neuraminidase__InfluenzaA__AEA72729

SEQ ID NO: 142532 - RNA, 1410 nt, Artificial Sequence
  derived and/or modified sequence opt3 from neuraminidase__InfluenzaA__AEA72742
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucggucggacaaaaaguauuagcucccgcaacggguucgagaugauaugggauccaaauggcuggaccggaacggacaacaauuuuucuaucaagcaagacauugugggcaucaacgaauggucgggguacagcggauccuucguccagcaucccgagcugacuggucuggauuguauucgaccuugcuucuggguggaacucaucagaggcaggccaaaagagaauacaauauggaccucagggaguucuaucagcuuuuguggaguuaacuccgacacugugggcuggucauggcccgauggugcagaguuaccguucacaauugacaaguga

SEQ ID NO: 142533 - RNA, 1410 nt, Artificial Sequence; identical to SEQ ID NO: 141029
  derived and/or modified sequence opt3 from neuraminidase__InfluenzaA__AEA72779

SEQ ID NO: 142534 - RNA, 1410 nt, Artificial Sequence
  derived and/or modified sequence opt3 from neuraminidase__InfluenzaA__AEA72789
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacgauucuauuagaaucggcagcaaaggugacguuuuugugauuagggagccauucaucuccuguucaccguuagaaugccggaccuuuuuccugacacagggggcucuacucaaugauaagcauaguaacggaaccaucaaagaccgcagccccuaucgaacucugaugucuuguccuauuggcgaggucccaucccccuacaauucacguuuugaaagcguggccuggagugcaucugccugccacgauggcauaaacuggcuuacaaucgggauuuccggaccugacaacggugcuguagcaguucugaaguauaauggcaucauaaccgauacgauuaagagcuggagaaacaauaucuugaggacucaagagucggagugugccugcgugaacgggucuuguuucaccgucaugacagacggaccauccgauggccaggcuucauacaaaaucuuucggauugaaaaggguaaaaucgugaagaguguggagaugaaugcccccaacuaucauuacgaagagugcagcuguuacccugacuccucugagauuacuugcgucugccgcgauaauuggcacgggagcaacagaccauggguuucauucaaucagaaccucgaauaucagauaggauacaucuguaguggcauuuuuggcgacaauccgaggcccaacgauaaaaccggguccugcggaccugugagcucuaauggugcgaacggcguaaagggguucucauuuaaguauggaaauggcguguggaucggucggacaaaaaguaucagcucccgcaacggguucgagaugauuugggacccaaacggcuggaccggaacggacaauaacuuuucuauaaagcaagauaucgucggcauuaaugaauggucgggguacagcggauccuucgugcagcaucccgagcugacuggucuggacuguauccgaccuugcuucuggguugaacucauuagaggcaggccaaaagagaacacaaucuggaccucagggaguucuauaucauuuuguggagucaauuccgauacugugggcuggucauggcccgacggugcagaguuaccguucacaaucgauaaguga

SEQ ID NO: 142535 - RNA, 1410 nt, Artificial Sequence; identical to SEQ ID NO: 141426
  derived and/or modified sequence opt3 from neuraminidase__InfluenzaA__AEA73291

SEQ ID NO: 142536 - RNA, 1410 nt, Artificial Sequence; identical to SEQ ID NO: 141426
  derived and/or modified sequence opt3 from neuraminidase__InfluenzaA__AEA73302

SEQ ID NO: 142537 - RNA, 1410 nt, Artificial Sequence; identical to SEQ ID NO: 141426
  derived and/or modified sequence opt3 from neuraminidase__InfluenzaA__AEA73313

SEQ ID NO: 142538 - RNA, 1410 nt, Artificial Sequence; identical to SEQ ID NO: 141426
  derived and/or modified sequence opt3 from neuraminidase__InfluenzaA__AEA73324

SEQ ID NO: 142539 - RNA, 1410 nt, Artificial Sequence; identical to SEQ ID NO: 141426
  derived and/or modified sequence opt3 from neuraminidase__InfluenzaA__AEA73335

SEQ ID NO: 142540 - RNA, 1410 nt, Artificial Sequence; identical to SEQ ID NO: 141426
  derived and/or modified sequence opt3 from neuraminidase__InfluenzaA__AEA73346

SEQ ID NO: 142541 - RNA, 1410 nt, Artificial Sequence; identical to SEQ ID NO: 141426
  derived and/or modified sequence opt3 from neuraminidase__InfluenzaA__AEA73357

SEQ ID NO: 142542 - RNA, 1410 nt, Artificial Sequence; identical to SEQ ID NO: 141426
  derived and/or modified sequence opt3 from neuraminidase__InfluenzaA__AEA73368

SEQ ID NO: 142543 - RNA, 1410 nt, Artificial Sequence; identical to SEQ ID NO: 141426
  derived and/or modified sequence opt3 from neuraminidase__InfluenzaA__AEA73379

SEQ ID NO: 142544 - RNA, 1410 nt, Artificial Sequence; identical to SEQ ID NO: 141426
  derived and/or modified sequence opt3 from neuraminidase__InfluenzaA__AEA73390

SEQ ID NO: 142545 - RNA, 1410 nt, Artificial Sequence; identical to SEQ ID NO: 141426
  derived and/or modified sequence opt3 from neuraminidase__InfluenzaA__AEA73401

SEQ ID NO: 142546 - RNA, 1410 nt, Artificial Sequence; identical to SEQ ID NO: 141426
  derived and/or modified sequence opt3 from neuraminidase__InfluenzaA__AEA73412

SEQ ID NO: 142547 - RNA, 1410 nt, Artificial Sequence; identical to SEQ ID NO: 141426
  derived and/or modified sequence opt3 from neuraminidase__InfluenzaA__AEA73423

SEQ ID NO: 142548 - RNA, 1410 nt, Artificial Sequence; identical to SEQ ID NO: 141426
  derived and/or modified sequence opt3 from neuraminidase__InfluenzaA__AEA73455

SEQ ID NO: 142549 - RNA, 1410 nt, Artificial Sequence; identical to SEQ ID NO: 141426
  derived and/or modified sequence opt3 from neuraminidase__InfluenzaA__AEA73466

SEQ ID NO: 142550 - RNA, 1410 nt, Artificial Sequence
  derived and/or modified sequence opt3 from neuraminidase__InfluenzaA__AEA73477
augaaccccaaucagaagaucauuaccauaggcagcgugucccugacaaucucuacuauuugcuucuuuaugcagaucgccauucucaucacgaccgucacacuucacuucaaacaguacaaguuuaacucaccuccaaauaaccagguuaugcugugugagccgacuauaaucgaaagaaauauuaccgagaucguguauuugacaaacaccacuauugaaaaagagaucugccccaaguuagcugaauacaggaauuggaguaaaccucagugugacauaacaggguucgcaccauuuagcaaggauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugagcugggaguucccuuucacuugggcaccaaacaggugugcauugcuuggagcaguuccucuugucaugacgguaaggccuggcuccacgucugcaucacaggggaugacaaaaacgcaaccgccagcuucaucuacaauggaaggcugguggauuccguaguuucauggaguaaggaaauucugcggacgcaggagagcgaaugugugugcauaaacggcacuuguacagucgugaugaccgacggcucugcuuccgggaaagcagauacuaagauccucuuuauugaggagggaaagaucgugcauacaucaaccuuaagcgguagugcccaacacgucgaagagugcucuugcuauccucgcuacccaggcguuagaugugugugcagggacaacuggaaaggguccaaucggccgauaguagauauuaacaucaaggaccacagcaucgugucgucuuacgucuguuccggacuggugggcgacacgccccgcaaaaaugauucaaguagcuccucucauugccuugacccuaacaaugaagagggugggcacggaguuaagggcugggcuuucgaugacggcaacgauguguggauggggcgaaccauuaaugaaacaagcagauugggauaugagacuuuuaaagucaucgaggguuggucaaacccaaagaguaaacugcagauuaauaggcaagugauaguagaccggggcaaccguuccggguacagcggaaucuucucuguugaaggcaagucauguauuaaucgcugcuuuuauguggagcuaaucagagguaggaaggaagagaccaaaguccucuggacaaguaacagcaucguggucuucugugggacuuccggcaccuacggaacaggcucuuggcccgauggggccgaccugaaucuuaugccuauuuga

SEQ ID NO: 142551 - RNA, 1410 nt, Artificial Sequence; identical to SEQ ID NO: 141426
  derived and/or modified sequence opt3 from neuraminidase__InfluenzaA__AEA73488

SEQ ID NO: 142552 - RNA, 1410 nt, Artificial Sequence
  derived and/or modified sequence opt3 from neuraminidase__InfluenzaA__AEA73499
augaaccccaaucagaagaucauuaccauaggcagcgugucccugacaaucucuacuauuugcuucuuuaugcagaucgccauucucaucacgaccgucacacuucacuucaaacaguacaaguuuaacucaccuccaaauaaccagguuaugcugugugagccgacuauaaucgaaagaaauauuaccgagaucguguauuugacaaacaccacuauugaaaaagagaucugccccaaguuagcugaauacaggaauuggaguaaaccucagugugacauaacaggguucgcaccauuuagcaaggauaacuccauucggcugucugccggaggugacaucuggguaacccgcgagcccuaugugucgugcgauccugacaaguguuaccaauucgcgcuaggccaggggacgacuauuaauaacguccauucaaauaacaccgugcgagaucguacaccauauagaacucuccugaugaaugagcuuggaguucccuuucaccugggcaccaaacaggugugcaucgcuuggagcaguuccucuugucaugacgguaaggccugguugcacgucugcaucacaggggaugacaaaaacgcaaccgccagcuucauuuacaauggaaggcucguggauuccguaguuucauggaguaaggaaauacugcggacgcaggagagcgaaugugugugcaucaacggcacuuguacagucgugaugaccgacggcucugcuuccgggaaagcagauacuaagauucuguuuaucgaggagggaaagauagugcauacaucaacccucagcgguagugcccaacacgucgaagagugcucuugcuauccucgcuacccaggcguuagaugugugugcagggacaacuggaaaggguccaaucggccgauuguagauaucaacaucaaggaccacagcauugugucgucuuacgucuguuccggauuagugggcgacacgccccgcaaaaaugauucaaguagcuccucucauugccuggacccuaacaaugaagagggugggcacggaguuaagggcugggcuuucgaugacggcaacgauguguggauggggcgaaccaucaaugaaacaagcagacuuggauaugagacuuuuaaagucauugaggguuggucaaacccaaagaguaaauugcagauaaauaggcaagugaucguagaccggggcaaccguuccggguacagcggaauuuucucuguugaaggcaagucauguaucaaucgcugcuuuuauguggagcugaucagagguaggaaggaagagaccgaaguccuauggacaaguaacagcauuguggucuucugugggacuuccggcaccuacggaacaggcucuuggcccgauggggccgaccucaaucugaugccuauauga

SEQ ID NO: 142553 - RNA, 1410 nt, Artificial Sequence; identical to SEQ ID NO: 141426
  derived and/or modified sequence opt3 from neuraminidase__InfluenzaA__AEA73510

SEQ ID NO: 142554 - RNA, 1410 nt, Artificial Sequence; identical to SEQ ID NO: 141426
  derived and/or modified sequence opt3 from neuraminidase__InfluenzaA__AEA73521

SEQ ID NO: 142555 - RNA, 1410 nt, Artificial Sequence; identical to SEQ ID NO: 141426
  derived and/or modified sequence opt3 from neuraminidase__InfluenzaA__AEA73532

SEQ ID NO: 142556 - RNA, 1410 nt, Artificial Sequence; identical to SEQ ID NO: 141426
  derived and/or modified sequence opt3 from neuraminidase__InfluenzaA__AEA73543

SEQ ID NO: 142557 - RNA, 1410 nt, Artificial Sequence; identical to SEQ ID NO: 141426
  derived and/or modified sequence opt3 from neuraminidase__InfluenzaA__AEA73554

SEQ ID NO: 142558 - RNA, 1410 nt, Artificial Sequence; identical to SEQ ID NO: 141426
  derived and/or modified sequence opt3 from neuraminidase__InfluenzaA__AEA73565

SEQ ID NO: 142559 - RNA, 1413 nt, Artificial Sequence; identical to SEQ ID NO: 139477
  derived and/or modified sequence opt3 from neuraminidase__InfluenzaA__AEA73576

SEQ ID NO: 142560 - RNA, 1413 nt, Artificial Sequence; identical to SEQ ID NO: 139477
  derived and/or modified sequence opt3 from neuraminidase__InfluenzaA__AEA73587

SEQ ID NO: 142561 - RNA, 1413 nt, Artificial Sequence; identical to SEQ ID NO: 142220
  derived and/or modified sequence opt3 from neuraminidase__InfluenzaA__AEA73598

SEQ ID NO: 142562 - RNA, 1413 nt, Artificial Sequence; identical to SEQ ID NO: 139477
  derived and/or modified sequence opt3 from neuraminidase__InfluenzaA__AEA73609

SEQ ID NO: 142563 - RNA, 1413 nt, Artificial Sequence; identical to SEQ ID NO: 139477
  derived and/or modified sequence opt3 from neuraminidase__InfluenzaA__AEA73620

SEQ ID NO: 142564 - RNA, 1413 nt, Artificial Sequence
  derived and/or modified sequence opt3 from neuraminidase__InfluenzaA__AEA73631
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucgauggagccaacggcguuaaagguuucaguuauaaguacgggaauggcguguggaucggaagaauuaaauccaacaggcugcggaagggcuuugagaugauaugggaccccaauggguggacuaacacagacagcgauuucucuguaaaacaggacguggucgcuaucaccgauuggucaggauauagugguagcuuugugcagcacccugaacucacuggcuuagacugcauucgcccauguuucuggguugagcuggugcgagggcuucccagagaaaacacaaccaucuggacguccggaucuucgauuagcuucugcggcgucaauuccgauaccgccaacuggucauggccugacggugcagaguugccauuuacaaucgauaaguga

SEQ ID NO: 142565 - RNA, 1413 nt, Artificial Sequence
  derived and/or modified sequence opt3 from neuraminidase__InfluenzaA__AEA73642
augaaccccaaucagagaaucauuaccauaggcagcaucuccauugccaucgggauuaucucucugaugcuccaaauaggaaacaucauuucaaucugggcuagucacagcauucagacagguucccagaauaacacuggcaucugcaagcagaggauaauuacguacgaaaauucuaccugggugaaccauacauaugucaauaucaacaauacuaacguuguggcaggggaggacaaaaccucgguaacacuugccggaaauucaagccuguguaguauuuccggcugggcgaucuacaccaaggauaacucuauccggauugguagcaaaggggacguguucgucauacgcgagccuuuuaucuccugcucacacuuggaaugucgaacuuucuuuuuaacacaaggagcucugcuaaaugauaagcauaguaacggcaccgccaaagaccguagcccauauagagcacucaugucuugcccgcugggcgaggcccccuccccuuacaauucaaaguucgaaagcguggcuuggagugcaucugccugucacgaugggaugggauggcuuacgauugguaucuccggcccagacaacggggcuguugccgugcugaaguauaacggaauaauuacuggcaccaucaaaagcuggaagaaacagaucuugaggacacaggagucggagugcgucuguaugaaugguucuugcuuuacuauuaugaccgaugggcccuccaacaaggcggcaucauacaaaaucuucaagauugaaaagggaaaagugacaaagaguauagagcucaaugccccuaacuuuuauuacgaagaguguagcugcuacccagacaccggcaucguaauguguguuugccgggauaauuggcauggcuccaaccgccccugggugucuuucaaucagaaccuggacuaucaaauuggguacaucugcagcggagucuuuggugauaauccuagaccagaggacggcgaagggucauguaacccggugacgguggauggagcuaauggcgucaaagguuucaguuauaaguacgggaacggcguuuggcugggaaggacuaaauccaaucggcuccgcaagggcuuugagaugaucugggaccccaacggguggacaaauaccgacagcgauuucucugugaaacaggacguaguggccauuacugauuggucaggauauagugguagcuuuguccagcacccugaauuaacaggccuggacugcauacgaccauguuucuggguggagcuuguuagaggguugcccagggaaaacaccacgaucuggaccuccggaucuucgauuagcuucugcggcgugaacuccgauacagcaaauuggucauggccugacggugcugagcugccauuuacuaucgauaaguga

SEQ ID NO: 142566 - RNA, 1413 nt, Artificial Sequence; identical to SEQ ID NO: 139477
  derived and/or modified sequence opt3 from neuraminidase__InfluenzaA__AEA73653

SEQ ID NO: 142567 - RNA, 1413 nt, Artificial Sequence
  derived and/or modified sequence opt3 from neuraminidase__InfluenzaA__AEA73664
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucaacggagccgauggcguuaaagguuucaguuauaaguacgggaauggcguguggaucggaagaacuaaauccaacaggcugcggaagggcuuugagaugauuugggaccccaauggguggacaaacaccgacagcgauuucucuguaaaacaggacguggucgcuauaacugauuggucaggauauagugguagcuuugugcagcacccugaacucacaggcuuagacugcauccgcccauguuucuggguugagcuggugcgagggcuucccaaggaaaacaccacgauuuggaccuccggaucuucgaucagcuucugcggcgucaauuccgauacagccaacuggucauggccugacggugcagaguugccauuuacuauugauaaguga

SEQ ID NO: 142568 - RNA, 1413 nt, Artificial Sequence
  derived and/or modified sequence opt3 from neuraminidase__InfluenzaA__AEA73675
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucgauggagccgacggcguuaaagguuucaguuauaaguacgggaacggcguguggaucggaagaacuaaauccaauaggcugcggaagggcuuugagaugauuugggaccccaacggguggacaaauaccgauagcgacuucucuguaaaacaggauguggucgcuauaacugacuggucaggauauagugguagcuuugugcagcacccugaacucacaggcuuagauugcauccgcccauguuucuggauugagcugguucgagggcuucccagagaaaacaccacgaucuggaccuccggaucuucgauuagcuucugcggcgugaacuccgacacagccaauuggucauggccugauggugcagaguugccauuuacuaucgacaaguga

SEQ ID NO: 142569 - RNA, 1413 nt, Artificial Sequence; identical to SEQ ID NO: 142220
  derived and/or modified sequence opt3 from neuraminidase__InfluenzaA__AEA73686

SEQ ID NO: 142570 - RNA, 1413 nt, Artificial Sequence
  derived and/or modified sequence opt3 from neuraminidase__InfluenzaA__AEA73697
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauauuguugcaggggaagacaaaaccucggugacacuugccggaaacucaagccuguguaguaucuccggcugggcgaucuacaccaaggauaauucuauuaggauagguagcaaaggggacguauucgugauccgggagccuuuuauuuccugcucacacuuggaaugucgcacuuucuuuuuaacacaaggagcucugcuaaacgauaagcauaguaauggcaccgucaaagaccgaagcccauaucgugcccucaugucuugcccgcugggcgaggcacccuccccuuacaacucaaaguucgaaagcguggccuggagugcuucugcaugucacgaugggaugggauggcuuacgaucgguauauccggcccagacaacggggccguugcugugcugaaguauaauggaauuaucacuggcaccaucaaaagcuggaagaaacagauuuugagaacacaggagucggagugcgucuguaugaacgguucuugcuuuacuaucaugaccgaugggcccuccaauaaggccgcgucauacaaaauuuucaagauagaaaagggaaaagugacaaagaguguagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucaacggagccgauggcguuaaagguuucaguuauaaguacgggaauggcguguggaucggaagaacuaaauccaacaggcugcggaagggcuuugagaugauuugggaccccaauggguggacaaacaccgacagcgauuucucuguaaaacaggacguggucgcuauaacugauuggucaggauauagugguagcuuugugcagcacccugaacucacaggcuuagacugcauccgcccauguuucuggguugagcuggugcgagggcuucccagagaaaacaccacgauuuggaccuccggaucuucgaucagcuucugcggcgucaauuccgauacagccaacuggucauggccugacggugcagaguugccauuuacuauugauaaguga

SEQ ID NO: 142571 - RNA, 1413 nt, Artificial Sequence; identical to SEQ ID NO: 142221
  derived and/or modified sequence opt3 from neuraminidase__InfluenzaA__AEA73708

SEQ ID NO: 142572 - RNA, 1413 nt, Artificial Sequence; identical to SEQ ID NO: 139477
  derived and/or modified sequence opt3 from neuraminidase__InfluenzaA__AEA73719

SEQ ID NO: 142573 - RNA, 1413 nt, Artificial Sequence; identical to SEQ ID NO: 139477
  derived and/or modified sequence opt3 from neuraminidase__InfluenzaA__AEA73730

SEQ ID NO: 142574 - RNA, 1413 nt, Artificial Sequence; identical to SEQ ID NO: 139477
  derived and/or modified sequence opt3 from neuraminidase__InfluenzaA__AEA73741

SEQ ID NO: 142575 - RNA, 1413 nt, Artificial Sequence; identical to SEQ ID NO: 139477
  derived and/or modified sequence opt3 from neuraminidase__InfluenzaA__AEA73752

SEQ ID NO: 142576 - RNA, 1413 nt, Artificial Sequence; identical to SEQ ID NO: 142220
  derived and/or modified sequence opt3 from neuraminidase__InfluenzaA__AEA73763

SEQ ID NO: 142577 - RNA, 1410 nt, Artificial Sequence; identical to SEQ ID NO: 138754
  derived and/or modified sequence opt3 from neuraminidase__InfluenzaA__AEA73774

SEQ ID NO: 142578 - RNA, 1410 nt, Artificial Sequence; identical to SEQ ID NO: 138754
  derived and/or modified sequence opt3 from neuraminidase__InfluenzaA__AEA73784

SEQ ID NO: 142579 - RNA, 1410 nt, Artificial Sequence; identical to SEQ ID NO: 138754
  derived and/or modified sequence opt3 from neuraminidase__InfluenzaA__AEA73794

SEQ ID NO: 142580 - RNA, 1410 nt, Artificial Sequence; identical to SEQ ID NO: 138754
  derived and/or modified sequence opt3 from neuraminidase__InfluenzaA__AEA73804

SEQ ID NO: 142581 - RNA, 1410 nt, Artificial Sequence; identical to SEQ ID NO: 138754
  derived and/or modified sequence opt3 from neuraminidase__InfluenzaA__AEA73814

SEQ ID NO: 142582 - RNA, 1410 nt, Artificial Sequence; identical to SEQ ID NO: 138754
  derived and/or modified sequence opt3 from neuraminidase__InfluenzaA__AEA73824

SEQ ID NO: 142583 - RNA, 1410 nt, Artificial Sequence
  derived and/or modified sequence opt3 from neuraminidase__InfluenzaA__AEA73834
augaaccccaaucagaagaucauuaccauaggcagcaucugcaugacaauugggauggccaaccugauccuccaaauuggaaauaucauauccaucuggauuucucacucaauccagcuugguaaccagaaucagauugagacuuguaaccaaagugugaucacguacgaaaauaacaccugggucaaucagacauauguuaacauaagcaauacuaacuucgcugcaggccaguccgugguaucugugaaacuggccggaaauucgucauugugcccugucagcggaugggcgauuuacaguaaggacaacuccaucagaauuggcucuaaaggugauguguuuguuaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggugccaucucccuacaacucccguuuugaaucagucgccuggagcgcaagugccugccacgacggcaucaauuggcuuacaauugggaucucuggaccugauaacggugcuguggcaguacugaaguauaauggcauaauuaccgacacgaucaaguccuggaaaaacaauaucuugagaacucaagagagcgagugugccugcguuaacgggucguguuucaccgugaugacagauggaccaucugacggccaggcuuccuacaagauuuuuaggaucgaaaaagguaagauugucaaaucaguggagaugaaugcccccaacuaucauuacgaagagugcaguuguuacccugauagcuccgagauaacuugcgugugccgggacaauuggcacgggucuaaccgcccaugggucagcuucaaucagaaccucgaauaucagaucggauacauuuguucaggcaucuuuggcgauaauccgagacccaacgacaagaccgggaguugcggaccuguuuccagcaauggugcgaacggcgugaagggguucucuuuuaaauauggaaacggcguauggaucgguaggacaaagucaauuaguagccggaauggguucgagaugauaugggauccaaacggcuggaccggaacggacaauaacuuuuccaucaaacaagacauugugggcaucaaugaauggucuggguacucggggagcuucguccagcaucccgagcugacuggucuggauuguauucgcccuugcuucuggguggaacucauccgaggcagaccaaaggagaacacaauauggaccuccgggucaaguaucucuuuuuguggaguuaauagcgacacugugggcugguccuggcccgauggugcagaguuaccguucacaauugacaaauga

SEQ ID NO: 142584 - RNA, 1410 nt, Artificial Sequence; identical to SEQ ID NO: 142116
  derived and/or modified sequence opt3 from neuraminidase__InfluenzaA__AEA73844

SEQ ID NO: 142585 - RNA, 1410 nt, Artificial Sequence; identical to SEQ ID NO: 138754
  derived and/or modified sequence opt3 from neuraminidase__InfluenzaA__AEA73854

SEQ ID NO: 142586 - RNA, 1410 nt, Artificial Sequence; identical to SEQ ID NO: 138754
  derived and/or modified sequence opt3 from neuraminidase__InfluenzaA__AEA73864

SEQ ID NO: 142587 - RNA, 1410 nt, Artificial Sequence; identical to SEQ ID NO: 140535
  derived and/or modified sequence opt3 from neuraminidase__InfluenzaA__AEA73874

SEQ ID NO: 142588 - RNA, 1410 nt, Artificial Sequence; identical to SEQ ID NO: 140535
  derived and/or modified sequence opt3 from neuraminidase__InfluenzaA__AEA73884

SEQ ID NO: 142589 - RNA, 1410 nt, Artificial Sequence; identical to SEQ ID NO: 142116
  derived and/or modified sequence opt3 from neuraminidase__InfluenzaA__AEA73894

SEQ ID NO: 142590 - RNA, 1410 nt, Artificial Sequence
  derived and/or modified sequence opt3 from neuraminidase__InfluenzaA__AEA73904
augaaccccaaucagaagaucauuaccauaggcagcgugugcaugacaaucgggauggccaaccugguccuccaaauuggaaauaucauuuccaucuggauaucucacucaauccagcuugguaaccagaaucagauugagacuuguaaccaaaguguuaucacguacgaaaauaacaccugggugaaucagacauauguaaacauuagcaauacuaacuucgcugcaggccaguccguggucucugugaaacuggccggaaauucgucauugugcccuguuagcggaugggcgaucuacaguaaggacaacuccauaagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucugacggccaggcuuccuacaaaaucuuucggaucgaaaaggguaaaauugugaagucagucgagaugaaugcccccaacuaucauuacgaagagugcaguuguuacccugauagcuccgagaucacuugcguuugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacaauaacuuuuccauuaagcaagacauaaucggcauuaaugaauggucuggguacucggggagcuucgugcagcaucccgagcugacuggucuggauuguauccgaccuugcuucuggguugaacucauuagaggcaggccaaaagagaagacaaucuggaccuccgggucaaguauaucuuuuuguggagugaacagcgacacugucggcugguccuggcccgauggugcagaguuaccguucacaaucgacaaauga

SEQ ID NO: 142591 - RNA, 1410 nt, Artificial Sequence; identical to SEQ ID NO: 138754
  derived and/or modified sequence opt3 from neuraminidase__InfluenzaA__AEA73914

SEQ ID NO: 142592 - RNA, 1410 nt, Artificial Sequence; identical to SEQ ID NO: 140535
  derived and/or modified sequence opt3 from neuraminidase__InfluenzaA__AEA73924

SEQ ID NO: 142593 - RNA, 1410 nt, Artificial Sequence; identical to SEQ ID NO: 142193
  derived and/or modified sequence opt3 from neuraminidase__InfluenzaA__AEA73934

SEQ ID NO: 142594 - RNA, 1410 nt, Artificial Sequence
  derived and/or modified sequence opt3 from neuraminidase__InfluenzaA__AEA73944
augaaccccaaucagaagaucauuaccauaggcagcgugugcaugacaaucgggauggccaaccugauucuccaagucggaaauaucauuuccaucuggauaucucacucaauccagcuugguaaccagaaucagauugagacuuguaaccaaaguguuaucacguacgaaaauaacaccugggugaaucagacauauguaaacauuagcaauacuaacuucgcugcaggccaguccguggucucugugaaacuggccggaaauucgucauugugcccuguuagcggaugggcgaucuacaguaaggacaacuccauaagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucugacggccaggcuuccuacaaaaucuuucggaucgaaaaggguaaaauugugaagucagucgagaugaaugcccccaacuauuacuacgaagagugcaguuguuauccugauagcuccgagaucacuugcguuugccgcgacaauuggcaugggucuaacagaccaugggugagcuucaaucagaaccucgaauaccagauuggauauauauguucaggcaucuuuggcgauaauccgaggcccaacgacaaaaccgggaguugcggaccuguauccagcaauggugcgaacggcgugaagggguucucuuuuaaguacggaaacggcgucuggauuggucggacaaaaucaaucaguagccgcaauggguucgagaugaucugggauccaaacggcuggaccggaacggacaauaacuuuuccauuaagcaagacauagugggcaucaaugaauggucuggguauucggggagcuucguucagcaccccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcagaguuaccguucacaauagacaaguga

SEQ ID NO: 142595 - RNA, 1410 nt, Artificial Sequence; identical to SEQ ID NO: 138754
  derived and/or modified sequence opt3 from neuraminidase__InfluenzaA__AEA73954

SEQ ID NO: 142596 - RNA, 1410 nt, Artificial Sequence; identical to SEQ ID NO: 138754
  derived and/or modified sequence opt3 from neuraminidase__InfluenzaA__AEA73964

SEQ ID NO: 142597 - RNA, 1410 nt, Artificial Sequence
  derived and/or modified sequence opt3 from neuraminidase__InfluenzaA__AEA73974
augaaccccaaucagaagaucauuaccauaggcagcgugugcaugacaaucgggauggccaaccugauucuccaaaucggaaauauuaucuccauauggaucucucacucaauucagcaugguaaccagaaucagaucgagacuuguaaccaaagugucauuacguacgaaaauaacaccuggguuaaucagacauaugugaacaucagcaauacuaacuucgcugcaggccaguccguagugucugucaaacuugccggaaauucgucacugugcccugugagcggaugggcgauauacaguaaggacaacuccauuagaaucggcucuaaaggugauguuuuugugauuagggagccauucaucagcuguuccccguuggaaugccggaccuuuuucuuaacacagggggcucugcuaaaugacaagcacucaaacggaaccaucaaagaucgcagucccuaucgaacucucaugagcuguccuauuggcgaggucccaucucccuacaacucccguuuugaaucaguggccuggagcgcaagugccugccaugacggcauaaauuggcugacaaucgggauuucuggaccugauaacggugcuguagcaguucuuaaguauaauggcaucauaaccgacacgauuaaguccuggagaaacaauauccugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucacuacgaagagugcaguuguuacccugauagcuccgagauuacuugcgucugccgcgacaauuggcaugggucuaacagaccauggguuagcuucaaucagaacuuggaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaccccgagcucacuggucuggauuguauccgaccuugcuucuggguugaacugauuagaggcaggccaaaagagaacacaaucuggaccuccgggucaaguauaucuuuuuguggagugaauagcgacacugucggcugguccuggcccgauggugcagagcucccguucacaaucgacaaguga

SEQ ID NO: 142598 - RNA, 1410 nt, Artificial Sequence; identical to SEQ ID NO: 138754
  derived and/or modified sequence opt3 from neuraminidase__InfluenzaA__AEA73984

SEQ ID NO: 142599 - RNA, 1410 nt, Artificial Sequence; identical to SEQ ID NO: 140105
  derived and/or modified sequence opt3 from neuraminidase__InfluenzaA__AEA73994

SEQ ID NO: 142600 - RNA, 1410 nt, Artificial Sequence
  derived and/or modified sequence opt3 from neuraminidase__InfluenzaA__AEA74004
augaaccccaauaagaaaaucauuauaaucggcagcgugugcaugaccauugggauggccaaccugauccuccagauuggaaauaucauauccaucuggauuucucacucaauccaacuugguaaccagaaucagauugagacauguaaccagagugucaucacuuacgaaaauaacacguggguuaaucaaaccuaugugaacauaagcaauacaaacuucgcugcaggccaguccguagugucugucaagcuggccggaaauucgucauugugcccugugagcggaugggcgauuuacaguaaagacaacuccaucagaauuggcucuaagggugauguuuuugugaucagggagccauucaucagcuguuccccguuagaaugccggaccuuuuuccugacucagggggcucuacucaaugacaaacauucaaacggaacaauuaaggaucgcagucccuaucgaacccugaugagcuguccuauaggcgaggucccaucucccuacaacucccguuuugaaucaguggccuggagcgcaagugccugccacgacggcaucaauuggcuuacuauugggaucucuggaccugauaacggugcuguagcaguucugaaguauaauggcauaauuacagacaccaucaaauccuggagaaacaauaucuugaggacgcaggagagcgagugugccugcgugaacgggucguguuucacugucaugaccgauggaccaucugacggccaggcuuccuacaagauuuuucggaucgaaaaagguaagauugugaaaucaguggagaugaaugcccccaacuaucauuacgaagagugcaguuguuacccugauagcuccgagauaacaugcgucugccgcgacaauuggcacgggucuaacagaccauggguuagcuucaaucaaaaccucgaauaucagaucggauacauuuguucaggcaucuuuggcgauaauccgaggcccaacgacaagacugggaguugcggaccuguguccagcaauggugcgaacggcguaaagggguucucuuuuaaauauggaaacggcguguggaucggucggaccaagucaauuaguagccgcaauggguucgagaugauaugggauccaaacggcuggacaggaaccgacaauaacuuuuccaucaaacaggacauugucggcaucaaugaauggucuggguacucggggagcuucgugcaacaucccgagcugacgggucuggauuguauucgaccuugcuucuggguugaacucaucagaggcaggccaaaggagaacacuauauggacauccgggucaaguaucucuuuuuguggagugaauagcgacaccgucggcugguccuggcccgauggugcagaguuaccguucacuauugacaaauga

SEQ ID NO: 142601 - RNA, 1410 nt, Artificial Sequence; identical to SEQ ID NO: 139931
  derived and/or modified sequence opt3 from neuraminidase__InfluenzaA__AEA74014

SEQ ID NO: 142602 - RNA, 1410 nt, Artificial Sequence; identical to SEQ ID NO: 139931
  derived and/or modified sequence opt3 from neuraminidase__InfluenzaA__AEA74024

SEQ ID NO: 142603 - RNA, 1410 nt, Artificial Sequence; identical to SEQ ID NO: 138754
  derived and/or modified sequence opt3 from neuraminidase__InfluenzaA__AEA74032

SEQ ID NO: 142604 - RNA, 1410 nt, Artificial Sequence; identical to SEQ ID NO: 138754
  derived and/or modified sequence opt3 from neuraminidase__InfluenzaA__AEA74034

SEQ ID NO: 142605 - RNA, 1410 nt, Artificial Sequence
  derived and/or modified sequence opt3 from neuraminidase__InfluenzaA__AEA77302
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaaaugccccaaguuagcugaguacaggaauuggaguaaaccucagugugacaucacaggguucgcaccauuuagcaaggauaacuccauacggcugucugccggaggugacauuuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcaucgcuuggagcaguuccucuugucaugacgguaaggccuggcuccacgucugcauuacaggggaugacaaaaacgcaaccgccagcuucaucuacaauggaaggcugguggauuccguaguuucauggaguaaggagauccugcggacgcaggaaagcgagugugugugcauuaacggcacuuguacagucgugaugaccgacggcucugcuuccgggaaagcagauacuaagauacucuuuaucgaggaaggaaagauugugcauacaucaaccuuaagcgguagugcccaacacgucgaggaaugcucuugcuauccucgcuacccaggcguuagaugugugugcagggacaacuggaaaggguccaaucggccgaucguagauauaaacauuaaggaccacagcaucgugucgucuuacgucuguuccggacuggugggcgacacgcccaaaaagaaugauucaaguagcuccucucauugccuugacccuaacaaugaggaaggugggcacggaguuaaaggcugggcuuucgaugacggcaacgauguguggauggggcgcaccaucagcgagaagucacgauugggauaugagacauuuaaagucauugaagguuggaguaauccaaaguccaagcugcagaucaacagacaggugauuguagacaggggcaaucggagcggguacucuggaauauucucaguugagggcaaaaguuguaucaaccguugcuuuuauguggaacuaauucgcgguagaaaggaggaaacugagguccucuggaccagcaauuccaucguggucuucugugggacaucuggcacuuacggaaccggcucguggcccgauggggccgacaucaaccugaugccuauuuga

SEQ ID NO: 142606 - RNA, 1410 nt, Artificial Sequence; identical to SEQ ID NO: 142273
  derived and/or modified sequence opt3 from neuraminidase__InfluenzaA__AEB21318

SEQ ID NO: 142607 - RNA, 1410 nt, Artificial Sequence
  derived and/or modified sequence opt3 from neuraminidase__InfluenzaA__AEB21328
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcuucaacuggcuuacaauagggaucuccggaccugauaauggugcuguagcaguucugaaguauaacggcauuaucaccgacacgauaaagagcuggagaaauaacauuuugaggacucaagagucggagugugccugcgugaaugggucuuguuuuaccaucaugacagauggaccauccgacggccaggcuucauacaaaaucuuccggauugaaaaggguaaaaucgucaagaguguggagaugaacgcccccaauuaucauuacgaagagugcagcuguuacccugauuccucugagauuacuugcgugugccgcgacaacuggcacgggagcaauagaccaugggucucauuuaaccagaaucucgaauaucagauaggauacaucuguaguggcauuuucggcgauaacccgaggcccaaugacaaaaccggguccugcggaccuguuagcucuaacggugcgaauggcgugaagggguuuucauucaaguauggaaacggcguauggaucggucggacaaaaaguaucagcucccgcaagggguuugagaugauuugggauccaaacggcuggaccggaacggacaauaacuucucuauaaaacaagacaucgugggcauuaaugaauggucgggguacagcggauccuucguccagcaucccgagcugacuggucuggauuguauccgaccuugcuuuuggguggaacucauuagaggcaggccaaaggagaacacaaucuggaccucagggaguucuaugagcuucuguggaguuaauuccgacacugugggcuggucauggcccgauggugcagaguuaccguuuacaauagacaaauga

SEQ ID NO: 142608 - RNA, 1410 nt, Artificial Sequence; identical to SEQ ID NO: 142273
  derived and/or modified sequence opt3 from neuraminidase__InfluenzaA__AEB21340

SEQ ID NO: 142609 - RNA, 1410 nt, Artificial Sequence
  derived and/or modified sequence opt3 from neuraminidase__InfluenzaA__AEB21350
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccgagugaaugccggaccuuuuucuuaacacagggggcucugcuaaacgacaagcauagcaauggaaccaucaaagaucgcucucccuaucgaacucucauguccuguccuauuggcgaggucccaucacccuacaacagccguuuugaaaguguggccuggucugcauccgccugccacgacggcauaaacuggcugacaaucgggauuagcggaccugauaauggugcuguagcaguucuuaaguauaacggcaucauaaccgacacgauuaagucguggagaaauaacauccugaggacucaagagucugagugugccugcgugaauggguccuguuucaccaucaugacagauggaccaucagacggccaggcuaguuacaaaauuuuucggaucgaaaaggguaaaauugucaagagcguggagaugaacgcccccaauuaucauuacgaagagugcuccuguuacccugauucuagcgagauaacuugcgugugccgcgacaacuggcacgggucaaauagaccaugggucaguuucaaccagaauuuggaauaucagaucggauacauuuguuccggcaucuuuggcgauaacccgaggcccaaugacaaaaccgggagcugcggaccuguuucuucaaacggugcgaauggcgugaagggguucaguuuuaaguauggaaacggcguauggaucggucggacaaaaagcauuauaucccgcaagggguucgagaugaucugggauccaaacggcuggaccggaacggacaauaacuuuucuauuaaacaagacaucgugggcauuaaugaauggucgggguacagcggauccuucguccagcaucccgagcucacuggucuggauuguauccgaccuugcuucuggguggaacugauaagaggcaggccaaaggagaacacaaucuggaccucagggaguucuauuagcuuuuguggaguuaauuccgacacugugggcuggucauggcccgauggugcagagcucccguucacaaucgacaaauga

SEQ ID NO: 142610 - RNA, 1410 nt, Artificial Sequence; identical to SEQ ID NO: 142273
  derived and/or modified sequence opt3 from neuraminidase__InfluenzaA__AEB21360

SEQ ID NO: 142611 - RNA, 1410 nt, Artificial Sequence; identical to SEQ ID NO: 139621
  derived and/or modified sequence opt3 from neuraminidase__InfluenzaA__AEB40209

SEQ ID NO: 142612 - RNA, 1410 nt, Artificial Sequence; identical to SEQ ID NO: 138615
  derived and/or modified sequence opt3 from neuraminidase__InfluenzaA__AEB66898

SEQ ID NO: 142613 - RNA, 1413 nt, Artificial Sequence
  derived and/or modified sequence opt3 from neuraminidase__InfluenzaA__AEB71103
augaaccccaaucagaagaucauuaccauaggcagcgugucccuggggcucgucguuuucaacgugcuucugcacguagugucuaucauugucacagugguuguguugggaaaugacgguggcaacgggaucugcaauggaacugucgugaaagaguacaacgaaacgguaagaauugagaggguuauccaauggcauaauaccucaguggucgaauauauaccuuacuuaaacggcgguacauauacuaauaacaccgagagugugugugaugugaagggguuugccccauucagcaaagacaauggaguccggaucggcucccgcggccacguuuuugugauucgagaaccguucguaucuugcucgccccgugaguguagaacauuuuuccugacccaggggucacuacucaacgauaagcauagcaauggaacugugaaagacaggaguccuuuuaagacacugauguccgucgaggugggucagucuccaaacguuuaccaggcucgguucgaagcaguggccuggagcgcgaccgcuugccacgauggcaagaaauggaugacgaucggggucacuggacccgacuccaaggccguggcaguaguucauuauggcggugugccuaccgauauuaucaauucaugggccggggacauacuucgcacacaagagaguagcuguacuugcauucagggagauuguuacugggucaugaccgacggcccagcuaacagacaggcacaguauaggaucuacaaaucuaaccaaggcaagauuaucgggcagauggauaucaauuuuaacggaggucacauugaagagugcuccuguuaccccaaugacggcaaaguggagugcgucugucgggauaacuggacagggaccaaucgcccugugcugguuauaucaccagacuugagcuauaaggugggauaccucugcgccggccugccgagugacacgccccgaggugaagaugcucaguucucuggguccugcacuagcccuguaggcggacagggcuauggggucaagggauuugguuucagacaaggcaacgacguguggauggggaggacaaucucgcggaccucucguuccggauuugagguuauucgcgugaaaaauggcuggacucagacaucaaaggaacagaucagaaaacaagucgugguagauaaccugaauuggagugguuacagcggguccuucacccucccaauagaguuaucuggcaagagcugucuggugcccugcuucuggguugaaacgauuaggggaaaaccugaggagaagaccaucuggacaucaaguuccagcaucgucauguguggcguggacuaugaaguggccgauuggucuuggcacgacggggcgauucuuccauuugauaucgacaaaauguga

SEQ ID NO: 142614 - RNA, 1413 nt, Artificial Sequence; identical to SEQ ID NO: 140946
  derived and/or modified sequence opt3 from neuraminidase__InfluenzaA__AEB71899

SEQ ID NO: 142615 - RNA, 1410 nt, Artificial Sequence
  derived and/or modified sequence opt3 from neuraminidase__InfluenzaA__AEB71910
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuuacuucgcugcaggccaguccguagugucugucaaacuggccgggaacucgucauugugcccugugagcggaugggcgauauauaguaaggacaauuccauuagaaucggcucuaaaggugauguuuuugugauuagggagccauucaucagcuguuccccguuagaaugccggaccuuuuuccugacacagggggcucuacucaacgacaagcauucaaauggaaccaucaaagaucgcagucccuaccgaacucugaugagcuguccuauuggcgaggucccaucucccuauaacucccguuuugaaucaguggccuggagcgcaagugccugccacgacggcauaaacuggcuuacaaucgggauuucuggaccugauaauggugcuguagcaguucugaaguacaacggcaucauaaccgacacgauuaaguccuggagaaauaacaucuugaggacucaagagagcgagugugccugcgugaaugggucguguuucaccgucaugacagauggaccaucugacggccaggcuuccuauaaaaucuuucggauugaaaaggguaaaaucgugaagucaguggagaugaacgcccccaauuaccauuacgaagagugcaguuguuauccugauagcuccgagauuacuugcgucugccgcgacaacuggcacgggucuaauagaccauggguuagcuucaaccagaaucucgaauaccagauaggauauaucuguucaggcauuuuuggcgauaacccgaggcccaaugacaaaaccgggaguugcggaccuguguccagcaacggugcgaauggcguaaagggguucucuuuuaaguacggaaacggcguguggaucggucggacaaaaucaaucaguagccgcaacggguucgagaugauuugggauccaaauggcuggaccggaacggacaacaauuuuuccauaaagcaagacaucgucggcauuaacgaauggucuggguauucggguagcuucgugcagcaucccgagcugacuggacuggauuguauccgaccuugcuucuggguugaacucauuagaggcaggccaaaagagaauacaaucuggaccuccgggucaaguauaucuuuuuguggagugaacagcgacacugucggcugguccuggcccgauggugcagaguuaccguucacaaucgacaaguga

SEQ ID NO: 142616 - RNA, 1410 nt, Artificial Sequence; identical to SEQ ID NO: 138754
  derived and/or modified sequence opt3 from neuraminidase__InfluenzaA__AEB71919

SEQ ID NO: 142617 - RNA, 1410 nt, Artificial Sequence; identical to SEQ ID NO: 140500
  derived and/or modified sequence opt3 from neuraminidase__InfluenzaA__AEB71928

SEQ ID NO: 142618 - RNA, 1410 nt, Artificial Sequence
  derived and/or modified sequence opt3 from neuraminidase__InfluenzaA__AEB71939
augaaccccaaucagaagaucauuaccauaggcagcgugucccugacaaucucugccauuugcuucuuuaugcaaaucgcuauucucaucacuacggucacccuucacuucaaacaguacgaguuuaacucaccuccaaauaaccagguuaugcugugugaaccgacaauaaucgagagaaauauuacugaaaucguguauuugaccaacacaaccauugagaaggaaaucugccccaaauuagcagaguacaggaauuggaguaagccucagugugacauaacuggguucgccccauuuagcaaagauaacuccauucggcugucugcgggaggugacaucuggguaacacgcgagcccuaugugucgugcgauccugacaaguguuaccaauucgcucuaggccaggggaccacgcucaauaacguccauucaaauaacacugugcgagaucguaccccauauagaacacugcuuaugaaugaacugggaguucccuuucacuugggcacuaaacaggugugcauugccuggagcaguuccucuugucaugacgguaaggcauggcuccacgucugcaucaccggggaugacaagaacgccacagcuagcuucaucuacaauggaaggcugguggauuccguaguuucauggaguaaagagauucugcggacccaggaaagcgagugugugugcauaaacggcacguguacugucgugaugacagacggcucugcauccgggaaggccgauaccaaaauccucuuuauugaggaaggaaagaucgugcauacuucaacauuaagcgguagugcucaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacccccaggaagaaugauucaaguagcuccucucauugccuugacccuaacaaugaggaaggugggcacggaguuaaaggcugggccuucgaugacggcaacgauguguggauggggcgaacgauuagcgagaagucaagauugggauaugagaccuuuaaagucaucgaagguuggaguaaucauaaguccaaacugcagauuaaccgccaggugauaguagaccggggcaaucguagcggguacucuggaaucuucucaguugagggcaagaguuguauuaaccgcugcuuuuauguggaacuaaucagagguaggaaggaggaaacagagguccucuggacuagcaauuccaucguggucuucugugggaccucuggcacauacggaacuggcucguggccagauggggcggaccugaaccuuaugcccauuuga

SEQ ID NO: 142619 - RNA, 1410 nt, Artificial Sequence
  derived and/or modified sequence opt3 from neuraminidase__InfluenzaA__AEB71950
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugaucacgggguuaaaggaugggcuuucgacgauggcaacgacguguggaugggccgaaccauuagcgagaagucaagauugggguaugagacauuuaaagucaucgaaggauggaguaaucauaaguccaaacugcagauuaacaggcaagugauaguagaucgggguaaucguagcggcuacucugggaucuucucaguugagggaaagaguuguauuaaccgcugcuuuuauguggaacuaaucagaggcaggaaggaggaaacugagguccucuggaccagcaauuccaucguggucuucugugguacaucugggacuuacggcaccggaucguggccagacggcgccgaucugaaccuuaugcccauuuga

SEQ ID NO: 142620 - RNA, 1413 nt, Artificial Sequence; identical to SEQ ID NO: 141953
  derived and/or modified sequence opt3 from neuraminidase__InfluenzaA__AEB71961

SEQ ID NO: 142621 - RNA, 1410 nt, Artificial Sequence
  derived and/or modified sequence opt3 from neuraminidase__InfluenzaA__AEB71972
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauuguaaaggagaucugccccaaauuagcugaauacaggaauuggaguaagccucagugugacauaacaggguucgcaccauuuagcaaagauaacuccauucggcugucugccggaggugacaucugggugacccgcgagcccuaugucucgugcgauccugacaaguguuaccaauucgcgcuaggccaggggacgacucucaauaacgugcauucaaauaacaccguucgagaucguacaccauauagaacucugcuuaugaaugagcugggagugcccuuucacuugggcaccaagcaggucugcauugcuuggagcaguuccucuugucaugacgguaaagccuggcuccacgugugcaucacaggggaugacaagaacgcaaccgccagcuucaucuacaauggaaggcugguagauuccguugugucauggaguaaagaaauucugcggacgcaggagagcgaaugugucugcauaaacggcacuuguacaguggugaugaccgacggcucugcuuccgggaaggcagauacuaaaauccucuuuauugaggagggaaagaucguccauacaucaaccuuaagcgguagugcccaacacguugaagagugcucuugcuauccucgcuacccaggcgugagauguguaugcagggacaacuggaagggguccaaucggccgauaguggauauuaacaucaaagaccacagcaucgucucgucuuacguguguuccggacugguuggcgacacgccccgcaagaaugauucaaguagcuccucucauugccuugacccuaacaaugaagagggugggcacggagugaaaggcugggcuuucgaugacggcaacgaugucuggauggggcgaaccauuagcgaaaagucaagauugggauaugagacauuuaaagugaucgaggguuggaguaauccaaaguccaaacugcagauuaacaggcagguaauaguugaccggggcaaucguagcggguacucuggaaucuucucaguggaaggcaagaguuguauuaaccgcugcuuuuaugucgagcuaaucagagguaggaaggaagagacugaagugcucuggaccagcaauuccaucgucguguucugugggacaucuggcacuuacggaaccggcucguggcccgauggggccgacauuaaccugaugccuauauga

SEQ ID NO: 142622 - RNA, 1410 nt, Artificial Sequence
  derived and/or modified sequence opt3 from neuraminidase__InfluenzaA__AEB71983
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaugaaagaccacagcaucgugucgucuuacgucuguuccggacuggugggcgacacgccccgccgaaaugauucaaguagcuccucucauugccuugacccuaacaaugaggaaggugggcacggaguuaagggcugggcuuucgaugacggcaacgauguguggauggggagaaccaucagcgagaaaucaagguugggauaugagacauuuaaggucauugaagguuggaguaauccaaaauccaagcugcagaucaaccgucaggugauuguagaccggggcaaucgcagcggguacucuggaauauucucaguugagggcaaaaguuguaucaacagaugcuuuuauguggaacuaauuaggggucggaaggaggaaacugagguccucuggaccagcaauuccaucguggucuucugugggacaucuggcacuuacggaaccggcucguggcccgauggggccgacaucaaccugaugccuauuuga

SEQ ID NO: 142623 - RNA, 1413 nt, Artificial Sequence
  derived and/or modified sequence opt3 from neuraminidase__InfluenzaA__AEB71995
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauauaucaacauuaauaacacuaaugugguugcaggggaagacaaaaccucggugacacuugccggaaacucaagccuguguaguaucuccggcugggcgaucuacaccaaggauaauucuauuaggauagguagcaaaggggacguauucgugauccgggagccuuuuauuuccugcucacacuuggaaugucgcacuuucuuuuuaacacaaggagcucugcuaaacgauaagcauaguaauggcaccgucaaagaccgaagcccauaucgugcccucaugucuugcccgcugggcgaggcacccuccccuuacaacucaaaguucgaaagcguggccuggagugcuucugcaugucacgaugggaugggauggcuuacgaucgguauauccggcccagacaacggggccguugcugugcugaaguauaauggaauuaucacuggcaccaucaaaagcuggaagaaacagauuuugagaacacaggagucggagugcgucuguaugaacgguucuugcuuuacuaucaugaccgaugggcccuccaauaaggccgcgucauacaaaauuuucaagauagaaaagggaaaagugacaaagaguaucgagcucaacgcaccuaauuuuuauuacgaagaguguagcugcuacccagacaccggcauuguaauguguguuugcagggauaacuggcauggcuccaaucggcccugggugucuuucaaccagaaucuggacuaucaaaucggguacaucugcagcggagucuuuggugauaacccucgcccagaggacggcgaagggucauguaauccggugacggugaacggagccgauggcgucaaagguuucaguuauaaguacgggaauggcguuuggauuggaagaacuaaauccaacaggcugcggaagggcuuugagaugauaugggaccccaauggguggacaaacaccgacagcgauuucucugugaaacaggacguaguggcuaucacugauuggucaggauauagugguagcuuuguccagcacccugaacucacaggcuuagagugcauucgcccauguuucuggguggaacugguucgagggcuucccagagagaacaccacgaucuggaccuccggaucuucgauuagcuucugcggcgucaauuccgacacagccaacuggucauggccugauggugcagaguugccauuuacuaucgacaaguga

SEQ ID NO: 142624 - RNA, 1413 nt, Artificial Sequence; identical to SEQ ID NO: 142221
  derived and/or modified sequence opt3 from neuraminidase__InfluenzaA__AEC13316

SEQ ID NO: 142625 - RNA, 1410 nt, Artificial Sequence; identical to SEQ ID NO: 138754
  derived and/or modified sequence opt3 from neuraminidase__InfluenzaA__AEC53262

SEQ ID NO: 142626 - RNA, 1410 nt, Artificial Sequence; identical to SEQ ID NO: 138754
  derived and/or modified sequence opt3 from neuraminidase__InfluenzaA__AEC53272

SEQ ID NO: 142627 - RNA, 1410 nt, Artificial Sequence; identical to SEQ ID NO: 138754
  derived and/or modified sequence opt3 from neuraminidase__InfluenzaA__AEC53282

SEQ ID NO: 142628 - RNA, 1410 nt, Artificial Sequence; identical to SEQ ID NO: 138754
  derived and/or modified sequence opt3 from neuraminidase__InfluenzaA__AEC53292

SEQ ID NO: 142629 - RNA, 1410 nt, Artificial Sequence
  derived and/or modified sequence opt3 from neuraminidase__InfluenzaA__AEC53302
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacauuaucaaguccuggagaaacaauaucuugaggacgcaagagagcgagugugccugcgugaacgggucguguuucacugucaugaccgauggaccaucugacggccaggcuuccuacaaaauuuuucggaucgaaaaggguaaaauugugaagucaguggagaugaaugcccccaacuaucauuacgaagagugcaguuguuacccugauagcuccgagauaacaugcgucugccgcgacaauuggcacgggucuaacagaccauggguuagcuucaaucagaaccucgaauaucagaucggauacauuuguucaggcaucuuuggcgauaauccgaggcccaacgacaaaacugggaguugcggaccuguguccagcaauggugcgaacggcguaaagggguucucuuuuaaguauggaaacggcguguggaucggucggaccaaaucaauuaguagccgcaauggguucgagaugauaugggauccaaacggcuggacaggaaccgacaauaacuuuuccaucaagcaagacauugucggcaucaaugaauggucuggguacucggggagcuucgugcagcaucccgagcugacgggucuggauuguauucgaccuugcuucuggguugaacucaucagaggcaggccaaaagagaacacuauauggacauccgggucaaguaucucuuuuuguggagugaauagcgacaccgucggcugguccuggcccgauggugcagaguuaccguucacuauugacaaguga

SEQ ID NO: 142630 - RNA, 1410 nt, Artificial Sequence; identical to SEQ ID NO: 138754
  derived and/or modified sequence opt3 from neuraminidase__InfluenzaA__AEC53350

SEQ ID NO: 142631 - RNA, 1410 nt, Artificial Sequence; identical to SEQ ID NO: 139462
  derived and/or modified sequence opt3 from neuraminidase__InfluenzaA__AEC53407

SEQ ID NO: 142632 - RNA, 1410 nt, Artificial Sequence; identical to SEQ ID NO: 138754
  derived and/or modified sequence opt3 from neuraminidase__InfluenzaA__AEC53427

SEQ ID NO: 142633 - RNA, 1410 nt, Artificial Sequence; identical to SEQ ID NO: 139580
  derived and/or modified sequence opt3 from neuraminidase__InfluenzaA__AED99967

SEQ ID NO: 142634 - RNA, 1410 nt, Artificial Sequence; identical to SEQ ID NO: 138744
  derived and/or modified sequence opt3 from neuraminidase__InfluenzaA__AEE27161

SEQ ID NO: 142635 - RNA, 1410 nt, Artificial Sequence; identical to SEQ ID NO: 138754
  derived and/or modified sequence opt3 from neuraminidase__InfluenzaA__AEE27170

SEQ ID NO: 142636 - RNA, 1410 nt, Artificial Sequence; identical to SEQ ID NO: 138744
  derived and/or modified sequence opt3 from neuraminidase__InfluenzaA__AEE27180

SEQ ID NO: 142637 - RNA, 1410 nt, Artificial Sequence
  derived and/or modified sequence opt3 from neuraminidase__InfluenzaA__AEE27190
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcgucauuaccgacacgaucaaguccuggagaaacaauauauugaggacucaagagagcgagugugccugcgugaacgggucguguuucaccgugaugacagauggaccaucuaauggccaggcuuccuacaaaauuuuuaagaucgaaaaagguaagaucgucaaaucaguugagaugaacgcccccaauuaucauuacgaagagugcaguuguuacccugacagcuccgagauuacuugcgugugccgggauaacuggcacgggucuaaucgcccaugggugagcuucaaccagaaucucgaauaucagaucggauacauuuguucaggcauauuuggcgacaacccgagacccaaugauaagaccgggaguugcggaccuguauccagcaacggugcgaacggcgucaagggguucucuuuuaaauauggaaauggcguguggaucgguaggacaaagucaauuaguagccggaacggguucgagaugaucugggacccaaauggcuggaccggaacggauaacaauuuuuccaucaaacaagacauuguuggcauaaacgaauggucuggguacucggggagcuucgugcagcaucccgagcugacuggucuggacuguauccgcccuugcuucugggucgaacucauucgaggcagaccaaaggagaauacaaucuggaccuccgggucaaguauuucuuuuuguggagugaacagcgauacuguaggcugguccuggcccgacggugcagaguuaccguucacaaucgauaaauga

SEQ ID NO: 142638 - RNA, 1410 nt, Artificial Sequence; identical to SEQ ID NO: 139977
  derived and/or modified sequence opt3 from neuraminidase__InfluenzaA__AEE27200

SEQ ID NO: 142639 - RNA, 1410 nt, Artificial Sequence; identical to SEQ ID NO: 141813
  derived and/or modified sequence opt3 from neuraminidase__InfluenzaA__AEG64755

SEQ ID NO: 142640 - RNA, 1362 nt, Artificial Sequence
  derived and/or modified sequence opt3 from neuraminidase__InfluenzaA__AEG64765
augaaccccaaucagaagaucauuaccauaggcagcaucugcaugguggucgggauuaucucccugauucuccaaaucggaaacauaaucucuauuuggaucucacacaguauucagacagguaaucagaaccauacuggcaucuguaaucaggggauaauuacguacaacguuguggccggacaagacagcaccuccguaauccuuacaggcaauucuucgcugugcccuauuagagguugggcuauccacucaaaagauaacgggaucaggauuggaagcaagggcgacguguucgucauacgggagccauuuaucaguuguucccauuuggaaugccgcacuuucuuuuuaacccagggcgcacugcuaaaugauaaacacucuaacgggacagugaaggaccgaagcccguaucgugcccucauguccugucccguuggagaggcgccuucaccauacaauaguagauucgaaagcguggcuuggucugccuccgcaugccaugaugguaugggcuggcugaccauugggaucucaggacccgacaacggcgccgucgcugugcuuaaauauaaugguauaauuacugagacaaucaagagcuggaggaagaaaauccugcggacccaggaaagugaguguacgugcguaaacgggucuuguuuuacuauuaugaccgauggaccuuccgacggcuuggcaagcuacaagaucuucaaaauugagaagggcaaaguuacaaagucgauagaacucaaugccccaaacucucacuaugaggaaugcuccuguuaccccgauacugggaaggugaugugcgucugccgcgacaacuggcacggaucaaauagaccuugggugaguuuugaucagaaccuggacuaucaaaucgguuacauuuguagcggcguguucggggauaauccaaggccgaaagacggaaccggcuccugcggucccgucucugcugacggggccaacggcguuaagggauuuagcuaccgguauggcaaugggguguggaucggacgcacaaaaucagauaguucccgacaugguuucgagaugaucugggacccuaacggcuggaccgagacggauagcagauuuucuguaaggcaggacguggucgcgaugacugaucggucaggguacaguggcagcuucgugcagcacccagaacugacaggacucgacuguaugcgucccugcuuuuggguugaguuaauucgcgguagaccugaagagaagaccauauggacuuccgggucuaucauuucguucuguggcgugaauagcgauacagucgacugguccuggccagauggagcagaacugcccuucaccaucgacaaauga

SEQ ID NO: 142641 - RNA, 1410 nt, Artificial Sequence
  derived and/or modified sequence opt3 from neuraminidase__InfluenzaA__AEG64787
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauagguugcggacucaagagagcgagugugccugcgugaacgggucguguuucaccgucaugacagauggaccaucugacggccaggcuuccuacaaaaucuuucgcaucgaaaaggguaaaauugugaagucaguggagaugaaugcccccaacuaucauuacgaagagugcaguuguuacccugauagcuccgagaucacuugcgucugcagagacaauuggcacgggucuaacaggccauggguuagcuucaaucagaaccucgaauaucagauuggauacauauguucaggcaucuuuggcgauaauccgcggcccaacgacaaaaccgggaguugcggaccuguguccagcaauggugcgaacggcguaaagggguucucuuuuaaguauggaaacggcguguggauuggucgcacaaaaucaaucaguagccgaaauggguucgagaugaucugggauccaaacggcuggaccggaacggacaaugacuuuuccauuaagcaagauauagucggcaucaacgaauggucuggguacucggggagcuucgugcagcaucccgagcugacuggucuggacuguauuagaccuugcuucuggguugaacucaucaggggccggccaaaagagaauacaauuuggaccuccgggucaaguaucucuuuuuguggagugaacagcgauacugucggcugguccuggcccgacggugcagaguuaccguucacaauagauaaguga

SEQ ID NO: 142642 - RNA, 1410 nt, Artificial Sequence
  derived and/or modified sequence opt3 from neuraminidase__InfluenzaA__AEG64837
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagccugaucuacaauggaaggcugguggauuccguaguuucauggaguaaagagauucuccggacgcaggaaagcgagugugugugcauaaacggcacuuguacagucgugaugaccgacggcucugcuuccgggaaggcagauacuaaaaucuuauucauugaggaaggaaagaucgugcauacaucaacccugagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuugugggcgacacgccccgcaagaaugauucaaguagcuccucucauugcuuggacccuaacaaugaggaaggugggcacggaguuaaaggcugggcuuuugaugacggcaacgauguguggauggggcgaaccauuaaugagacaagcagacugggauaugagacuuucaaggucaucgaagguuggucaaacccaaaaaguaagcuacagauuaauaggcaagugauaguagaccggggcaaccguuccggguacagcggaaucuuuucuguugagggcaaaucauguauuaaucgcugcuucuauguggaacucaucagagguaggaaggaggaaaccgagguccuguggacaaguaacagcaucguggucuuuugugggacuuccggcaccuacggaacaggcucuuggcccgauggggccgaccuuaaucugaugccuauuuga

SEQ ID NO: 142643 - RNA, 1410 nt, Artificial Sequence
  derived and/or modified sequence opt3 from neuraminidase__InfluenzaA__AEG64848
augaaccccaaucagaagaucauuaccauaggcagcgugucccugacaaucucuacuauuugcuucuuuaugcaaaucgccauucucaucacgaccgucacacuucacuucaaacaguacgaguuuuauucaccuccaaacaaucagguuaugcugugugaaccgacuauaaucgagagaaacauuaccgaaaucguguacuugacaaauaccacuauugagaaggaaaucugccccaaauuagcugaguauaggaacuggcugaagccucagugugacauaacaggguucgcaccauuuaguaaagauaauagcauucggcuauccgccggaggugacaucuggguaacccgcgagcccuacgugucuugcgauccugacaaguguuaucaauucgcgcucggccaggggacgacucugaacaauguccauucgaacaauaccgugcgagaucguacaccauacagaacucuucugaugaacgaauugggaguucccuuucaccucggcaccaaacaggugugcauugcuuggucaagcaguuccugucaugacgguaaggccuggcugcacgucugcaucacaggggaugacaagaaugcaaccgccucuuucaucuauaacggaaggcugguggauagcguaguuuccuggucaaaagagauucuccggacgcaggaaagugagugugugugcauaaauggcacuuguacagucgugaugaccgacggcagcgcuucugggaaggcagauacuaaaaucuuauuuauugaggaaggaaagaucgugcauacauccacccugucagguagcgcccaacacgucgaggaaugcaguugcuacccucgcuacccaggcguuagaugugugugcagggacaacuggaaggggucuaaccggccgauaguagauauuaauaucaaagaccacuccaucgugagcucguaugucuguucuggacuugugggcgacacgccccgcaagaacgauuccucaaguagcucccauugcuuggacccuaauaacgaggaaggugggcacggaguuaaaggcugggcuuucgaugacggcaaugauguguggauggggcgaaccauuaacgagacaucuagacugggauacgagacuuuuaaggucaucgaagguuggagcaauccaaaaucaaagcuacagauuaacaaacaggugauaguagacaggggcaaucggaguggguauuccggaaucuucagcguugagggcaagucuuguauuaaccguugcuuuuacguggaacucauccgcgguagaaaggaggaaaccgagguccuguggacaucaaauaguaucguggucuucugugggacuagcggcaccuauggaacaggcuccuggcccgauggggccgaccuuaaccugaugccuauuuga

SEQ ID NO: 142644 - RNA, 1410 nt, Artificial Sequence; identical to SEQ ID NO: 136249
  derived and/or modified sequence opt3 from neuraminidase__InfluenzaA__AEG64859

SEQ ID NO: 142645 - RNA, 1410 nt, Artificial Sequence; identical to SEQ ID NO: 136077
  derived and/or modified sequence opt3 from neuraminidase__InfluenzaA__AEG64870

SEQ ID NO: 142646 - RNA, 1410 nt, Artificial Sequence; identical to SEQ ID NO: 136269
  derived and/or modified sequence opt3 from neuraminidase__InfluenzaA__AEG64881

SEQ ID NO: 142647 - RNA, 1410 nt, Artificial Sequence; identical to SEQ ID NO: 136077
  derived and/or modified sequence opt3 from neuraminidase__InfluenzaA__AEG64892

SEQ ID NO: 142648 - RNA, 1410 nt, Artificial Sequence; identical to SEQ ID NO: 136153
  derived and/or modified sequence opt3 from neuraminidase__InfluenzaA__AEG64914

SEQ ID NO: 142649 - RNA, 1410 nt, Artificial Sequence; identical to SEQ ID NO: 136153
  derived and/or modified sequence opt3 from neuraminidase__InfluenzaA__AEG64925

SEQ ID NO: 142650 - RNA, 1410 nt, Artificial Sequence
  derived and/or modified sequence opt3 from neuraminidase__InfluenzaA__AEG64936
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcguucccuuucaccucgguaccagacagguguguaucgccuggucaagcaguuccugccaugacgggaaggcauggcugcacgucugugugacaggagaggauaaaaacgccaccgcuucuuucauuuauaauggcaggcugguagacagcaucggcuccuggucaaagaaaauccuccggacgcaggaaagugagugcguuuguauuaacgggacuugcacaguggucaugaccgauggaagcgcaucugguaaggccgacacuaaaauauuauuuaucgaggaaggcaagauugugcacaucuccacacugucagggagcgcucaacauguggaggaaugcaguuguuacccucgcuauccaggagucagaugcguuuguagggauaacuggaagggcucuaaucggccgauaguggacauuaacguaaaagauuacuccaucgugagcucguacgucugcucuggucuugugggggacacccccaggaagaaugacuccucaaguagcucccacuguuuggauccuaacaaugaggaaggaggccauggcguuaaagggugggccuucgacgauggaaacgacguguggaugggucgaacgaucucugagaagcugagaagcggcuaugagaccuuuaaagucauugaaggguggucaaagccaaauaguaaacuacagaucaaccgccaggugauuguagagcggggaaaucguuccggcuacagcgguauauucucuguugaagggaagucaugcaucaaccgcuguuuuuauguggagcucauuagaggcaggaaggaagagacagaggucugguggaccaguaauagcaucguggucuucugcggaacuuccggcacauacgggacuggaucuuggcccgauggugcggacaucaaccugaugccuauuuga

SEQ ID NO: 142651 - RNA, 1410 nt, Artificial Sequence; identical to SEQ ID NO: 136166
  derived and/or modified sequence opt3 from neuraminidase__InfluenzaA__AEG64947

SEQ ID NO: 142652 - RNA, 1410 nt, Artificial Sequence; identical to SEQ ID NO: 136153
  derived and/or modified sequence opt3 from neuraminidase__InfluenzaA__AEG64958

SEQ ID NO: 142653 - RNA, 1410 nt, Artificial Sequence; identical to SEQ ID NO: 136153
  derived and/or modified sequence opt3 from neuraminidase__InfluenzaA__AEG64969

SEQ ID NO: 142654 - RNA, 1410 nt, Artificial Sequence; identical to SEQ ID NO: 136153
  derived and/or modified sequence opt3 from neuraminidase__InfluenzaA__AEG64980

SEQ ID NO: 142655 - RNA, 1410 nt, Artificial Sequence
  derived and/or modified sequence opt3 from neuraminidase__InfluenzaA__AEG64991
augaaccccaaucagaagaucauuaccauaggcagcgugucccugacaaucucuacuauuugcuucuuuaugcaaaucgccauucucaucacgaccgucacacuucacuucaaacaguacgagucaaacaguccuccaaauaaccagguuaugcugugugaaccgacuauaaucgagagaaauauuaccgaaaucguguauuugacaaacaccacuauugagaaggaaaucugccccaaauuagcugaguacaggaauuggagcaagccucaguguaacauaacaggguuugcaccauucuccaaagacaauucuauucggcugucggccggaggugauaucuggguaacccgcgagcccuaugugucaugcgacccugauaaguguuaccaauuugcgcuaggccaggggacgacucucaacaauguccauagcaacgacaccgugcacgaucgaacaccauaucguacucugcuuaugaaugaacugggaguucccuuccauuugggcaccaaacaggugugcauugcuuggaguuccucuagcugucacgacgguaaggccuggcuccaugucugcgugacaggggaugacaagaacgcaaccgccuccuuuaucuacaauggaagacugguagauucaaucguuaguuggagcaaagagauucugaggacgcaggaaucugagugugugugcauaaacggcacuuguacagucgugaugaccgacggcuccgcuucagggaaggcagauacuaaaauccucuucauugaggaaggaaagaucgugcacacaagcaccuuaagugguucugcccaacacgucgaggaaugcuccugcuauccucgguacccaggcguucgcugugugugcagagacaacuggaaggggagcaauaggccgauaguagauauuaacaucaaagacuacucgaucgugucuuccuaugucuguucaggacuggugggcgacacgccccggaagaaugauaguagcuccucuagccauugccuugacccuaacaaugaggaaggugggcacggaguuaaaggcugggcuuuugaugacggcaacgauguguggauggggcgcaccauuucagagaaguugcgaaguggauacgagacauucaaagucaucgaagguugguccaauccaaacagcaagcugcagacuaauagacaggugauuguagacaggggcaaccggucuggguauucaggaauauuuaguguugagggcaaaagcuguaucaaucguugcuucuacguggaacuaauucgcgguagaaaggaggaaaccgagguccucuggacauccaacucuaucguggucuuuugugggacuucgggcaccuauggaacaggcagcuggcccgauggggccgacaucaaucugaugccuauuuga

SEQ ID NO: 142656 - RNA, 1410 nt, Artificial Sequence; identical to SEQ ID NO: 136343
  derived and/or modified sequence opt3 from neuraminidase__InfluenzaA__AEG65002

SEQ ID NO: 142657 - RNA, 1410 nt, Artificial Sequence
  derived and/or modified sequence opt3 from neuraminidase__InfluenzaA__AEG65013
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagauauucugaggacgcaggagagcgaaugugugugcauaaauggcacuuguacagucgugaugaccgacggcucugcuuccgggaaggcagauacuaaaauccucuuuauugaggagggaaagaucgugcacacaucaaccuuaagcgguagugcccaacacgucgaagagugcucuugcuauccucgguacccaggcguucgcugugugugcagagacaacuggaagggguccaacaggccgauaguagacauuaauaucaaagauuacagcaucgugucgucuuaugucuguuccggacuggugggcgacacgccccggaagaacgauucaaguagcuccucucauugccuugacccuaauaacgaagagggugggcacggaguuaaaggcugggcuuucgaugacggcaaugauguguggauggggcgcaccauuagcgaaaaguugcgacugggauacgagacauuuaaagucaucgaggguuggucaaacccaaauaguaagcuacagacuaacagacaggugauuguagaaaggggcaaucgguccggguauagcggaauauucucuguugagggcaaaucauguaucaaccguugcuuuuacguggaacucauucgcgguagaaaggaggaaaccgagguccuguggacaaguaauagcaucguggucuucugugggacuuccggcaccuauggaacaggcucuuggcccgacggggccgauaucaaccuuaugccuauuuga

SEQ ID NO: 142658 - RNA, 1410 nt, Artificial Sequence
  derived and/or modified sequence opt3 from neuraminidase__InfluenzaA__AEG65024
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccauguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaguucgcgcuaggccaagggacgacucucaauaacguccacucaaaugauaccgugcaugaccgaacaccauaucguacucugcuuaugaacgaacugggaguucccuuucacuugggcaccaaacaggugugcauugcuuggagcaguuccucuugucaugaugguaaggccuggcuccacgucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccagcaugucgaggaaugcucuugcuauccucgguacccaggcguucgcugugugugcagagauaacuggaagggguccaacaggccgauaguagacauuaauaucaaagacuacagcaucgugucgucuuaugucuguuccggacuggugggcgauacgccccggaagaacgacucaaguagcuccucucacugccuugauccuaauaacgaggaaggugggcauggaguuaaaggcugggcuuucgacgauggcaaugacguguggauggggcgcaccauuagcgagaaguugcgacugggauacgagacauuuaaagucaucgaagguuggucaaacccaaauaguaagcuacaaauuaacagacaggugauaguagauaggggcaaucgguccggguauagcggaaucuucucuguugagggcaaaucauguauuaaccguugcuuuuacguggaacucauccgcgguagaaaggaggaaacugagguccuguggaccaguaauagcaucguggucuucugugggacauccggcacuuauggaaccggcucuuggcccgacggggccgauauuaaccuuaugccuauauga

SEQ ID NO: 142659 - RNA, 1410 nt, Artificial Sequence
  derived and/or modified sequence opt3 from neuraminidase__InfluenzaA__AEG65035
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaguaugccccaaauuagcugaguacaggaauuggaguaagccucaguguaacaucacaggguucgcaccauuuagcaaagacaauuccauacggcugucugccggaggugauauuugggugacccgcgagcccuaugucucgugcgaccuagauaaguguuaccaauucgcgcucggccaggggacgacucugaacaaugugcauucaaacgacaccguucacgaucgaacaccuuaucguacucuucugaugaaugaauugggagugccauuucaucucggcaccaagcaggucugcaucgcuuggagcaguuccucuugucacgacgguaaagccuggcugcaugugugcguaacaggggaugacaagaacgcaaccgccagcuucauuuacaauggaagacugguugauuccaucgugucauggaguaaagagauccucaggacgcaggaaagcgagugugucugcauuaacggcacuuguacaguggugaugaccgacggcucugcuuccgggaaggcagauacuaaaauauuauuuaucgaggaaggaaagauuguccacacaucaacccugagcgguagugcccaacacguugaggaaugcucuugcuauccccgguacccuggcgugcgcuguguaugcagagacaacuggaagggguccaauaggccaaucguggauauaaacauuaaagacuacagcaucgucucgucuuauguguguuccggacuuguuggcgacacgccgcggaagaaugauucaaguagcuccucucauugcuuggaccccaacaaugaggaaggugggcacggagugaaaggcugggcuuucgaugacggcaacgaugucuggauggggcgcaccaucagcgagaagcugcgaucaggauacgagacauuuaaagugauugaagguuggaguaauccuaacuccaagcuacagaucaauagacagguaauuguugacaggggcaaccggagcggguauucuggaauauucucaguggagggcaaaaguuguaucaaucguugcuuuuacgucgaacucauucgcgguagaaaggaggaaaacgaggugcuguggacuagcaauuccaucgucguguucugugggaccucuggcacauauggaacuggcucguggccagauggggccgacaucaaccuuaugcccauuuga

SEQ ID NO: 142660 - RNA, 1410 nt, Artificial Sequence; identical to SEQ ID NO: 136728
  derived and/or modified sequence opt3 from neuraminidase__InfluenzaA__AEG65057

SEQ ID NO: 142661 - RNA, 1410 nt, Artificial Sequence; identical to SEQ ID NO: 137723
  derived and/or modified sequence opt3 from neuraminidase__InfluenzaA__AEG65068

SEQ ID NO: 142662 - RNA, 1410 nt, Artificial Sequence
  derived and/or modified sequence opt3 from neuraminidase__InfluenzaA__AEG65079
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugccaagcacgucgaggaaugcucuugcuauccucgguacccaggcguucgcugugugugcagagacaacuggaaaggguccaauaggccgauaguagauauuaacaucaaggacuacagcaucgugucgucuuaugucuguuccggacuggugggcgacacgccccggaaaaaugauucaaguagcuccggucauugccuugacccuaacaaugaggaagggggacacggcguuaagggcugggcuuucgaugacgggaacgauguguggaugggacgcaccauuucugagaaauugcgaagcgguuacgagacauuuaaggucaucgaaggcuggucaaauccaaacaguaaacugcaaauuaauagacaggugauaguagacagggggaaccgguccggauauagcggcaucuucucuguugaggguaagucauguauuaaucguugcuuuuacguggaacuaauccgcgggagaaaggaggaaacugagguccucuggaccaguaacagcaucguggucuucuguggcacauccggaacuuauggcaccgggucuuggcccgauggagccgacauuaaucugaugccuauauga

SEQ ID NO: 142663 - RNA, 1410 nt, Artificial Sequence
  derived and/or modified sequence opt3 from neuraminidase__InfluenzaA__AEG65090
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucauacacacaucaaccuuaagcgguagugcccaacacguggaggaaugcucuugcuauccucgguacccaggcguccgcuguguuugcagagacaacuggaagggguccaauaggccgauuguggauaucaacaucaaagacuacagcauuguaucgucuuauguguguuccggacuggucggcgacacgccccggaagaaugauucaaguagcuccucucauugccuugacccuaacaaugaggaaggugggcacggagugaaaggcugggcuuucgaugacggcaacgauguuuggauggggcgcaccaucagcgagaaguugcgaucaggauacgagacauuuaaagugauugaagguuggaguaauccaaacuccaagcugcagauaaauagacaggucaucguggacaggggcaaccggagcggguauucuggaauuuucucaguagagggcaaaaguuguaucaaucguugcuuuuacguugaacuaauccgcgguagaaaggaggaaacugaggugcucuggaccagcaacuccauugucguguucugugggacaucuggcacuuauggaaccggcucguggcccgauggggccgacauaagccugaugccuaucuga

SEQ ID NO: 142664 - RNA, 1410 nt, Artificial Sequence
  derived and/or modified sequence opt3 from neuraminidase__InfluenzaA__AEG65101
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccagacaaucagguuaugcugugugaaccgacuauaaucgagagaaacauuaccgaaaucguguauuugacaaauaccacuauugagaaggaaaucugccccaaauuagcugaguacaggaacuggaguaagccucagugugauauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccguugugucauggaguaaagacauccugaggacgcaggagagcgaaugugucugcauuaacggcacuuguacaguggugaugaccgauggcucugcuuccgggaaggcagacacuaaaauacucuuuaucgaggagggaaagauuguccacacaucaaccuuaagcgguagugcccaacacguugaagagugcucuugcuauccucgguacccaggcgugcgcuguguaugcagagacaauuggaagggguccaacaggccgaucguggauauaaacauuaaaaauuacagcaucgucucgucuuauguguguuccggacugguuggcgacacgccccggaagaccgauucaaguagcuccucucauugccuugacccuaacaaugaagagggugggcacggagugaaaggcugggcuuucgaugacggcaacgaugucuggauggggcgcacaaucagcgaaaaguugcgacugggauacgagacuuuuaaagugauugaggguuggucaaauccaaacaguaagcuacagaucaauagacagguaauuguugacaggggcaaccgguccggguauagcggaauauucucuguggaaggcaaaucauguaucaaucguugcuuuuacgucgagcucauucgcgguagaaaggaagagaccgaagugcuguggacaaguaacagcaucgucguguucugugggacuuccggcaccuauggaacaggcucuuggcccgauggggccgacaucaaucuuaugccuauuuga

SEQ ID NO: 142665 - RNA, 1410 nt, Artificial Sequence
  derived and/or modified sequence opt3 from neuraminidase__InfluenzaA__AEG65123
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuaccauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaaugauacagugcacgaccgaacuccauaucguacccugcuuaugaacgaacugggaguucccuuucauuugggcacaaaacaggugugcaucgcuuggagcaguuccucuugucacgaugguaaagccuggcuccaugucugcgugaccggggacgauaagaaugcaacggccagcuucauuuacaacggaagacugguagacuccguugugucauggaguaaagauauccugaggacucaggagagcgaaugugucugcaucaauggcacauguaccguggugaugacugacggcucugcuuccgggaaggcagauacaaaaauucucuuuauagaggagggaaagaucguccacaccucaacguuaagcgguagugcccaacacguugaagagugcucuugcuauccucgguacccaggcgugcgcuguguaugcagagacaacuggaagggguccaacaggccgauuguggacaucaauauaaagaacuacagcauugucucgucuuauguguguuccggacugguuggcgauacaccccggaagaccgacucaaguagcuccucucauugccuugauccuaauaacgaagagggugggcacggagugaaaggcugggcuuucgacgauggcaaugacgucuggauggggcgcacuaucagcgaaaaguugcgacugggauacgagaccuuuaaagugaucgaggguuggucaaacccaaauaguaagcuacagauuaacagacagguaaucguugauaggggcaaucgguccggguauagcggaauuuucucuguggaaggcaaaucauguauaaaccguugcuuuuacgucgagcucauccgcgguagaaaggaagagaaugaagugcuguggacaaguaacagcauugucguguucugugggacuuccggcaccuauggaacaggcucuuggcccgacggggccgauaucaaucuuaugccuaucuga

SEQ ID NO: 142666 - RNA, 1410 nt, Artificial Sequence; identical to SEQ ID NO: 137723
  derived and/or modified sequence opt3 from neuraminidase__InfluenzaA__AEG65134

SEQ ID NO: 142667 - RNA, 1410 nt, Artificial Sequence
  derived and/or modified sequence opt3 from neuraminidase__InfluenzaA__AEG65145
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggacaacuggaagggcucuaaucggccgauaguggauauuaacguaaaggacuacuccaucgugagcucguaugucugcucuggucuugugggggacacccccaggaaaaaugauuccuucucaaacagucauuguuuggacccuaauaacgaggaaggaggccacggcguuaaggggugggccuuugaugacggaaaugauguguggaugggucgaacgaucagcgagaaacugagauccggcuacgagaccuucaaggucauugaaggguggucuaaaccaaacagcaagcuacagaucaaucgccaggugauuguagagcggggaaaccguucaggcuauagugguauauuuuccguugaagggaaaagcugcaucaaucgcuguuucuacguggagcucauuagaggcaggaaggaagagacagaggucugguggacuucuaacucaaucguggucuuuugcggaaccaguggcacauaugggacuggaagcuggcccgacggugcggauaucaaucugaugccuauuuga

SEQ ID NO: 142668 - RNA, 1410 nt, Artificial Sequence
  derived and/or modified sequence opt3 from neuraminidase__InfluenzaA__AEG65156
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacacauccacccugucagggagcgcucaacacguggaggaaugcaguuguuauccucgcuacccaggagucagaugcguuuguagggacaacuggaagggcucuaaucggccgaucguggauauaaacguaaaggacuacuccauugugagcucguaugucugcucuggucuugugggggacacgccccgcaaaaaugauuccuucucaaguagccauuguuuggacccuaacaaugaggaaggaggccacggcguuaaggggugggccuuugaugacggaaacgauguguggaugggucgaaccaucuccgagaaacugagaucuggcuacgagacauucaaggucaucgaaggguggagcaaaccaaauucaaagcuacagauuaacaggcaagugaucguagagcggggaaaucguaguggcuauuccgguauuuuuagcguugaagggaaaucuugcauaaaccgcuguuucuacguggagcucaucagaggcaggaaggaagagacugaggucugguggaccucaaauaguauuguggucuuuugcggaacaagcggcacuuaugggaccggauccuggcccgacggugcggauaucaaccugaugccuaucuga

SEQ ID NO: 142669 - RNA, 1410 nt, Artificial Sequence
  derived and/or modified sequence opt3 from neuraminidase__InfluenzaA__AEG65167
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucgccacguggaggaaugcaguuguuauccuagauacccaggagucaggugcguuugucgggacaacuggaagggcucuaaucgcccgauaguggauauuaacguaaaggacuacuccaucgugagcucguaugucugcucuggucuugugggggacacgccccggaaaaaugauuccuucucaaguagccauuguuuggacccuaacaaugaggaaggaggccacggcguuaaggggugggccuuugaugacggaaacgauguguggauggguagaaccaucuccgagaaacugaggucuggcuacgagaccuucaaggucauugaaggguggagcaaaccaaauucaaagcuacaaaucaaccgacaggugauuguagagcguggaaaucgcaguggcuauuccgguauauuuagcguugaagggaaaucuugcaucaacagauguuucuacguggagcucauuaggggccggaaggaagagacagaggucugguggacuucaaauaguaucguggucuuuugcggaaccagcggcacauaugggacuggauccuggcccgacggugcggauaucaaccugaugccuauuuga

SEQ ID NO: 142670 - RNA, 1410 nt, Artificial Sequence
  derived and/or modified sequence opt3 from neuraminidase__InfluenzaA__AEG65178
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacaauaccgugcaugaccgaacaccauaccguacucuucugaugaacgaauugggcguucccuuucaccucgguaccagacagguguguaucgccuggucaagcaguuccugccaugaugggaaggcauggcugcacgucugugugacaggagacgauaaaaaugccaccgcuucuuucauuuauaacggcaggcugguagacagcaucggcuccuggucaaagaacauccuccggacgcaggagagugaaugcguuuguauuaaugggacuugcacaguggucaugaccgauggaagcgcaucugguaaagccgacacuaagauauuauuuaucgaggagggcaaaauugugcacaucuccacacugucagggagcgcucaacauguggaagagugcaguuguuacccucgcuauccaggagucagaugcguuuguagggauaacuggaagggcucuaaucggccgauaguggacauuaacguaaaggauuacuccaucgugagcucguacgucugcucuggucuugugggggacacccccaggaaaaaugacuccuucucaaguagccacuguuuggauccuaacaaugaagagggaggccauggcguuaaggggugggccuuugacgauggaaacgacguguggaugggucgaacgaucuccgaaaaacugagaucuggcuaugagaccuucaaggucauugagggguggagcaaaccaaauucaaagcuacagaucaaccgccaggugauuguagaacggggaaaucguaguggcuacuccgguauauuuagcguugaggggaaaucuugcaucaaccgcuguuucuauguggaacucauuagaggcaggaaggaggaaacagaggucugguggacuucaaauaguaucguggucuuuugcggaaccagcggcacauacgggacuggauccuggcccgauggugcggacaucaaccugaugccuauuuga

SEQ ID NO: 142671 - RNA, 1410 nt, Artificial Sequence
  derived and/or modified sequence opt3 from neuraminidase__InfluenzaA__AEG65189
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaacuggaagggguccaacaggccgauaguagacauuaauaucaacgacuacagcaucgugucgucuuaugucuguuccggacuggugggcgauacgccccggaaaaaugacucaaguagcuccucucauugccuugauccuaacaaugaggaaggugggcacggaguuaagggcugggcuuucgacgauggcaacgacguguggauggggcgcaccauuagcgagaaauugcgaucaggauacgagacauuuaaggucaucgaagguuggaguaauccaaacuccaaacugcagauuaauagacaggugauaguagauaggggcaaccggagcggguauucuggaaucuucucaguugagggcaagaguuguauuaaucguugcuuuuacguggaacuaauccgcgguagaaaagaggaaacugagguccucuggaccagcaacuccaucguggucuucugugggacaucuggcacuuauggaaccggcucguggcccgacggggccgauauuaaucugaugccuauauga

SEQ ID NO: 142672 - RNA, 1410 nt, Artificial Sequence
  derived and/or modified sequence opt3 from neuraminidase__InfluenzaA__AEG65200
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagaggugcugaggacgcaggaaagcgagugugucugcauuaauggcacuuguacaguggugaugaccgauggcucugcuuccgggaaggcagacacuaaaauacucuuuaucgaggaaggaaagauuguccacacaucaaccuuaagcgguagugcccaacacguugaggaaugcucuugcuauccucgguacccaggcgugcgcuguguaugcagagauaacuggaagggguccaacaggccgaucguggacauaaauauuaaagacuacagcaucgucucgucuuauguguguuccggacugguuggcgauacgccccggaagaacgacucaaguagcuccucucauugccuugauccuaauaacgaggaaggugggcacggagugaaaggcugggcuuucgacgauggcaaugacgucuggauggggcgcaccaucagcgagaaguugcgaucaggauacgagacauuuaaagugauugaagguuggaguaacccaaauuccaagcugcagacuaacagacagguaaucguugauaggggcaaucggagcggguauucuggaauuuucucaguggagggcaaaaguuguauaaaccguugcuuuuacgucgaacuaauccgcgguagaaaggaggaaaccgaggugcucuggacaagcaauuccauugucguguucugugggacuucuggcaccuauggaacaggcucguggcccgacggggccgauaucaaccugaugccuaucuga

SEQ ID NO: 142673 - RNA, 1410 nt, Artificial Sequence; identical to SEQ ID NO: 136728
  derived and/or modified sequence opt3 from neuraminidase__InfluenzaA__AEG65211

SEQ ID NO: 142674 - RNA, 1410 nt, Artificial Sequence; identical to SEQ ID NO: 136730
  derived and/or modified sequence opt3 from neuraminidase__InfluenzaA__AEG65222

SEQ ID NO: 142675 - RNA, 1410 nt, Artificial Sequence
  derived and/or modified sequence opt3 from neuraminidase__InfluenzaA__AEG65233
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuuuauugaggagggaaagaucgugcacacaucaaccuuaagcgguagugcccaacacgucgaagagugcucuugcuauccucgguacccaggcguucgcugugugugcagagauaacuggaaaggguccaacaggccgauaauugacaucaauaucaaggacuacagcauuguaucgucuuauguguguuccggacuggucggcgauacgccccggaaaaacgacucaaguagcuccucucauugccuugauccuaauaacgaagagggugggcacggagugaagggcugggcuuucgacgauggcaaugacguuuggauggggcgcaccaucagcgaaaaauugcgaucaggauacgagacauuuaaggugauugaggguuggaguaacccaaauuccaaacugcagauaaacagacaggucaucguggauaggggcaaucggagcggguauucuggaauuuucucaguagaaggcaagaguuguaucaaccguugcuuuuacguugagcuaauccgcgguagaaaggaagagacugaagugcucuggaccagcaauuccauugucguguucugugggacaucuggcacuuauggaaccggcucguggcccgacggggccgauauaaaccugaugccuaucuga

SEQ ID NO: 142676 - RNA, 1410 nt, Artificial Sequence
  derived and/or modified sequence opt3 from neuraminidase__InfluenzaA__AEG65244
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcacccaacaggugugcauugcuuggagcaguuccucuugucacgacgguaaggccuggcuccaugucugcgugacaggggaugacgagaacgcaaccgccagcuucaucuacaauggaagacugguagauuccaucguuucauggaguaaaaagauucugaggacgcaggaaagcgagugugugugcauaaacggcacuuguacagucgugaugaccgacggcucugcuuccgggaaagcagauacuaagauccucuuuauugaggaaggaaaaaucgugcacacaucaaccuuaagcgguagugcccagcacgucgaggaaugcucuugcuauccucgguacccaggcguucgcugugugugcagagacaacuggaagggguccaauaggccgauaguagauauuaacaucaaggacuacagcaucgcuucgucuuauguguguuccggacuggucggcgacacgccccggaaaaaugauucaaguagcuccucucauugccuugacccuaacaaugaggaaggugggcacggagugaagggcugggccuucgaugacggcaacgauguuuggauggggcgcaccauuagcgagaaauugcgaucaggauacgagacauuuaaggugaucgaagguuggaguaauccaaacuccaaacugcagauuaauagacaggucauaguggacaggggcaaccggagcggguauucuggaaucuucucaguagagggcaagaguuguauuaaucguugcuuuuacguugaacuaauccgcgguagaaaccaagagacugaagugcucuggaccagcaauuccaucgucguguucugugggacaucuggcacuuauggaaccggcucguggcccgauggggcggacauuaaccugaugccuauauga

SEQ ID NO: 142677 - RNA, 1410 nt, Artificial Sequence; identical to SEQ ID NO: 136730
  derived and/or modified sequence opt3 from neuraminidase__InfluenzaA__AEG65255

SEQ ID NO: 142678 - RNA, 1410 nt, Artificial Sequence; identical to SEQ ID NO: 136607
  derived and/or modified sequence opt3 from neuraminidase__InfluenzaA__AEG65266

SEQ ID NO: 142679 - RNA, 1410 nt, Artificial Sequence; identical to SEQ ID NO: 136607
  derived and/or modified sequence opt3 from neuraminidase__InfluenzaA__AEG65277

SEQ ID NO: 142680 - RNA, 1410 nt, Artificial Sequence
  derived and/or modified sequence opt3 from neuraminidase__InfluenzaA__AEG65288
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacugguggaguauaggaauuggucaaagccucagugcaacaucacaggguucgcaccauuuaguaaagacaauagcauacggcuauccgccggaggugauauuugggucacccgcgagcccuacgugucuugugacccugauaagugcuaucaauucgcgcucggccaggggacgacucugaacaauggacacucgaacgacaccguucaugaucgaacaccauaccguacucuucugaugaaugaauugggcgugcccuuucaccucgguaccagacaggucuguaucgcuuggucaagcaguuccugccaugacgggaaggccuggcugcacguguguguaacaggagaugacaaaaacgcaaccgccucuuucauuuauaauggcaggcugguugauagcaucggcuccuggucaaagaaaauccuccggacgcaggagagugaaugcguguguauuaacgggacuugcacagucgugaugaccgacggaagcgcuucugguaaggcagauacuaaaauauuauuuaucgaggagggcaagauugugcacaucuccacacugucagggagcgcccaacaugucgaagagugcaguuguuacccucgcuauccaggaguuagaugcguguguagggacaacuggaagggcucuaaucggccgauaguagauauuaacgugaaagacuacuccaucgucagcucguacgugugcucuggucuuguuggggacacgccccgcaagaauaacuccuucucaaguagccacuguuuggauccuaauaacgaagagggaggccauggcgugaaagggugggcuuuugacgauggaaaugacgucuggaugggucgaaccaucuccgaaaagcugagaucuggcuaugagaccuucaaagugauugagggguggagcaagccaaacucaaaacuacagaucaauaggcagguaauuguugaacggggaaaccguaguggcuacuccgguauauuuagcguggaggggaagucuugcaucaaucgcuguuucuaugucgaacucauuagaggcaggaaggaggaaacagaggugugguggacuucaaacaguaucgucguguuuugcggaaccagcggcacauacgggacuggauccuggcccgauggugccgacaucaaucugaugccuauuuga

SEQ ID NO: 142681 - RNA, 1410 nt, Artificial Sequence; identical to SEQ ID NO: 136607
  derived and/or modified sequence opt3 from neuraminidase__InfluenzaA__AEG65299

SEQ ID NO: 142682 - RNA, 1410 nt, Artificial Sequence; identical to SEQ ID NO: 136730
  derived and/or modified sequence opt3 from neuraminidase__InfluenzaA__AEG65310

SEQ ID NO: 142683 - RNA, 1410 nt, Artificial Sequence; identical to SEQ ID NO: 136730
  derived and/or modified sequence opt3 from neuraminidase__InfluenzaA__AEG65321

SEQ ID NO: 142684 - RNA, 1410 nt, Artificial Sequence; identical to SEQ ID NO: 136730
  derived and/or modified sequence opt3 from neuraminidase__InfluenzaA__AEG65332

SEQ ID NO: 142685 - RNA, 1410 nt, Artificial Sequence; identical to SEQ ID NO: 136730
  derived and/or modified sequence opt3 from neuraminidase__InfluenzaA__AEG65354

SEQ ID NO: 142686 - RNA, 1410 nt, Artificial Sequence; identical to SEQ ID NO: 136730
  derived and/or modified sequence opt3 from neuraminidase__InfluenzaA__AEG65365

SEQ ID NO: 142687 - RNA, 1410 nt, Artificial Sequence
  derived and/or modified sequence opt3 from neuraminidase__InfluenzaA__AEG65376
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcacccaacaggugugcauugcuuggagcaguuccucuugucacgacgguaaggccuggcuccaugucugcgugacaggggaugacgagaacgcaaccgccagcuucaucuacaauggaagacugguagauuccaucguuucauggaguaaaaagauucugaggacgcaggaaagcgagugugugugcauaaacggcacuuguacagucgugaugaccgacggcucugcuuccgggaaagcagauacuaagauccucuuuauugaggaaggaaaaaucgugcacacaucaaccuuaagcgguagugcccagcacgucgaggaaugcucuugcuauccucgguacccaggcguucgcugugugugcagagacaacuggaagggguccaauaggccgauaguagauauuaacaucaaggacuacagcaucgugucgucuuaugucuguuccggacuggugggcgacacgccccggaaaaaugauucaaguagcuccucucauugccuugacccuaacaaugaggaaggugggcacggaguuaagggcugggcuuucgaugacggcaacgauguguggauggggcgcaccauuagcgagaaauugcgaucaggauacgagacauuuaaggucaucgaagguuggaguaauccaaacuccaaacugcagauuaauagacaggugauaguagacaggggcaaccggagcggguauucuggaaucuucucaguugagggcaagaguuguauuaaucguugcuuuuacguggaacuaauccgcgguagaaaccaagagacugaaguccucuggaccagcaauuccaucguggucuucugugggacaucuggcacuuauggaaccggcucguggcccgauggggccgacauuaaccugaugccuauauga

SEQ ID NO: 142688 - RNA, 1410 nt, Artificial Sequence; identical to SEQ ID NO: 136607
  derived and/or modified sequence opt3 from neuraminidase__InfluenzaA__AEG65387

SEQ ID NO: 142689 - RNA, 1410 nt, Artificial Sequence; identical to SEQ ID NO: 136607
  derived and/or modified sequence opt3 from neuraminidase__InfluenzaA__AEG65398

SEQ ID NO: 142690 - RNA, 1410 nt, Artificial Sequence; identical to SEQ ID NO: 136607
  derived and/or modified sequence opt3 from neuraminidase__InfluenzaA__AEG65409

SEQ ID NO: 142691 - RNA, 1410 nt, Artificial Sequence; identical to SEQ ID NO: 136607
  derived and/or modified sequence opt3 from neuraminidase__InfluenzaA__AEG65420

SEQ ID NO: 142692 - RNA, 1410 nt, Artificial Sequence; identical to SEQ ID NO: 136607
  derived and/or modified sequence opt3 from neuraminidase__InfluenzaA__AEG65431

SEQ ID NO: 142693 - RNA, 1410 nt, Artificial Sequence; identical to SEQ ID NO: 136728
  derived and/or modified sequence opt3 from neuraminidase__InfluenzaA__AEG65442

SEQ ID NO: 142694 - RNA, 1410 nt, Artificial Sequence; identical to SEQ ID NO: 136730
  derived and/or modified sequence opt3 from neuraminidase__InfluenzaA__AEG65453

SEQ ID NO: 142695 - RNA, 1410 nt, Artificial Sequence; identical to SEQ ID NO: 136730
  derived and/or modified sequence opt3 from neuraminidase__InfluenzaA__AEG65464

SEQ ID NO: 142696 - RNA, 1410 nt, Artificial Sequence; identical to SEQ ID NO: 136730
  derived and/or modified sequence opt3 from neuraminidase__InfluenzaA__AEG65475

SEQ ID NO: 142697 - RNA, 1410 nt, Artificial Sequence
  derived and/or modified sequence opt3 from neuraminidase__InfluenzaA__AEG65486
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugagcauaggaauuggaguaagccucagugugacauaacaggguucgcaccauuuagcaaagauaacuccauucggcugucugccggaggugacaucuggguaacccgcgagcccuacgugucgugcgauccugacaaguguuaucaauucgcgcuaggccaggggacgacucucaauaacguccacucaaaugauaccgugcaugaccgaacaccauaccguacucugcuuaugaacgaacugggaguucccuuucacuugggcaccaaacaggugugcauugcuuggagcaguuccucuugucaugaugguaaggccuggcuccacgucugcgugacaggggacgauaagaaugcaaccgccagcuucaucuauaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuuuauugaggagggaaagaucgugcacacaucaaccuuaagcgguagugcccaacaugucgaagagugcucuugcuacccucgguauccaggcguucgcugugugugcagagauaacuggaaaggguccaacaggccgauaguagacauuaauaucaaggacuacagcaucgugucgucuuacgucuguuccggacuggugggcgauacgccccggaaaaacgacucaaguagcuccucucacugccuugauccuaauaacgaagagggugggcauggaguuaagggcugggcuuucgacgauggcaaugacguguggauggggcgcaccauuagcgaaaaauugcgaucaggauaugagacauuuaaggucaucgaggguuggaguaacccaaauuccaaacugcagauuaacagacaggugauaguagauaggggcaaucggagcggguacucuggaaucuucucaguugaaggcaagaguuguauuaaccguugcuuuuauguggagcuaauccgcgguagaaaggaagagacugaaguccucuggaccagcaauuccaucguggucuucugugggacaucuggcacuuacggaaccggcucguggcccgacggggccgauauuaaccugaugccuauauga

SEQ ID NO: 142698 - RNA, 1410 nt, Artificial Sequence; identical to SEQ ID NO: 136730
  derived and/or modified sequence opt3 from neuraminidase__InfluenzaA__AEG65497

SEQ ID NO: 142699 - RNA, 1410 nt, Artificial Sequence; identical to SEQ ID NO: 136730
  derived and/or modified sequence opt3 from neuraminidase__InfluenzaA__AEG65508

SEQ ID NO: 142700 - RNA, 1410 nt, Artificial Sequence; identical to SEQ ID NO: 136730
  derived and/or modified sequence opt3 from neuraminidase__InfluenzaA__AEG65519

SEQ ID NO: 142701 - RNA, 1410 nt, Artificial Sequence; identical to SEQ ID NO: 136730
  derived and/or modified sequence opt3 from neuraminidase__InfluenzaA__AEG65530

SEQ ID NO: 142702 - RNA, 1410 nt, Artificial Sequence; identical to SEQ ID NO: 136730
  derived and/or modified sequence opt3 from neuraminidase__InfluenzaA__AEG65541

SEQ ID NO: 142703 - RNA, 1410 nt, Artificial Sequence
  derived and/or modified sequence opt3 from neuraminidase__InfluenzaA__AEG65563
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugaccgauguuaccaauucgcgcuaggccaggggacgacucucaauaacguccauucaaaugauaccgugcacgaccguacaccauauagaacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaaggcugguagacuccaucguuucauggaguaagaaaauucugcggacgcaggagagcgaaugugugugcauaaauggcacuuguacagucgugaugaccgauggcucugcuuccgggaaggcagacacuaaaauccucuuuauugaggagggaaagaucgugcacacaucaaccuuaagcgguagugcccaacacgucgaagagugcucuugcuauccucgcuacccaggcguuagaugugugugcagggauaacuggaagggguccaaccggccgauaguagacauuaauaucaaagacuacagcaucgugucgucuuaugucuguuccggacuggugggcgauacgccccgcaagaacgacucaaguagcuccucucauugccuugauccuaauaacgaagagggugggcacggaguuaaaggcugggcuuucgacgauggcaaugacguguggauggggcgaaccauuagcgaaaaguugagaucaggauacgagacauuuaaagucaucgaggguuggaguaacccaaauuccaagcugcagauuaacaggcaagugauaguagaucggggcaaucguagcggguauucuggaaucuucucaguugaaggcaaaaguuguauuaaccgcugcuuuuacguggagcuaaucagagguaggaaggaagagacugaaguccucuggaccagcaauuccaucguggucuucugugggacaucuggcacuuauggaaccggcucguggcccgacggggccgauauuaaccugaugccuauauga

SEQ ID NO: 142704 - RNA, 1410 nt, Artificial Sequence
  derived and/or modified sequence opt3 from neuraminidase__InfluenzaA__AEG65574
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaguuggagcaagccucagugugacauaacaggguucgcaccauuuuccaaagauaauucuauucggcugucggccggaggugacaucuggguaacccgcgagcccuaugugucaugcgauccugaccgauguuaccaauucgcgcuaggccaggggacgacucucaacaauguccauagcaacgauaccgugcacgaccguacaccauauagaacucugcuuaugaaugaacugggaguucccuuucauuugggcaccaaacaggugugcauugcuuggaguuccucuagcugucacgaugguaaggccuggcuccaugucugcgugacaggggacgauaagaacgcaaccgccuccuucaucuacaauggaaggcugguagacucaaucguuaguuggagcaagaaaauucugcggacgcaggagucugaaugugugugcauaaacggcacuuguacagucgugaugaccgauggcuccgcuucagggaaggcagacacuaaaauccucuuuauugaggagggaaagaucgugcacacaagcaccuuaagugguucugcccaacacgucgaagagugcuccugcuauccucgcuacccaggcguuagaugugugugcagggauaauuggaaggggagcaaccggccgauaguagacauuaacaucaaagacuacucgaucgugucuuccuaugucuguucaggacuggugggcgauacgccccgcaagaaugacaguagcuccucuagccauugccuugauccuaacaaugaagagggugggcacggaguuaaaggcugggcuuucgacgauggcaacgacguguggauggggcgaaccauuucagaaaaguugagaaguggauacgagacauuuaaagucaucgaggguugguccaauccaaacagcaagcugcagauuaauaggcaagugauaguagaucggggcaaccguucuggguauucaggaaucuucaguguugaaggcaaaagcuguauuaaucgcugcuuuuacguggagcuaaucagagguaggaaggaagagacugaaguccucuggaccuccaacucuaucguggucuucugugggacaucgggcacuuauggaaccggcagcuggcccgacggggccgauauuaaucugaugccuauauga

SEQ ID NO: 142705 - RNA, 1410 nt, Artificial Sequence; identical to SEQ ID NO: 142703
  derived and/or modified sequence opt3 from neuraminidase__InfluenzaA__AEG65585

SEQ ID NO: 142706 - RNA, 1410 nt, Artificial Sequence; identical to SEQ ID NO: 142703
  derived and/or modified sequence opt3 from neuraminidase__InfluenzaA__AEG65596

SEQ ID NO: 142707 - RNA, 1410 nt, Artificial Sequence
  derived and/or modified sequence opt3 from neuraminidase__InfluenzaA__AEG65607
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuuuauugaggagggaaagaucgugcacacaucaaccuuaagcgguagugcccaacacgucgaagagugcucuugcuauccucgguacccaggcguucgcugugugugcagagauaacuggaaaggguccaacaggccgauaguagacauuaauaucaaggacuacagcaucgcuucgucuuauguguguuccggacuggucggcgauacgccccggaaaaacgacucaaguagcuccucucauugccuugauccuaauaacgaagagggugggcacggagugaagggcugggccuucgacgauggcaaugacguuuggauggggcgcaccauuagcgaaaaauugcgaucaggauacgagacauuuaaggugaucgaggguuggaguaacccaaauuccaaacugcagauuaacagacaggucauaguggauaggggcaaucggagcggguauucuggaaucuucucaguagaaggcaagaguuguauuaaccguugcuuuuacguugagcuaauccgcgguagaaaggaagagacugaagugcucuggaccagcaauuccaucgucguguucugugggacaucuggcacuuauggaaccggcucguggcccgacggggcggauauuaaccugaugccuauauga

SEQ ID NO: 142708 - RNA, 1410 nt, Artificial Sequence
  derived and/or modified sequence opt3 from neuraminidase__InfluenzaA__AEG65629
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaacuggaagggguccaacaggccgauaguagacauuaauaucaaagacuacagcaucgugucgucuuaugucuguuccggacuggugggcgauacgccccggaagaacgacucaaguagcuccucucauugccuugauccuaaugacgaggaaggugggcacggaguuaaaggcugggcuuucgaugacggcaacgauguguggauggggcgcaccauuagcgagaaguugcgaucaggauacgagacauuuaaagucaucgaagguuggaguaauccaaacuccaagcugcagauuaauagacaggugauaguagacaggggcaaccggagcggguauucuggaaucuucucaguugagggcaaaaguuguauuaaucguugcuuuuacguggaacuaauccgcgguagaaaggaggaaaucgagguccucuggacuagcaacuccauuguggucuucugugggaccucuggcacauauggaacuggcucguggcccgauggggccgacauaaaucugaugccuaucuga

SEQ ID NO: 142709 - RNA, 1410 nt, Artificial Sequence; identical to SEQ ID NO: 142708
  derived and/or modified sequence opt3 from neuraminidase__InfluenzaA__AEG65640

SEQ ID NO: 142710 - RNA, 1410 nt, Artificial Sequence; identical to SEQ ID NO: 136151
  derived and/or modified sequence opt3 from neuraminidase__InfluenzaA__AEG65651

SEQ ID NO: 142711 - RNA, 1410 nt, Artificial Sequence; identical to SEQ ID NO: 136730
  derived and/or modified sequence opt3 from neuraminidase__InfluenzaA__AEG65662

SEQ ID NO: 142712 - RNA, 1410 nt, Artificial Sequence; identical to SEQ ID NO: 136730
  derived and/or modified sequence opt3 from neuraminidase__InfluenzaA__AEG65673

SEQ ID NO: 142713 - RNA, 1410 nt, Artificial Sequence; identical to SEQ ID NO: 136730
  derived and/or modified sequence opt3 from neuraminidase__InfluenzaA__AEG65684

SEQ ID NO: 142714 - RNA, 1410 nt, Artificial Sequence; identical to SEQ ID NO: 142687
  derived and/or modified sequence opt3 from neuraminidase__InfluenzaA__AEG65695

SEQ ID NO: 142715 - RNA, 1410 nt, Artificial Sequence
  derived and/or modified sequence opt3 from neuraminidase__InfluenzaA__AEG65706
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccaaacuccaagcugcagauuaauagacaggugauaguagacaggggcaaccggagcggguauucuggaaucuucucaguugagggcaaaaguuguauuaaucguugcuuuuacguggaacuaauccgcgguagaaaggaggaaaacgagguccucuggacuagcaauuccaucguggucuucugugggaccucuggcacauauggaacuggcucguggcccgauggggccgacauuaaccugaugccuauauga

SEQ ID NO: 142716 - RNA, 1410 nt, Artificial Sequence
  derived and/or modified sequence opt3 from neuraminidase__InfluenzaA__AEG65728
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccaaacuccaagcugcagauuaauagacaggugauaguagacaggggcaaccggagcggguauucuggaaucuucucaguugagggcaaaaguuguauuaaucguugcuuuuacguggaacuaauccgcgguagaaaggaggaaacugagguccucuggaccagcaacuccaucguggucuucugugggacaucuggcacuuauggaaccggcucguggcccgauggggccgagauuaaucugaugccuauauga

SEQ ID NO: 142717 - RNA, 1410 nt, Artificial Sequence
  derived and/or modified sequence opt3 from neuraminidase__InfluenzaA__AEG65739
augaaccccaaucagaagaucauuaccauaggcagcgugucccugacaaucucuacuauuugcuucuuuaugcaaaucgccauucucaucacgaccgucacacuucacuucaaacaguacgaguuuucaaguccuccaaacaaucagguuaugccgugugaacccacuauaaucgagagaaacauuaccgaaaucguguaucugacaaauaccacuauugagaaggaaaucugcccuaaauuggcugaguacaggaacuggagcaagccacagugugacauaacaggguucgcacccuuuuccaaagauaauucuauucgguuaucggccggaggugacaucuggguaacccgcgagccuuaugugucaugcgauccagacaaguguuaccaauucgcgcugggccaggggacgacucuaaacaauguccauagcaacgauaccgugcacgaccgaacacccuaucguacucuccugaugaaugaacuuggaguuccuuuucaucugggcaccaaacaggugugcauugcuuggaguuccucuagcugucacgaugguaaggccugguugcaugucugcgugacaggggacgauaagaacgcaaccgccuccuucaucuacaauggaagacucguagacucaaucguuaguuggagcaaagagauucugaggacgcaggaaucugagugugugugcauaaacggcacuuguacagucgugaugaccgauggcuccgcuucagggaaggcagacacuaaaauccuguuuauugaggaaggaaagaucgugcacacaagcacccucagugguucugcccaacacgucgaggaaugcuccugcuauccacgguacccgggcguucgcugugugugcagagauaauuggaaggggagcaacaggcccauaguagacauuaacaugaaagacuacucgaucgugucuuccuaugucuguucaggauuagugggcgauacgccucggaagaaugacaguagcuccucuagccauugccuggauccaaacaaugaggaaggugggcacggaguuaaaggcugggcuuucgacgauggcaacgacguguggauggggcgcaccaucucagagaaacuucgaaguggauacgagacauuuaaggucauugaagguugguccaaucccaacagcaaguugcagaucaauagacaggugauuguagauaggggcaaccggucuggguauucaggaauauucaguguugagggcaaaagcuguaucaaucguugcuuuuacguggaacugauucgcgguagaaaggaggaaacugagguccuauggaccuccaacucuaucguggucuucugugggacaucgggcacuuauggaaccggcagcuggccugacggggccgauaucaaucucaugccaauuuga

SEQ ID NO: 142718 - RNA, 1410 nt, Artificial Sequence; identical to SEQ ID NO: 138580
  derived and/or modified sequence opt3 from neuraminidase__InfluenzaA__AEG65750

SEQ ID NO: 142719 - RNA, 1410 nt, Artificial Sequence; identical to SEQ ID NO: 142716
  derived and/or modified sequence opt3 from neuraminidase__InfluenzaA__AEG65761

SEQ ID NO: 142720 - RNA, 1410 nt, Artificial Sequence
  derived and/or modified sequence opt3 from neuraminidase__InfluenzaA__AEG65772
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaaugugccccaaauuagcugaguacaggaauuggaguaagccucagugugacauuaccggguucgcaccauuuagcaaagauaacuccauccggcugucugccggaggugacauauggguaacgcgcgagcccuaugugucgugcgauccugacaaguguuaccaauucgcgcuaggccaggggacuacccucaauaacguccauucaaaugauacagugcacgaccgaacuccauaucguacccugcuuaugaacgaacugggaguucccuuucauuugggcacaaaacaggugugcauugcuuggagcaguuccucuugucacgaugguaaggccuggcuccaugucugcgugaccggggacgauaagaaugcaacggccagcuucaucuacaacggaagacugguagacuccauuguuucauggaguaaaaagauccugaggacucaggagagcgaaugugugugcaucaauggcacauguaccgucgugaugacugauggcucugcuuccgggaaagcagacacaaagauucucuuuauagaggagggaaagaucauucacaccucaacguuaagcgguagugcccaacacguggaagagugcucuugcuauccucgguacccaggcguccgcuguguuugcagagauaacuggaaaggguccaacaggccgaucguggacauaaauauuaaggacuacagcaucguaucgucuuauguguguuccggacuggucggcgauacaccccggaaaaacgacucaaguagcuccucucauugccuugauccuaauaacgaagagggugggcacggagugaagggcugggcuuucgacgauggcaaugacguuuggauggggcgcaccaucagcgaaaaauugcgaucaggauacgagacuuuuaaggugauugaggguuggaguaaaccaaacuccaagcugcagaucaauagacaggucauuguggauaggggcaaccggagcggguauucuggaauauucucaguagaaggcaagaguuguaucaaucguugcuuuuacguugagcuaauucgcgguagaaaagaagagaccgaagugcucuggacaagcaacuccaucgucguguucugugggacuucuggcaccuauggaacaggcucguggcccgacggggccgauaucaaucugaugccuauuuga

SEQ ID NO: 142721 - RNA, 1410 nt, Artificial Sequence; identical to SEQ ID NO: 141534
  derived and/or modified sequence opt3 from neuraminidase__InfluenzaA__AEG65783

SEQ ID NO: 142722 - RNA, 1410 nt, Artificial Sequence
  derived and/or modified sequence opt3 from neuraminidase__InfluenzaA__AEG65794
augaaccccaaucagaagaucauuaccauaggcagcgugucccugacaaucucuacuauuugcuucuuuaugcaaaucgccauucucaucacgaccauaacacuucacuucaaacaguacgaguuuaacucaccuccaaauaaccaggucaugcugugugaaccgacuaucauugagagaaauaucaccgaaauuguuuauuugacaaacaccacuaucgagaaggaaauaugccccaaauuagcugaguacaggaauuggaguaagccucagugugacauuacaggguucgcaccauuuagcaaagauaacuccauccggcugucugccggaggugacauuugggugacccgcgagcccuauguaucgugcgauccugacaaguguuaccaauucgcgcuaggccaggggacgacucucaauaacgugcauucaaauaacaccguccgagaucguacaccauauagaacucugcuuaugaaugaacugggagugcccuuucacuugggcaccaagcagguuugcaucgcuuggagcaguuccucuugucaugacgguaaagccuggcuccacgugugcaucacaggggaugacaagaacgcaaccgccagcuucauuuacaauggaaggcuggucgauuccgugguaucauggaguaaagagauacugcggacgcaggaaagcgaguguguuugcaucaacggcacuuguacaguggucaugaccgacggcucugcuuccgggaaggcagauacuaaaauucucuuuaucgaggaaggaaagauagugcauacaucaaccuuaagcgguagugcccaacacguggaggaaugcucuugcuauccucgcuacccaggcgucagauguguuugcagggacaacuggaagggguccaaucggccgauuguggauaucaacaucaaagaccacagcauuguaucgucuuacguguguuccggacuggucggcgacacgccccgcaagaaugauucaaguagcuccucucauugccuugacccuaacaaugaggaaggugggcacggagugaaaggcugggcuuucgaugacggcaacgauguuuggauggggcgaaccaucaaugagacaagcagauugggauaugagacuuuuaaggugauugaagguuggucaaacccaaaaaguaagcugcagauaaauaggcaggucaucguggacaaaggcaaccgguccggguacagcggaauuuucucuguagagggcaagucauguaucaaucguugcuuuuauguugaacuaauccgcgguagaaaggaggaaaccgaggugcucuggacaaguaacagcauugucguguucugugggacuuccggcaccuacggaacaggcucuuggcccgauggggccgaccugaaucuuaugccuauauga

SEQ ID NO: 142723 - RNA, 1410 nt, Artificial Sequence; identical to SEQ ID NO: 141534
  derived and/or modified sequence opt3 from neuraminidase__InfluenzaA__AEG65805

SEQ ID NO: 142724 - RNA, 1410 nt, Artificial Sequence
  derived and/or modified sequence opt3 from neuraminidase__InfluenzaA__AEG65816
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccggggaggcagauacuaagauccucuuuauugaagagggaaaaaucgugcauacaucaaccuuaagcgguagugcccaacacgucgaagagugcucuugcuauccucgcuacccaggcguuagaugugugugcagggacaacuggaagggguccaaucggccgauaguagauauuaacaucaaggaccacagcaucgugucgucuuacgucuguuccggacuggugggcgacacgccccgcaaaaaugauucaaguagcuccucucauugccuugacccuaacaaugaagagggugggcacggaguuaagggcugggcuuucgaugacggcaacgauguguggauggggcgaaccauuaaugagacaagcagauugggauaugaaacuuuuaaagucaucgaggguuggucaaacccaaagaguaaacugcagauuaauaggcaagugauaguagaccggggcaaccguuccggguacagcggaaucuucucuguugaaggcaagucauguauuaaucgcugcuuuuauguggagcuaaucagagguaggaaagaagagaccgagguccucuggacaaguaacagcaucguggucuucugugggacuuccggcaccuacggaacaggcucuuggcccgauggggccgaccugaaucuuaugccuauuuga

SEQ ID NO: 142725 - RNA, 1410 nt, Artificial Sequence
  derived and/or modified sequence opt3 from neuraminidase__InfluenzaA__AEG79808
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcaagggguucgagaugauaugggauccaaauggcuggaccggaacggacaacaauuuuuccaucaaacaagacauugugggcaucaacgaauggucuggguacucggggagcuucguccagcaucccgagcugacuggucuggauuguauucgaccuugcuucuggguggaacucaucagaggcaggccaaaggagaauacaauauggaccuccgggucaaguaucucuuuuuguggaguuaacagcgacacugugggcugguccuggcccgauggugcagaguuaccguucacaauugacaaauga

SEQ ID NO: 142726 - RNA, 1410 nt, Artificial Sequence; identical to SEQ ID NO: 142725
  derived and/or modified sequence opt3 from neuraminidase__InfluenzaA__AEG79814

SEQ ID NO: 142727 - RNA, 1410 nt, Artificial Sequence
  derived and/or modified sequence opt3 from neuraminidase__InfluenzaA__AEG79826
augaaccccaaucagaagaucauuaccauaagcuccgugugcaugacaaucggcauggccaaccugauucuccaaaucgggaauauuaucucuauauggaucucacacaguauucagcuuggaaaccagaaucagaucgagacuuguaaccaaagcgucauuacguacgaaaauaacaccuggguuaaucagacauaugugaacaucuccaauacuaacuucgcugcaggucagucuguagugucggucaaacuggccggcaauagcucauugugcccugugagugggugggcgauauacuccaaggacaacucuauuagaaucggaagcaaaggcgauguuuuugugauuagggagccauucaucuccuguucaccguuagaaugccggaccuuuuuccugacacagggugcucuacucaaugacaagcauaguaacgggaccaucaaagaucgcagccccuaucgaacucugaugucuuguccuauuggagaggucccaucccccuacaacucacguuuugaaagcguggccuggagugcaucugccugccacgacggcauaaauuggcuuacaaucggcauuuccgggccugauaacggagcuguagcaguucugaaguauaaugguaucauaaccgacacgauuaagagcuggagaaacaauaucuugaggacucaagagucggagugugccugcgugaacggcucuuguuucaccaucaugacagaugggccauccgacggacaggcuucauacaaaauuuuucggaucgaaaagggcaaaauugucaagaguguggagaugaaugcccccaacuaucauuacgaagagugcagcuguuacccugauuccucugagauaacuugcgugugccgcgacaauuggcacgguagcaacagaccaugggucucauucaaucagaaccucgaauaucagaucggguacauuuguaguggaaucuuuggcgauaauccgaggcccaacgacaaaaccggcuccugcgggccuguuagcucuaauggagcgaacggugugaagggcuucucauuuaaguaugggaacggaguauggaucggccggacaaaaaguauuagcucccgcaaggguuucgagaugauaugggauccaaauggguggaccggcacggacaacaauuuuucuaucaaacaagacauugugggaaucaacgaauggucgggcuacagcggguccuucguccagcaucccgagcugacuggacuggauuguauucgaccuugcuucuggguggaacucaucagagguaggccaaaggagaauacaauauggaccucaggcaguucuaucagcuuuugugggguuaacuccgacacuaugggauggucauggcccgauggcgcagaguuaccguucacaauugacaaauga

SEQ ID NO: 142728 - RNA, 1410 nt, Artificial Sequence
  derived and/or modified sequence opt3 from neuraminidase__InfluenzaA__AEG79830
augaaccccaaucagaagaucauuaccauaagcuccgugugcaugacaaucggcauggccaaccugauucuccaaaucgggaauauuaucucuauauggaucucacacaguauucagcuuggaaaccagaaucagaucgagacuuguaaccaaagcgucauuacguacgaaaauaacaccuggguuaaucagacauaugugaacaucuccaauacuaacuucgcugcaggucagucuguagugucggucaaacuggccggcaauagcagcuugugcccugugagugggugggcgauauacuccaaggacaacucuauuagaaucggaagcaaaggcgauguuuuugugauuagggagccauucaucuccuguucaccguuagaaugccggaccuuuuuccugacacagggugcucuacucaaugacaagcauaguaacgggaccaucaaagaucgcagccccuaucgaacucugaugucuuguccuauuggagaggucccaucccccuacaacucacguuuugaaagcguggccuggagugcaucugccugccacgacggcauaaauuggcuuacaaucggcauuuccgggccugauaacggagcuguagcaguucugaaguauaaugguaucauaaccgacacgauuaagagcuggagaaacaauaucuugaggacucaagagucggagugugccugcgugaacggcucuuguuucaccgucaugacagaugggccauccgacggacaggcuucauacaaaaucuuucggauugaaaagggcaaaaucgugaagaguguggagaugaaugcccccaacuaucauuacgaagagugcagcuguuacccugauuccucugagauuacuugcgucugccgcgacaauuggcacgguagcaacagaccauggguuucauucaaucagaaccucgaauaucagauaggguacaucuguaguggaauuuuuggcgauaauccgaggcccaacgacaaaaccggcuccugcgggccugugagcucuaauggagcgaacgguguaaagggcuucucauuuaaguaugggaacggaguguggaucggccggacaaaaaguaucagcucccgcaaggguuucgagaugauuugggauccaaauggguggaccggcacggacaacaauuuuucuauaaaacaagacaucgucggaauuaacgaauggucgggcuacagcggguccuucgugcagcaucccgagcugacuggacuggauuguauccgaccuugcuucuggguugaacucauuagagguaggccaaaggagaauacaaucuggaccucaggcaguucuauaucauuuuguggggugaacuccgacacugucggauggucauggcccgauggcgcagaguuaccguucacaaucgacaaauga

SEQ ID NO: 142729 - RNA, 1410 nt, Artificial Sequence; identical to SEQ ID NO: 142273
  derived and/or modified sequence opt3 from neuraminidase__InfluenzaA__AEG79836

SEQ ID NO: 142730 - RNA, 1410 nt, Artificial Sequence
  derived and/or modified sequence opt3 from neuraminidase__InfluenzaA__AEH59356
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacaggggacccuacucaaugacaagcauucaaacggaacuaucaaagaucgcagucccuaucgaacacugaugagcuguccuauuggcgaggucccaucucccuacaacucccguuuugaaucaguggcuuggagcgccagugcaugccacgacggcauaaauuggcuuaccaucgggauuucuggaccugauaacggugccguagcuguucugaaguauaauggcaucauaacggacacuauuaaguccuggagaaacaauaucuugaggacccaagagagcgagugugcaugcgugaacgggucguguuucacaaucaugacugauggaccaucugacggccaggccuccuacaaaauuuuucggaucgaaaaggguaaaauugucaagucaguggagaugaaugcucccaacuauuacuacgaagagugcaguuguuauccugauagcuccgagauaaccugcgugugccgcgacaauuggcaugggucuaacagaccaugggucagcuucaaucagaaccucgaauaccagaucggauauauuuguucaggcaucuuuggcgauaauccgaggcccaacgacaaaacagggaguugcggaccuguuuccagcaauggugccaacggcgugaagggguucucuuuuaaguacggaaacggcguauggaucggucggaccaaaucaauuaguagccgcaagggguucgagaugauaugggauccaaauggcuggacgggaacugacaacaauuuuuccaucaaacaagacauugugggcaucaacgaauggucuggguauucggggagcuucguccagcaccccgagcugacaggucuggauuguauucgaccuugcuucuggguggaacucaucagaggcaggccaaaggagaauaccguuuggacuuccgggucaaguauaucuuuuuguggagugaacagcgacacagucggcugguccuggcccgauggugcggaguuaccguucaccaucgacaaauga

SEQ ID NO: 142731 - RNA, 1410 nt, Artificial Sequence; identical to SEQ ID NO: 142725
  derived and/or modified sequence opt3 from neuraminidase__InfluenzaA__AEH59360

SEQ ID NO: 142732 - RNA, 1410 nt, Artificial Sequence
  derived and/or modified sequence opt3 from neuraminidase__InfluenzaA__AEH59364
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaaaugacggccaggcuucuuacaaaaucuuucggauugaaaaggguaaaaucgugaaguccguggagaugaacgcccccaauuaucauuacgaagagugcucauguuacccugauaguagcgagauuacuugcgucugccgcgacaacuggcacggggcgaauagaccauggguuuccuucaaccagaaucucgaauaucagauaggauacaucuguucuggcauuuuuggcgauaacccgaggcccaaugacaaaaccgggagcugcggaccugugucaaguaacggugcaaacggcguaaagggguucuccuuuaaguauggaaauggcguguggaucggucggacaaaaagcaucucuucacgcaacggguucgagaugauuugggauccaaauggcuggaccggaacggacaacaauuuuaguauaaagcaagacaucgucggcauuaacgaauggagcggguacuccggaucuuucgugcagcaucccgagcugacuggucuggauuguauccgaccuugcuucuggguugaacucauuagaggcaggccaaaagagaauacaaucuggaccucggggagcuccauaucauuuuguggagugaacagugacacugucggcuggucuuggcccgauggugccgaguuaccguucacaaucgacaaguga

SEQ ID NO: 142733 - RNA, 1410 nt, Artificial Sequence
  derived and/or modified sequence opt3 from neuraminidase__InfluenzaA__AEH59366
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcggcgucccaucucccuacaacucccguuuugagucaguggccuggagcgcaagugccugccacgacgggauaaauuggcuuacaaucggaauuucugguccugauaacggcgcuguagcaguucugaaguauaaugggaucauaaccgacacgauuaaguccuggagaaacaauaucuugaggacucaagaaagcgagugugccugcgugaacggaucguguuucaccaucaugacagauggcccaucugacggucaggcuuccuacaaaauuuuucggaucgagaaggggaaaauugucaagucaguggaaaugaaugcccccaacuaucauuacgaggaaugcaguuguuacccugauagcuccgagauaacuugcgugugccgcgacaauuggcacggaucuaacagaccaugggucagcuucaaucagaaccucgaguaucagaucggcuacauuuguucaggcaucuuuggggauaauccgaggcccaacgacaaaaccggaaguugcgguccuguuuccagcaauggcgcgaacggggugaagggauucucuuuuaaguauggcaacgguguauggaucgggcggacaaaaucaauuaguagccgcaagggcuucgaaaugauaugggauccaaauggauggaccggcacggacaacaauuuuuccaucaaacaagacauuguggggaucaacgaguggucuggauacucggguagcuucguccagcaucccgaacugacuggccuggauuguauucgaccuugcuucuggguggagcucaucagagggaggccaaaggaaaauacaauauggaccuccggaucaaguaucucuuuuuguggcguuaacagcgacacuguggguugguccuggcccgauggggcagaguuaccguucacaauugacaaauga

SEQ ID NO: 142734 - RNA, 1410 nt, Artificial Sequence; identical to SEQ ID NO: 142725
  derived and/or modified sequence opt3 from neuraminidase__InfluenzaA__AEH59368

SEQ ID NO: 142735 - RNA, 1410 nt, Artificial Sequence; identical to SEQ ID NO: 142273
  derived and/or modified sequence opt3 from neuraminidase__InfluenzaA__AEH59370

SEQ ID NO: 142736 - RNA, 1410 nt, Artificial Sequence; identical to SEQ ID NO: 142732
  derived and/or modified sequence opt3 from neuraminidase__InfluenzaA__AEH59372

SEQ ID NO: 142737 - RNA, 1410 nt, Artificial Sequence; identical to SEQ ID NO: 142732
  derived and/or modified sequence opt3 from neuraminidase__InfluenzaA__AEH59376

SEQ ID NO: 142738 - RNA, 1410 nt, Artificial Sequence; identical to SEQ ID NO: 142273
  derived and/or modified sequence opt3 from neuraminidase__InfluenzaA__AEH59378

SEQ ID NO: 142739 - RNA, 1410 nt, Artificial Sequence; identical to SEQ ID NO: 142732
  derived and/or modified sequence opt3 from neuraminidase__InfluenzaA__AEH59382

SEQ ID NO: 142740 - RNA, 1410 nt, Artificial Sequence
  derived and/or modified sequence opt3 from neuraminidase__InfluenzaA__AEH59384
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaagggucgcauugucaaaaguguggagaugaacgcccccaauuaucauuacgaagagugcagcuguuacccugauuccucugagauaacuugcgugugcagagacaacuggcacgggagcaauaggccaugggucucauucaaccagaaucucgaauaucagaucggauacauuuguaguggcaucuuuggcgauaacccgcggcccaaugacaagaccggguccugcggaccuguuagcucuaacggugcgaauggcgugaaaggguucucauuuaaguauggaaacggcguauggaucggucgcacaaagaguauuagcucccgaaaaggguucgagaugauaugggauccaaacggcuggaccggaacggacaauaacuuuucuaucaagcaagacauugugggcaucaaugaauggucgggguacagcggauccuucguccagcaucccgagcugacuggucuggauuguauuagaccuugcuucuggguggaacucaucaggggccggccaaaagagaacacaauauggaccucagggaguucuaucagcuuuuguggaguuaauuccgacacugugggcuggucauggcccgauggugcagaguuaccguucacaauugacaaguga

SEQ ID NO: 142741 - RNA, 1410 nt, Artificial Sequence
  derived and/or modified sequence opt3 from neuraminidase__InfluenzaA__AEH59386
augaaccccaaucagaagaucauuaccauaggcagcgugugcaugacaaucgggauggccaaccugauucuccaaaucggaaauauuaucuccauauggaucucucacucaauucagaucgguaaccagaaucagauugagacuuguaaccaaagugucaucacguacgaaaauaacaccuggguuaaucagacauaugugaacauaagcaauacuaacuucgcugcaggccaguccguagugucugucaaacuugccggaaauucgucacugugcccugugagcggaugggcgauuuacaguaaggacaacuccaucagaauuggcucuaaaggugauguuuuugugaucagggagccauucaucagcuguuccccguuggaaugccggaccuuuuucuuaacacagggggcucugcuaaaugacaagcauucaaacggaaccauuaaagaucgcagucccuaucgaacucucaugagcuguccuauaggcgaggucccaucucccuacaacucccguuuugaaucaguggccuggagcgcaagugccugccacgacggcaucaauuggcugacaauugggaucucuggaccugauaacggugcuguagcaguucuuaaguauaauggcauaauuaccgacacgaucaaguccuggagaaacaauauccugaggacucaagagagcgagugugccugcgugaacgggucguguuucaccauuaugacagauggaccaucugacggccaggcuuccuacaaaaucuuucggauugaaaaggguaaaauagucaagucaguggagaugaaugcccccaacuaucauuacgaagagugcaguuguuacccugauagcuccgagaucacuugcgugugccgcgacaauuggcacgggucuaacagaccaugggucagcuucaaucagaacuuggaauaucagauuggauacaucuguucaggcaucuuuggcgauaauccgaggcccaacgacaaaaccgggaguugcggaccuguuuccagcaauggugcgaacggcgugaagggguucucuuuuaaguauggaaacggcguauggauuggucggacaaaaucaauaaguagccgcaagggguucgagaugaucugggauccaaauggcuggaccggaacggacaacaauuuuuccauuaaacaagacaucgugggcauuaacgaauggucuggguacucggggagcuucguccagcaucccgagcucacuggucuggauuguauccgaccuugcuucuggguggaacugauaagaggcaggccaaaggagaauacaaucuggaccuccgggucaaguauuucuuuuuguggaguuaacagcgacacugugggcugguccuggcccgauggugcagagcucccguucacaaucgacaaauga

SEQ ID NO: 142742 - RNA, 1410 nt, Artificial Sequence; identical to SEQ ID NO: 142732
  derived and/or modified sequence opt3 from neuraminidase__InfluenzaA__AEH59388

SEQ ID NO: 142743 - RNA, 1410 nt, Artificial Sequence
  derived and/or modified sequence opt3 from neuraminidase__InfluenzaA__AEH59390
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucggucggacaaaaaguauuagcucccgcaagggguucgagaugauaugggauccaaacggcuggaccggaacggacaauaacuuuucuaucaaacaagacauugugggccugaaugaauggucgggguacagcggauccuucguccagcaucccgagcugacuggucucgauuguauccgaccuugcuucuggguggaauuaauuagaggccugccaaaggagaacacaaucuggaccucagggaguucuauaucauuuuguggaguuaauuccgacacugugggcuggucauggcccgauggugcagagcuuccguucacaaucgacaaauga

SEQ ID NO: 142744 - RNA, 1410 nt, Artificial Sequence; identical to SEQ ID NO: 142732
  derived and/or modified sequence opt3 from neuraminidase__InfluenzaA__AEH59392

SEQ ID NO: 142745 - RNA, 1410 nt, Artificial Sequence; identical to SEQ ID NO: 142732
  derived and/or modified sequence opt3 from neuraminidase__InfluenzaA__AEH59396

SEQ ID NO: 142746 - RNA, 1410 nt, Artificial Sequence
  derived and/or modified sequence opt3 from neuraminidase__InfluenzaA__AEH59398
augaaccccaaucagaagaucauuaccauaggcagcgugugcaugacaaucggggucgccaaccugauucuccaaaucggaaauauuaucuccauauggaucucucacucaauucagcuugguaaccagaaucagaucgagacuuguaaccaaaguguuauuacguacgaaaauaacaccugggugaaucagacauauguaaacaucagcaauacuaacuucgcugcaggccaguccguggucucugugaaacuggccggaaauucgucauugugcccuguuagcggaugggcgauauacaguaaggacaacuccauuagaaucggcucuaaaggugauguguuugucauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggugccaucucccuacaacucccguuuugaaucaguagccuggagcgcaagugccugccacgacggcauaaauuggcuuacaaucgggauuucuggaccugauaacggugcuguugcagugcugaaguauaauggcaucauaaccgacacgauuaaguccuggagaaacuacaucuugaggacucaagagagcgagugugccugcgucaaugggucguguuucaccaucaugacagauggaccaucugacggccaggcuuccuauaaaauuuuucggaucgaaaaggguaaaguggugaagucagucgagaugaacgcccccaauuaccauuacgaagagugcaguuguuauccugauagcuccgagauuacuugcguuugccgcgacaacuggcacgggucuaauagaccaugggugagcuucaaccagaaucucgaauaccagauaggauauaucuguucaggcauuuuuggcgauaacccgaggcccaaugacaaaaccgggaguugcggaccuguauccagcaacggugcgaauggcgugaagggguucucuuuuaaguacggaaacggcgucuggaucggucggacaaaaucaaucaguagccgcaagggguucgagaugauuugggauccaaacggcuggaccggaacggacaauaacuuuuccauaaaacaagacaucauuggcaucaaugaauggucuggguauucggggagcuucgugcagcaucccgagcugacuggucuggauuguauucgaccuugcuucuggguugaacucaucagaggcaggccaaaggagaacacaauauggaccuccgggucaaguaucucuuuuuguggagugaauagcgacacugucggcugguccuggcccgauggugcagaguuaccguucacaauugacaaauga

SEQ ID NO: 142747 - RNA, 1410 nt, Artificial Sequence
  derived and/or modified sequence opt3 from neuraminidase__InfluenzaA__AEH59400
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacucaucuuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccgucaugacagauggaccaaacgacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacggggcgaacagaccauggguuucuuucaaucagaaccucgaauaucagauaggauacaucuguagcggcauuuuuggcgauaauccgaggcccaacgacaaaaccgggucaugcggaccugugaguuccaauggugcaaacggcguaaagggguucagcuuuaaguauggaaacggcguguggaucggucggacaaaaucuaucucaagucgcaauggguucgagaugauuugggauccaaacggcuggaccggaacggacaauaacuuuagcauaaagcaagacaucgucggcauuaaugaaugguccggguacucuggaucguucgugcagcaucccgagcugacuggucuggauuguauccgaccuugcuucuggguugaacucauuagaggcaggccaaaagagaacacaaucuggaccagcggguccucaauaaguuuuuguggagugaauagcgacacugucggcuggagcuggcccgauggugccgaguuaccguucacaaucgacaaguga

SEQ ID NO: 142748 - RNA, 1410 nt, Artificial Sequence
  derived and/or modified sequence opt3 from neuraminidase__InfluenzaA__AEH59402
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaaaugacggccaggcuucuuacaaaaucuuucggauugaaaaggguaaaaucgugaaguccguggagaugaacgcccccaauuaucauuacgaagagugcucauguuacccugauaguagcgagauuacuugcgucugccgcgacaacuggcacggggcgaauagaccauggguuuccuucaaccagaaucucgaauaucagauaggauacaucuguucuggcauuuuuggcgauaacccgaggcccaaugacaaaaccgggagcugcggaccugugucaaguaacggugcaaacggcguaaagggguucuccuuuaaguauggaaauggcguguggaucggucggacaaaaagcaucucuucacgcaacggguucgagaugauuugggauccaaauggcuggaccgaaacggacaacaauuuuaguauaaagcaagacaucgucggaauuaacgaguggagcggcuacuccgggucuuucgugcagcaucccgaacugacuggacuggauuguauccgaccuugcuucuggguugagcucauuagagguaggccaaaagagaauacaaucuggaccucgggcagcuccauaucauuuuguggggugaacagugacacugucggauggucuuggcccgauggcgccgaauuaccguucacaaucgacaaguga

SEQ ID NO: 142749 - RNA, 1410 nt, Artificial Sequence
  derived and/or modified sequence opt3 from neuraminidase__InfluenzaA__AEH59404
augaaccccaaucagaagaucauuaccauaggcagcgccugcaugacaaucgggauggcuaaccugauucuccaaaucggaaauauuaucuccauauggaucucucacucaauucagcuugguaaccagagucagaucgagacuuguaaucaaagcgugauuacguacgaaaacaauaccugggucaaccagacauauguuaauaucuccaacacuaauuucgcagccggccagccugugguaucugugaaacuggcggggaacucgucauugugcccagucagcggaugggcuauauacaguaaggacaauuccauuagaaucggcucuaaaggugauguguuuguuauuagggagccguucaucagcuguucccccuuagaaugccggaccuuuuuccugacacagggggcccuacucaacgacaagcauucaaauggaaccaucaaagaucgcaguccuuaucgaacucugaugagcuguccaauuggcgaggugcccucuccuuacaacucccguuuugaaucagucgcauggagcgccagugcuugccacgacggcauaaacuggcuuacaaucgggauuucuggaccagauaauggugcaguggccguacugaaguauaacggcaucauaaccgacacgauuaaguccuggagaaauaacaucuugaggacucaagagagcgagugugcuugcguuaaugggucguguuucaccaucaugacagauggacccucugacggccaggccuccuacaaaauuuuucggaucgaaaaggguaaaauugugaagucagucgagaugaacgcgccuaauuaucauuacgaagagugcaguuguuacccagauagcuccgagauaacuugcgugugccgcgacaacuggcacgggucuaauagaccgugggugagcuucaaccagaaucucgaauaucagaucggauacauuuguucaggcaucuuuggcgauaaccccaggccuaaugacaaaaccgggaguugcggaccagucuccagcaacggugcaaauggcguuaagggguucucuuuuaaguauggaaacggcguguggaucggucggacaaaaucaauuaguagccgcaagggguucgagaugauaugggaucccaacggcuggaccggaacggacaauaacuuuuccaucaaacaagacauuguaggcaucaaugaauggucuggguacucggguagcuucgugcagcauccugagcugacuggacuggauuguauucgaccaugcuucugggucgaacucaucagaggcaggcccaaggagaacacaauauggaccuccgggucaaguaucucuuuuuguggagugaauagcgacacuguuggcugguccuggccggauggugccgaguuaccuuucacaauugacaaauga

SEQ ID NO: 142750 - RNA, 1410 nt, Artificial Sequence
  derived and/or modified sequence opt3 from neuraminidase__InfluenzaA__AEH59406
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccacuuaucauuacgaagagugcagcuguuacccugauuccucugagauaaccugcgugugccgcgacaauuggcacgggagcaacagaccaugggucucauucaaucagaaccucgaauaucagaucggauacauuuguaguggcaucuuuggcgauaauccgaggcccaacgacaaaacaggguccugcggaccuguuagcuucaauggugcgaacggcgugaagggguuuucuuucaaguauggaaauggcguauggaucggucggaccaaaucaauuaguagccgcaagggguuugagaugauaugggauccaaacggcuggacgggaacugacaacaauuucuccaucaaacaagacauugugggcaucgaugaauggucuggguacucgggaucauucguccagcaucccgagcugacaggucuggacuguauucgaccuugcuuuuggguggaacucaucagaggcaggccaaaggagaacaccauauggacuuccgggucaaguaucucuuucuguggaguuaauagcgauacagugggcugguccuggcccgacggugcagaguuaccguuuaccauugauaaauga

SEQ ID NO: 142751 - RNA, 1410 nt, Artificial Sequence; identical to SEQ ID NO: 142273
  derived and/or modified sequence opt3 from neuraminidase__InfluenzaA__AEH59408

SEQ ID NO: 142752 - RNA, 1410 nt, Artificial Sequence
  derived and/or modified sequence opt3 from neuraminidase__InfluenzaA__AEH59412
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuagaagcuggaggaauaacaucuugcggacucaagagucggagugugccugcgugaaugggucuuguuucaccaucaugacagauggaccauccgacggccaggcuucauacaagauuuuucgcaucgaaaaagguaagauuauaaaaagugucgagaugaacgcccccaauuaucauuacgaagagugcagcuguuacccugauuccucugagaucacuugcgugugcagagacaacuggcacgggagcaauaggccaugggugucauucaaccagaaucucgaauaucagauuggauacaucuguaguggcaucuuuggcgauaacccgcggcccaaugacaagaccggguccugcggaccuguccugagcaacggugcgaauggcguuaaaggguucucuuuuaaguauggaaacggcguguggauuggucgcacaaagucaauaaguagccgaaaaggguucgagaugaucugggauccaaacggcuggaccggaacggacaauaacuuuuccauuaagcaagacaucguaggcauuaaugaauggucuggguacucgggaucauucgugcagcaucccgagcugacuggucucgauuguaucagaccuugcuucugggucgaauuaauaaggggccggccaaaagagaacacaaucuggaccuccgggucaaguauuucuuuuuguggagugaauagcgacacuguuggcugguccuggcccgauggugcagagcugccguucacaaucgacaaguga

SEQ ID NO: 142753 - RNA, 1410 nt, Artificial Sequence; identical to SEQ ID NO: 142725
  derived and/or modified sequence opt3 from neuraminidase__InfluenzaA__AEH59416

SEQ ID NO: 142754 - RNA, 1410 nt, Artificial Sequence; identical to SEQ ID NO: 138754
  derived and/or modified sequence opt3 from neuraminidase__InfluenzaA__AEH59584

SEQ ID NO: 142755 - RNA, 1410 nt, Artificial Sequence; identical to SEQ ID NO: 138754
  derived and/or modified sequence opt3 from neuraminidase__InfluenzaA__AEH59586

SEQ ID NO: 142756 - RNA, 1410 nt, Artificial Sequence; identical to SEQ ID NO: 138754
  derived and/or modified sequence opt3 from neuraminidase__InfluenzaA__AEH59588

SEQ ID NO: 142757 - RNA, 1410 nt, Artificial Sequence; identical to SEQ ID NO: 138754
  derived and/or modified sequence opt3 from neuraminidase__InfluenzaA__AEH59592

SEQ ID NO: 142758 - RNA, 1410 nt, Artificial Sequence; identical to SEQ ID NO: 138754
  derived and/or modified sequence opt3 from neuraminidase__InfluenzaA__AEH59594

SEQ ID NO: 142759 - RNA, 1410 nt, Artificial Sequence; identical to SEQ ID NO: 138754
  derived and/or modified sequence opt3 from neuraminidase__InfluenzaA__AEH59596

SEQ ID NO: 142760 - RNA, 1410 nt, Artificial Sequence; identical to SEQ ID NO: 138754
  derived and/or modified sequence opt3 from neuraminidase__InfluenzaA__AEH59598

SEQ ID NO: 142761 - RNA, 1410 nt, Artificial Sequence; identical to SEQ ID NO: 138754
  derived and/or modified sequence opt3 from neuraminidase__InfluenzaA__AEH59600

SEQ ID NO: 142762 - RNA, 1410 nt, Artificial Sequence
  derived and/or modified sequence opt3 from neuraminidase__InfluenzaA__AEH59602
augaaccccaaucagaagaucauuaccauaggcagcgugugcaugacaaucgggauggccaaccugauucuccaaaucggaaauauuaucuccauauggaucucucacucaauucagcuugguagucagaaccagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccgucaugacagauggaccauccgacggccaggcuucauacaaaaucuuucggauugaaaaggguaaaaucgugaagaguguggagaugaacgcccccaauuaucauuacgaagagugcagcuguuacccugauuccucugagauuacuugcgucugccgcgacaacuggcacgggagcaauagaccauggguuucauucaaccagaaucucgaauaucagauaggauacaucuguaguggcauuuuuggcgauaacccgaggcccaaugacaaaaccggguccugcggaccugugagcucuaacggugcgaauggcguaaagggguucucauuuaaguauggaaacggcguguggaucggucggacaaaaaguaucagcucccgcaacggguucgagaugauuugggauccaaauggcuggaccggaacggacaacaauuuuucuauaaagcaagacaucgucggcauuaacgaauggucgggguacagcggauccuucgugcagcaucccgagcugacuggucuggauuguauccgaccuugcuucuggguugaacucauuagaggcaggccaaaagagaauacaaucuggaccucagggaguucuauaucauuuuguggagugaacuccgacacugucggcuggucauggcccgauggugcagaguuaccguucacaaucgacaaguga

SEQ ID NO: 142763 - RNA, 1410 nt, Artificial Sequence; identical to SEQ ID NO: 138754
  derived and/or modified sequence opt3 from neuraminidase__InfluenzaA__AEH59606

SEQ ID NO: 142764 - RNA, 1410 nt, Artificial Sequence; identical to SEQ ID NO: 138754
  derived and/or modified sequence opt3 from neuraminidase__InfluenzaA__AEH59616

SEQ ID NO: 142765 - RNA, 1410 nt, Artificial Sequence; identical to SEQ ID NO: 138754
  derived and/or modified sequence opt3 from neuraminidase__InfluenzaA__AEH59626

SEQ ID NO: 142766 - RNA, 1413 nt, Artificial Sequence; identical to SEQ ID NO: 139477
  derived and/or modified sequence opt3 from neuraminidase__InfluenzaA__AEH77262

SEQ ID NO: 142767 - RNA, 1410 nt, Artificial Sequence
  derived and/or modified sequence opt3 from neuraminidase__InfluenzaA__AEH77273
augaaccccaaucagaagaucauuaccauaggcagcgugugcaugacaaucgggauggccaaccugauucuccaaaucggaaauauuacuuccaucuggauaucucacucaauccagcuugguaaccagaaucagauugagacguguaaccaaagugucaucaccuacgaaaauaacacauggguuaaucagacuuaugugaacauuagcaauaccaacuucgcugcaggccaguccguagugucugucaaacuggccggaaauucgucauugugcccugugagcggaugggcgaucuacaguaaggacaacuccauaagaauuggcucuaaaggugauguuuuugugaucagggagccauucauuagcuguuccccguuagaaugccggacauuuuuccugacccagggggcucuacucaaugacaagcauucaaacggaacuaucaaagaucgcagucccuaucgaacacugaugagcuguccuaucggcgaggucccaucucccuacaacucccguuuugaaucaguggccuggagcgcaagugccugccacgacggcauuaauuggcuuaccauagggaucucuggaccugauaacggugcuguagcaguucugaaguauaauggcauuaucacggacacuauaaaguccuggagaaacaauauuuugaggacccaagagagcgagugugccugcgugaacgggucguguuucacagucaugacugauggaccaucugacggccaggcuuccuacaaaaucuuucggaucgaaaaggguaaaauugugaagucaguggagaugaaugcccccaacuaucauuacgaagagugcaguuguuacccugauagcuccgagauuaccugcgucugccgcgacaauuggcacgggucuaacagaccauggguuagcuucaaucagaaccucgaauaucagaucggauacauauguucaggcaucuuuggcgauaauccgaggcccaacgacaaaacagggaguugcggaccuguguccagcaauggugcgaacggcguaaagggguucucuuuuaaguauggaaacggcguguggauuggucggaccaaaucaaucaguagccgcaauggguucgagaugaucugggauccaaacggcuggacgggaacugacaauaacuuuuccauuaagcaagacauagucggcaucaaugaauggucuggguacucggggagcuucgugcagcaucccgagcugacaggucuggauuguauucgaccuugcuucuggguugaacucaucagaggcaggccaaaagagaacaccauuuggacuuccgggucaaguaucucuuuuuguggagugaauagcgacacagucggcugguccuggcccgauggugcagaguuaccguucaccauagacaaguga

SEQ ID NO: 142768 - RNA, 1410 nt, Artificial Sequence
  derived and/or modified sequence opt3 from neuraminidase__InfluenzaA__AEH77282
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcguucccuuucaccucgguaccagacagguguguaucgccuggucaagcaguuccugccaugacgggaaggcauggcugcacgucugugugacaggagaugacaaaaacgccaccgcuucuuucauuuauaauggcaggcugguagauagcaucggcuccuggucaaagaaaauccuccggacgcaggagagugaaugcguuuguauuaacgggacuugcacaguggucaugaccgacggaagcgcaucugguaaggccgauacuaaaauauuauuuguggaggagggcaagaucgugcacauuuccacacugucagggagcgcucaacaugucgaagagugcaguuguuacccucgcuauccaggaguuagaugcguguguagggacaacuggaagggcucuaaucggccgaucguagauauaaacgugaaagacuacuccauugucagcucguacgugugcucuggucuuguuggggacacuccccgcaagaaugauuccucaaguagcucccacuguuuggacccuaacaaugaagagggaggccauggcgugaaagggugggccuucgaugacggaaacgaugucuggaugggucgaacgaucucugaaaagcugagaagcggcuaugagaccuuuaaagugaucgagggguggucaaagccaaauaguaaacuacagauuaacaggcagguaaucguugaacggggaaaucguuccggcuacagcgguauuuucucuguggaggggaagucaugcauaaaccgcuguuuuuaugucgaacucaucagaggcaggaaggaggaaacagaggugugguggaccaguaauagcauugucguguucugcggaaccuccggcacauacgggacuggaucuuggcccgacggugcggauaucaaccugaugccuaucuga

SEQ ID NO: 142769 - RNA, 1410 nt, Artificial Sequence; identical to SEQ ID NO: 138754
  derived and/or modified sequence opt3 from neuraminidase__InfluenzaA__AEI29218

SEQ ID NO: 142770 - RNA, 1410 nt, Artificial Sequence; identical to SEQ ID NO: 140121
  derived and/or modified sequence opt3 from neuraminidase__InfluenzaA__AEI29228

SEQ ID NO: 142771 - RNA, 1410 nt, Artificial Sequence; identical to SEQ ID NO: 136153
  derived and/or modified sequence opt3 from neuraminidase__InfluenzaA__AEI54350

SEQ ID NO: 142772 - RNA, 1410 nt, Artificial Sequence; identical to SEQ ID NO: 136166
  derived and/or modified sequence opt3 from neuraminidase__InfluenzaA__AEI54361

SEQ ID NO: 142773 - RNA, 1410 nt, Artificial Sequence; identical to SEQ ID NO: 136730
  derived and/or modified sequence opt3 from neuraminidase__InfluenzaA__AEI54372

SEQ ID NO: 142774 - RNA, 1410 nt, Artificial Sequence; identical to SEQ ID NO: 136607
  derived and/or modified sequence opt3 from neuraminidase__InfluenzaA__AEI54383

SEQ ID NO: 142775 - RNA, 1410 nt, Artificial Sequence; identical to SEQ ID NO: 136730
  derived and/or modified sequence opt3 from neuraminidase__InfluenzaA__AEI54394

SEQ ID NO: 142776 - RNA, 1410 nt, Artificial Sequence; identical to SEQ ID NO: 137900
  derived and/or modified sequence opt3 from neuraminidase__InfluenzaA__AEI54416

SEQ ID NO: 142777 - RNA, 1410 nt, Artificial Sequence; identical to SEQ ID NO: 142720
  derived and/or modified sequence opt3 from neuraminidase__InfluenzaA__AEI54427

SEQ ID NO: 142778 - RNA, 1410 nt, Artificial Sequence; identical to SEQ ID NO: 141534
  derived and/or modified sequence opt3 from neuraminidase__InfluenzaA__AEI54438

SEQ ID NO: 142779 - RNA, 1410 nt, Artificial Sequence; identical to SEQ ID NO: 141534
  derived and/or modified sequence opt3 from neuraminidase__InfluenzaA__AEI54449

SEQ ID NO: 142780 - RNA, 1410 nt, Artificial Sequence; identical to SEQ ID NO: 141534
  derived and/or modified sequence opt3 from neuraminidase__InfluenzaA__AEI54460

SEQ ID NO: 142781 - RNA, 1410 nt, Artificial Sequence
  derived and/or modified sequence opt3 from neuraminidase__InfluenzaA__AEI54471
augaaccccaaucagaagaucauuaccauaggcagcgugucccugacaaucucuacuauuugcuucuuuaugcaaaucgccguccucauuacgaccguuacacuucacuucaaacaguacaaguuuaacucaccuccaaauaaccaggugaugcugugugagccgacuaucauagaaagaaauaucaccgagauuguauauuugacaaacaccacuaucgaaaaagagauuugccccaaguuagcugaauacaggaauuggaguaaaccucagugugacaucacaggguucgcaccauuuagcaaggauaacuccauacggcugucugccggaggugacauuugggugacccgcgagcccuaugucucgugcgauccugacaaguguuaccaauucgcgcuaggccaggggacgacucucaauaacgugcauucaaauaacaccguucgagaucguacaccauauagaacucugcuuaugaaugagcugggagugcccuuucacuugggcaccaaacaggucugcaucgcuuggagcaguuccucuugucaugacgguaaggccuggcuccacgugugcauuacaggggaugacaaaaacgcaaccgccagcuucaucuacaauggaaggcugguagauuccguugugucauggaguaaggaaauccugcggacgcaggagagcgaaugugucugcauuaacggcacuuguacaguggugaugaccgacggcucugcuuccgggaaagcagauacuaagauacucuuuaucgaggagggaaagauuguccauacaucaaccuuaagcgguagugcccaacacguugaagagugcucuugcuauccucgcuacccaggcgugagauguguaugcagggacaacuggaaaggguccaaucggccgaucguggauauaaacauuaaggaccacagcaucgucucgucuuacguguguuccggacugguuggcgacacgccccgcaaaaaugauucaaguagcuccucucauugccuugacccuaacaaugaagagggugggcacggagugaagggcugggcuuucgaugacggcaacgaugucuggauggggcgaaccaucaaugaaacaagcagauugggauaugagacuuuuaaagugauugaggguuggucaaacccaaagaguaaacugcagaucaauaggcagguaauuguugaccggggcaaccguuccggguacagcggaauauucucuguggaaggcaagucauguaucaaucgcugcuuuuaugucgagcuaauuagagguaggaaggaagagaccgaagugcucuggacaaguaacagcaucgucguguucugugggacuuccggcaccuacggaacaggcucuuggcccgauggggccgaccugaaucuuaugccuaucuga

SEQ ID NO: 142782 - RNA, 1410 nt, Artificial Sequence; identical to SEQ ID NO: 141426
  derived and/or modified sequence opt3 from neuraminidase__InfluenzaA__AEI54482

SEQ ID NO: 142783 - RNA, 1410 nt, Artificial Sequence
  derived and/or modified sequence opt3 from neuraminidase__InfluenzaA__AEI54493
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuaaugagacaagcagauugggauaugagacuuuuaaggucaucgaagguuggucaaacccaaaaaguaagcugcagauuaauaggcaagugauaguagaccggggcaaccguuccggguacagcggaaucuucucuguugagggcaaaucauguauuaaucgcugcuuuuauguggaacuaaucagagguaggaaggaggaaaccgagguccucuggacaaguaacagcaucguggucuucugugggacuuccggcaccuacggaacaggcucuuggcccgauggggccgaccugaaucuuaugucgauuuga

SEQ ID NO: 142784 - RNA, 1410 nt, Artificial Sequence; identical to SEQ ID NO: 141534
  derived and/or modified sequence opt3 from neuraminidase__InfluenzaA__AEI54504

SEQ ID NO: 142785 - RNA, 1410 nt, Artificial Sequence; identical to SEQ ID NO: 141054
  derived and/or modified sequence opt3 from neuraminidase__InfluenzaA__AEI59982

SEQ ID NO: 142786 - RNA, 1413 nt, Artificial Sequence; identical to SEQ ID NO: 141952
  derived and/or modified sequence opt3 from neuraminidase__InfluenzaA__AEI59993

SEQ ID NO: 142787 - RNA, 1413 nt, Artificial Sequence; identical to SEQ ID NO: 141948
  derived and/or modified sequence opt3 from neuraminidase__InfluenzaA__AEI60004

SEQ ID NO: 142788 - RNA, 1410 nt, Artificial Sequence
  derived and/or modified sequence opt3 from neuraminidase__InfluenzaA__AEI60015
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccggucauugccuugacccuaacaaugaggaagggggaaacggcguuaaaggcugggcuuucgaugacgggaaugauguguggaugggacgaaccauuucugaaaagagcagauuggguuaugagacauuuaaagucaucgagggcuggucaaaccacaagaguaaacugcagauuaauaggcaagugauaguagaccgggggaaccguuccggauacagcggcaucuucucuguugaggguaagucauguauuaaucgcugcuuuuauguggaacuaaucagagggaggaaggaggaaacugagguccucuggaccaguaacagcaucguggucuucuguggcacauccggaacuuacggcaccgggucuuggccagauggagccgaccugaaucuuaugcccauuuga

SEQ ID NO: 142789 - RNA, 1410 nt, Artificial Sequence; identical to SEQ ID NO: 140500
  derived and/or modified sequence opt3 from neuraminidase__InfluenzaA__AEI60026

SEQ ID NO: 142790 - RNA, 1410 nt, Artificial Sequence
  derived and/or modified sequence opt3 from neuraminidase__InfluenzaA__AEI60037
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgccgaaaugauucaaguagcuccucucauugccuugacccuaacaaugaggaaggugggcacggaguuaagggcugggcuuucgaugacggcaacgauguguggauggggagaaccauuagcgagaaaucaagguugggauaugagacauuuaaggucaucgaagguuggaguaaucauaaauccaagcugcagauuaaccgucaggugauaguagaccggggcaaucgcagcggguacucuggaaucuucucaguugagggcaaaaguuguauuaacagaugcuuuuauguggaacuaaucaggggucggaaggaggaaacugagguccucuggaccagcaauuccaucguggucuucugugggacaucuggcacuuacggaaccggcucguggccagauggggccgaccugaaccuuaugcccauuuga

SEQ ID NO: 142791 - RNA, 1410 nt, Artificial Sequence
  derived and/or modified sequence opt3 from neuraminidase__InfluenzaA__AEI60048
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugcuccgacuauaaucgaaagaaauauuaccgagaucguguauuugacaaacaccacuauugaaaaggagaucugccccaaauuagcagaauacaggaauuggaguaagccucagugugacauaacaggguucgccccauuuagcaaagauaacuccauucggcugucugcgggaggugacaucuggguaacccgcgagcccuaugugucgugcgauccugacaaguguuaccaauucgcucuaggccaggggacgacucucaauaacguccauucaaauaacaccgugcgagaucguacaccauauagaacucugcuuaugaaugagcugggaguucccuuucacuugggcaccaaacaggugugcauugccuggagcaguuccucuugucaugacgguaaggcauggcuccacgucugcaucacaggggaugacaagaacgccaccgcuagcuucaucuacaauggaaggcugguggauuccguaguuucauggaguaaagaaauucugcggacgcaggagagcgaaugugugugcauaaacggcacuuguacagucgugaugaccgacggcucugcauccgggaaggccgauacuaaaauccucuuuauugaggagggaaagaucgugcauacaucaaccuuaagcgguagugcucaacacgucgaagagugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaagagggugggcacggaguuaaaggcugggccuucgaugacggcaacgauguguggauggggcgaaccauuagcgaaaagucaagauugggauaugagacauuuaaagucaucgaggguuggaguaauccaaaguccaaacugcagauuaacaggcaagugauaguagaccggggcaaucguagcggguacucuggaaucuucucaguugaaggcaagaguuguauuaaccgcugcuuuuauguggagcuaaucagagguaggaaggaagagacugaaguccucuggaccagcaauuccaucguggucuucugugggacaucuggcacuuacggaaccggcucguggcccgauggggcggacauuaaccugaugccuauauga

SEQ ID NO: 142792 - RNA, 1410 nt, Artificial Sequence
  derived and/or modified sequence opt3 from neuraminidase__InfluenzaA__AEI60089
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucugacggccaggcuuccuacaaaauuuuucggaucgaaaaggguaaaauugucaagucaguggagaugaaugcccccaacuauuacuacgaagagugcaguuguuauccugauagcuccgagauaacuugcgugugccgcgacaauuggcaugggucuaacagaccaugggucagcuucaaucagaaccucgaauaccagaucggauauauuuguucaggcaucuuuggcgauaauccgaggcccaacgacaaaaccgggaguugcggaccuguuuccagcaauggugcgaacggcgugaagggguucucuuuuaaguacggaaacggcguauggaucggucggacaaaaucaauuaguagccgcaagggguucgagaugauaugggauccaaauggcuggaccggaacggacaacaauuuuuccaucaaacaagacauugugggcaucaacgaauggucuggguauucggggagcuucguccagcaccccgagcugacuggucuggauuguauucgaccuugcuucuggguggaacucaucagaggcaggccaaaggagaauacaauauggaccuccgggucaaguaucucuuuuuguggaguuaacagcgacacugugggcugguccuggcccgauggugcagaguuaccguucacaauugacaaauga

SEQ ID NO: 142793 - RNA, 1410 nt, Artificial Sequence; identical to SEQ ID NO: 142725
  derived and/or modified sequence opt3 from neuraminidase__InfluenzaA__AEI60099

SEQ ID NO: 142794 - RNA, 1410 nt, Artificial Sequence
  derived and/or modified sequence opt3 from neuraminidase__InfluenzaA__AEI60111
augaaccccaaucagaagaucauuaccauaggcagcaucucccugacaauugccacuaucugcuuccucaugcaaauugcuauccuugugacgaccgucacacugcacuuuaaacaguacaaguguaacucuccuccaaauaacagaguuauguugugcgagccgacuauaaucgaaaggaauauuaccgagaucguguauuuaacaaacaccacuauugaaaaagagaucugucccaagcuggcagaauaccggaauuggucaaaaccucagugcaacauaaagggguucgccccauuuaguaaggacaauagcauucgccuauccgcgggaggugauaucuggguaacacgagagcccuaugugucuugugacccugauaaaugcuaccaguucgcucucggccaagggaccacgcugaacaauggacauucgaacgacacuguccacgaucguaccccauauagaacacuucugaugaaugaguugggcgugcccuuucaucucgguacuaggcagguuuguauugccuggucaagcaguuccugccacgacgggaaggcauggcugcauguguguaucaccggagaugacgaaaacgccacagcuucuuucaucuacaauggccggcuggucgauagcauuggcuccuggaguaaaaagauacuccgcacccaggagucagaaugcguguguaucaacgggacgugcacuguaguuaugacagacggaagcgcaucugguaaagccgauaccaagauuuuauuuaucgaggagggcaagauagugcacauuuccacucugucagggagcgcucagcacgucgaagagugcaguuguuauccuagauacccaggagugaggugcgugugucgggacaacuggaaaggcucuaaucgcccgaucgucgauaucaacguucgagacuacuccauugugagcucguauguaugcucuggucuugugggggacacacccagaaagaaugauuccuucucaaguagccauuguuuggacccuaacaaugaagagggaggccacggcgucaaagggugggccuuugaugacggaaacgauguguggauggguaggaccaucuccgaaaagcugcggucuggcuacgagacguucaaaguuauugagggguggagcaagccaaauucaaaacuacaagugaaccgucaggucauaguggaacgcggaaauagaaguggcuauuccgguaucuuuagcguagaggggaagucuugcauuaacagguguuucuacguugaacucauccggggccgaaaggaggaaaccaaagugugguggacaucaaauaguaucgucguguuuugcggaacuagcggcaccuaugggacaggauccuggcccgacggugcggauauuaacauaaugccuaucuga

SEQ ID NO: 142795 - RNA, 1410 nt, Artificial Sequence; identical to SEQ ID NO: 138754
  derived and/or modified sequence opt3 from neuraminidase__InfluenzaA__AEI73669

SEQ ID NO: 142796 - RNA, 1410 nt, Artificial Sequence
  derived and/or modified sequence opt3 from neuraminidase__InfluenzaA__AEI86727
augaaccccaaucagaagaucauuaccauaggcagcgugugcaucacaauugggauggccaaccugauccuccaaauuggaaauaucauauccaucuggauuucucacucaauccagcuugguaaccagaaucagauugagacuuguaaccaaagugucaucacguacgaaaauaacaccuggguuaaucagacauaugugaacauaagcaauacuaacuucgcugcaggccaguccguagugucugucaaacuggccggaaauucgucauugugcccugugagcgggugggcgauuuacaguaaggacaacuccaucagaauuggcucuaaaggugauguuuuugugaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggucccaucucccuacaacuccaaguuugaaucaguggccuggagcgcaagugccugccacgacggcaucucuuggcuuacaauugggaucuccggaccugauaauggugcuguagcaguucugaaguauaacggcauaauuaccgacacgaucaaaagcuggcguaauaacaucuugagaacucaagagucggagugugccugcgugaaugggucuuguuucaccgucaugacagauggaccauccgacggccaggcuucauacaagauuuuuaggaucgaaaaagguaagauugugaaaaguguggagaugaacgcccccaauuaucauuacgaagagugcagcuguuacccugauuccucugagauaacuugcgucugccgggacaacuggcacgggagcaaucgcccauggguuucauucaaccagaaucucgaauaucagaucggauacauuuguaguggcaucuuuggcgauaacccgagacccaaugacaagaccggguccugcggaccugugagcucuaacggugcgaauggcguaaagggguucucauuuaaauauggaaacggcguguggaucgguaggacaaagaguauuagcucccggaacggguucgagaugauaugggauccaaauggcuggaccggaacggacaacaauuuuucuaucaaacaagacauugucggcaucaacgaauggucgggguacagcggauccuucgugcagcaucccgagcugacuggucuggauuguauucgcccuugcuucuggguugaacucauccgaggcagaccaaaggagaauacaauauggaccucagggaguucuaucagcuuuuguggagugaacuccgacacugucggcuggucauggcccgauggugcagaguuaccguucacaauugacaaauga

SEQ ID NO: 142797 - RNA, 1410 nt, Artificial Sequence
  derived and/or modified sequence opt3 from neuraminidase__InfluenzaA__AEI86737
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaaaaccuggguuaaccagacauaugugaauaucagcaacacuaauuucgcugcaggccaguccguagugucugucaagcuggccgggaacucgucauugugcccugugagcggaugggcgauauacaguaaagacaauuccauuagaaucggcucuaagggugauguuuuugugauuagggagccauucaucagcuguuccccguuagaaugccggaccuuuuuccugacacagggggcucuacucaacgacaaacauucaaauggaaccaucaaggaucgcagucccuaucgaacucugaugagcuguccuauuggcgaggucccaucucccuacaacucccguuuugaaucaguggccuggagcgcaagugccugccacgacggcauaaacuggcuuacaaucgggauuucuggaccugauaauggugcuguagcaguucugaaguauaacggcaucauaaccgacacgauuaaauccuggagaaauaacaucuugaggacucaagagagcgagugugccugcgugaaugggucguguuucaccgucaugacagauggaccaucugacggccaggcuuccuacaagaucuuucggauugaaaaagguaagguggugaaaucagucgagaugaacgcccccaauuaucauuacgaagagugcaguuguuacccugauagcuccgagaucacuugcguuugccgcgacaacuggcacgggucuaauagaccaugggugagcuucaaccagaaucucgaauaucagauuggauacauauguucaggcaucuuuggcgauaacccgaggcccaaugacaagaccgggaguugcggaccuguauccagcaacggugcgaauggcgugaagggguucucuuuuaaauauggaaacggcgucuggauuggucggacaaagucaaucaguagccgcaacggguucgagaugaucugggauccaaauggcuggaccggaacggacaacaauuuuuccauuaaacaagacauagugggcaucaacgaauggucuggguacucggguagcuucguucagcaucccgagcugacuggacuggauuguauucgaccuugcuucuggguggaacucaucagaggcaggccaaaggagaauacaauuuggaccuccgggucaaguaucucuuuuuguggagucaacagcgacacugugggcugguccuggcccgauggugcagaguuaccguucacaauagacaaauga

SEQ ID NO: 142798 - RNA, 1410 nt, Artificial Sequence
  derived and/or modified sequence opt3 from neuraminidase__InfluenzaA__AEI86757
augaaccccaaucagaagaucauuaccauaggcagcgugugcaucacaauugggauggccaaccugauccuccaaauuggaaauaucauauccaucuggauuucucacucaauccagcuugguaaccagaaucagauugagacuuguaaccaaagugucaucacguacgaaaauaacaccuggguuaaucagacauaugugaacauaagcaauacuaacuucgcugcaggccaguccguagugucugucaaacuggccggaaauucgucauugugcccugugagcggaugggcgauuuacaguaaggacaacuccaucagaauuggcucuaaaggugauguuuuugugaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggucccaucucccuacaacucccguuuugaaucaguggccuggagcgcaagugccugccacgacggcaucucuuggcuuacaauugggaucuccggaccugauaauggugcuguagcaguucugaaguauaacggcauaauuaccgacacgaucaagagcuggagaaauaacaucuugaggacucaagagucggagugugccugcgugaaugggucuuguuucaccgucaugacagauggaccauccgacggccaggcuucauacaaaauuuuucggaucgaaaaggguaaaauugugaagaguguggagaugaacgcccccaauuaucauuacgaagagugcagcuguuacccugauuccucugagauaacuugcgucugccgcgacaacuggcacgggagcaauagaccauggguuucauucaaccagaaucucgaauaucagaucggauacauuuguaguggcaucuuuggcgauaacccgaggcccaaugacaaaaccggguccugcggaccugugagcucuaacggugcgaauggcguaaagggguucucauuuaaguauggaaacggcguguggaucggucggacaaaaaguauuauaagccgcaacggguucgagaugaucugggauccaaauggcuggaccggaacggacaacaauuuuuccauuaagcaagacaucgucggcauuaacgaauggucuggguacucggggagcuucgugcagcaucccgagcugacuggucuggauuguauccgaccuugcuucuggguugaacucauaagaggcaggccaaaagagaauacaaucuggaccuccgggucaaguauuucuuuuuguggagugaacagcgacacugucggcugguccuggcccgauggugcagaguuaccguucacaaucgacaaguga

SEQ ID NO: 142799 - RNA, 1410 nt, Artificial Sequence
  derived and/or modified sequence opt3 from neuraminidase__InfluenzaA__AEI86767
augaaccccaaucagaagaucauuaccauaggcagcgugugcaucacaauugggauggccaaccugauccuccaaauuggaaauaucauauccaucuggauuucucacucaauccagcuugguaaccagaaucagauugagacuuguaaccaaagugucaucacguacgaaaauaacaccuggguuaaucagacauaugugaacauaagcaauacuaacuucgcugcaggccaguccguagugucugucaaacuggccggaaauucgucauugugcccugugagcgggugggcgauuuacaguaaggacaacuccaucagaauuggcucuaaaggugauguuuuugugaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggucccaucucccuacaacucccguuuugaaucaguggccuggagcgcaagugccugccacgacggcaucucuuggcuuacaauugggaucuccggaccugauaauggugcuguagcaguucugaaguauaacggcauaauuaccgacacgaucaagagcuggagaaauaacaucuugaggacucaagagucggagugugccugcgugaaugggucuuguuucaccgucaugacagauggaccauccgacggccaggcuucauacaaaauuuuucggaucgaaaaggguaaaauugugaagaguguggagaugaacgcccccaauuaucauuacgaagagugcagcuguuacccugauuccucugagauaacuugcgucugccgcgacaacuggcacgggagcaauagaccauggguuucauucaaccauaaucucgaauaucagaucggauacauuuguaguggcaucuuuggcgauaacccgaggcccaaugacaaaaccggguccugcggaccugugagcucuaacggugcgaauggcguaaagggguucucauuuaaguauggaaacggcguguggaucggucggacaaaaaguauuagcucccgcaacggguucgagaugauaugggauccaaauggcuggaccggaacggacaacaauuuuucuaucaagcaggacauugucggcaucaacgaauggucgggguacagcggauccuucgugcaacaccccgagcugacuggucuggauuguauucgaccuugcuucuggguugaacucaucagaggcaggccaaaagagaauacaauauggaccucagggaguucuaucagcuuuuguggagugaacuccgacacugucggcuggucauggcccgauggugcagaguuaccguucacaauugacaaguga

SEQ ID NO: 142800 - RNA, 1410 nt, Artificial Sequence; identical to SEQ ID NO: 142799
  derived and/or modified sequence opt3 from neuraminidase__InfluenzaA__AEI86777

SEQ ID NO: 142801 - RNA, 1410 nt, Artificial Sequence
  derived and/or modified sequence opt3 from neuraminidase__InfluenzaA__AEI86787
augaaccccaaucagaagaucauuaccauaggcagcgugugcaugacaaucgggauggccaaccugaugcuccaaauuggaaauaucauuuccaucuggauaucucacucaauccagcuugguaaccagaaucagauugagacuuguaaccaaagugucaucacguacgaaaauaacaccuggguuaaucagacauaugugaacauuagcaauacuaacuucgcugcaggccaguccguagugucugucaaacuggccggaaauucgucauugugcccugugagcggaugggcgaucuacaguaaggacaacuccauaagaauuggcucuaaaggugauguuuuugugaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggucccaucucccuacaacucccguuuugaaucaguggccuggagcgcaagugccugccacgacggcauuaauuggcuuacaauagggaucucuggaccugauaacggugcuguagcaguucugaaguauaauggcauuaucaccgacacgauaaaguccuggagaaacaauauuuugaggacucaagagagcgagugugccugcgugaacgggucguguuucaccgucaugacagauggaccaucugacggccaggcuuccuacaaaaucuuucggaucgaaaaggguaaaauugugaagucaguggagaugaaugcccccaacuaucauuacgaagagugcaguuguuacccugauagcuccgagaucacuugcgucugccgcgacaauuggcacgggucuaacagaccauggguuagcuucaaucagaaccucgaauaucagauuggauacauauguucaggcaucuuuggcgauaauccgaggcccaacgacaaaaccgggaguugcggaccuguguccagcaauggugcgaacggcguaaagggguucucuuuuaaguauggaaacggcguguggauuggucggacaaaaucaaucaguagccgcaauggguucgagaugaucugggauccaaacggcuggaccggaacggacaauaacuuuuccauuaagcaagacauagucggcaucaaugaauggucuggguacucggggagcuucgugcagcaucccgagcugacuggucuggauuguauucgaccuugcuucuggguugaacucaucagaggcaggccaaaagagaacacaauuuggaccuccgggucaaguaucucuuuuuguggagugaauagcgacacugucggcugguccuggcccgauggugcagaguuaccguucacaauagacaaguga

SEQ ID NO: 142802 - RNA, 1410 nt, Artificial Sequence
  derived and/or modified sequence opt3 from neuraminidase__InfluenzaA__AEI86797
augaaccccaaucagaagaucauuaccauaggcagcgugugcaucacaauugggauggccaaccugauccuccaaauuggaaauaucauauccaucuggauuucucacucaauccagcuugguaaccagaaucagauugagacuuguaaccaaagugucaucacguacgaaaauaacaccuggguuaaucagacauaugugaacauaagcaauacuaacuucgcugcaggccaguccguagugucugucaaacuggccggaaauucgucauugugcccugugagcgggugggcgauuuacaguaaggacaacuccaucagaauuggcucuaaaggugauguuuuugugaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggucccaucucccuacaacucccguuuugaaucaguggccuggagcgcaagugccugccacgacggcaucucuuggcuuacaauugggaucuccggaccugauaauggugcuguagcaguucugaaguauaacggcauaauuaccgacacgaucaagagcuggagaaauaacaucuugaggacucaagagucggagugugccugcgugaaugggucuuguuucaccgucaugacagauggaccauccgacggccaggcuucauacaaaauuuuucggaucgaaaaggguaaaauugugaagaguguggagaugaacgcccccaauuaucauuacgaagagugcagcuguuacccugauuccucugagauaacuugcgucugccgcgacaacuggcacgggagcaauagaccauggguuucauucaaccagaaucucgaauaucagaucggauacauuuguaguggcaucuuuggcgauaacccgaggcccaaugacaaaaccggguccugcggaccugugagcucuaacggugcgaauggcguaaagggguucucauuuaaguauggaaacggcguguggaucggucggacaaaaaguauuagcucccgcaacggguucgagaugauaugggauccaaauggcuggaccggaacggacaacaauuuuucuaucaagcaagacauugucggcaucaacgaauggucgggguacagcggauccuucgugcagcaucccgagcugacuggucuggauuguauucgaccuugcuucuggguugaacucaucagaggcaggccaaaagagaauacaauauggaccucagggaguucuaucagcuuuuguggagugaacuccgacacugucggcuggucauggcccgauggugcagaguuaccguucacaauugacaaguga

SEQ ID NO: 142803 - RNA, 1410 nt, Artificial Sequence
  derived and/or modified sequence opt3 from neuraminidase__InfluenzaA__AEI86807
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccaaaauuacuugcgucugccgcgacaauuggcacgggucuaacagaccauggguuagcuucaaucagaaccucgaguaucagauaggauacaucuguucaggcauuuuuggcgauaauccgaggcccaacgacaagaccgggaguugcggaccuguguccagcaauggugcgaacggcguaaagggguucucuuuuaaauauggaaacggcguguggaucggucggacaaagucaaucaguagccgcaauggguucgaaaugauuugggauccaaacggcuggaccggaacggacaauaacuuuuccauaaaacaagacaucgucggcauuaaugaguggucuggguacucggggagcuucgugcagcaucccgaacugacuggucuggauuguauccgaccuugcuucuggguugagcucauuagaggcaggccaaaggaaaacacaaucuggaccuccgggucaaguauaucuuuuuguggagugaauagcgacacugucggcugguccuggcccgauggugcagaguuaccguucaucauugacaaauga

SEQ ID NO: 142804 - RNA, 1410 nt, Artificial Sequence; identical to SEQ ID NO: 142799
  derived and/or modified sequence opt3 from neuraminidase__InfluenzaA__AEI86817

SEQ ID NO: 142805 - RNA, 1410 nt, Artificial Sequence
  derived and/or modified sequence opt3 from neuraminidase__InfluenzaA__AEI86827
augaaccccaaucagaagaucauuaccauaggcagcgugugcaucacaauugggauggccaaccugauccuccaaauuggaaauaucauauccaucuggauuucucacucaauccagcuugguaaccagaaucagauugagacuuguaaccaaagugucaucacguacgaaaauaacaccuggguuaaucagacauaugugaacauaagcaauacuaacuucgcugcaggccaguccguagugucugucaaacuggccgggaauagcucauugugcccugugagcggaugggcgauuuacaguaaggacaacuccaucagaauuggcucuaaaggugauguuuuugugaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggucccaucucccuacaacucccguuuugaaucaguggccuggagcgcaagugccugccacgacggcaucucuuggcuuacaauugggaucuccggaccugauaauggugcuguagcaguucugaaguauaacggcauaauuaccgacacgaucaagagcuggagaaauaacaucuugaggacucaagagucggagugugccugcgugaaugggucuuguuucaccgucaugacagauggaccauccgacggccaggcuucauacaaaauuuuucggaucgaaaaggguaaaauugugaagaguguggagaugaacgcccccaauuaucauuacgaagagugcagcuguuacccugauuccucugagauaacuugcgucugccgcgacaacuggcacgggagcaauagaccauggguuucauucaaccauaaucucgaauaucagaucggauacauuuguaguggcaucuuuggcgauaacccgaggcccaaugacaaaaccggguccugcggaccugugagcucuaacggugcgaauggcguaaagggguucucauuuaaguauggaaacggcguguggaucggucggacaaaaaguaccagcucccgcaacggguucgagaugauuugggauccaaauggcuggacgggaacugacaacaauuuuucuauaaagcaggacaucgucggcauuaacgaauggucgggguacagcggauccuucgugcaacaccccgagcugacaggucugaauuguauccgaccuugcuucuggguugaacucauuagaggcaggccaaaagagaacaccaucuggacuucagggaguucuauaucguuuuguggagucaauuccgauacagugggcuggucauggcccgacggugcagaguuaccguucaccaucgauaaguga

SEQ ID NO: 142806 - RNA, 1410 nt, Artificial Sequence; identical to SEQ ID NO: 142802
  derived and/or modified sequence opt3 from neuraminidase__InfluenzaA__AEI86837

SEQ ID NO: 142807 - RNA, 1410 nt, Artificial Sequence; identical to SEQ ID NO: 142273
  derived and/or modified sequence opt3 from neuraminidase__InfluenzaA__AEI86847

SEQ ID NO: 142808 - RNA, 1410 nt, Artificial Sequence
  derived and/or modified sequence opt3 from neuraminidase__InfluenzaA__AEI86867
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaaccuggcugcaggccaguccguagugucugucaaauuggccggaaauucgucauuaugcccugugagcggaugggcgauauacaguaaggacaacuccauuagaaucggcucuaaaggugauguuuucgugauuagggagccauuuaucagcuguuccccgcuggaaugccggaccuucuuucuaacacagggggcucuccugaaugacaagcauucaaacggaaccaucaaagaucgcagucccuaucgaacucuuaugagcuguccuauuggcgaggucccaucucccuacaacuccaaguucgaaucaguggccuggagcgcaagugccugccacgacggcauaaauuggcugacaaucgggauuucuggaccugauaacggugcuguagcaguuuugaaguauaauggcaucauaaccgacacgauuaaauccuggcguaacaauauccucagaacucaagagagcgagugugccugcgugaacgggucguguuuuaccaucaugacagauggaccaucugacggccaggcuuccuacaagauuuucaggaucgaaaaagguaagauugucaaaucaguggagaugaaugcccccaacuaucauuacgaagagugcaguuguuacccugauagcuccgagauaacuugcgugugccgggacaauuggcacgggucuaaccgcccaugggucagcuuuaaucagaaccuggaauaucagaucggauacauuuguucaggcaucuucggcgauaauccgagacccaacgacaagaccgggaguugcggaccuguuuccagcaauggugcgaacggcgugaagggguuuucuuucaaauauggaaacggcguauggaucgguaggacaaagucaauuaguagccggaaaggguuugagaugauaugggauccaaauggcuggaccggaacggacaacaauuucuccaucaagcaagacauugugggcaucaacgaauggucuggguacucggggagcuuuguccagcaucccgagcugacuggucucgauuguauucgcccuugcuucuggguggaauuaauccgaggcagaccaaaagagaauacaauauggaccuccgggucaaguaucucuuucuguggaguuaacagcgacacugugggcugguccuggcccgauggugcagagcugccguuuacaauugacaaguga

SEQ ID NO: 142809 - RNA, 1410 nt, Artificial Sequence; identical to SEQ ID NO: 142802
  derived and/or modified sequence opt3 from neuraminidase__InfluenzaA__AEI86887

SEQ ID NO: 142810 - RNA, 1410 nt, Artificial Sequence; identical to SEQ ID NO: 142802
  derived and/or modified sequence opt3 from neuraminidase__InfluenzaA__AEI86897

SEQ ID NO: 142811 - RNA, 1410 nt, Artificial Sequence
  derived and/or modified sequence opt3 from neuraminidase__InfluenzaA__AEI86907
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacauccauucaaacggaaccauuaaggaucgcagucccuaucgaacucugaugagcuguccuauaggcgaggucccaucucccuacaacucccguuuugaaucaguggccuggagcgcaagugccugccacgacggcaucaauuggcuuacaauugggaucucuggaccugauaacggugcuguagcaguucugaaauauaauggcauaauuaccgacacgaucaaguccuggagaaacaauaucuugaggacucaagagagcgagugugccugcgugaacgggucguguuucaccauuaugacagauggaccaucugacggccaggcuuccuacaagaucuuucggauugaaaaagguaagauagucaaaucaguggagaugaaugcccccaacuaucauuacgaagagugcaguuguuacccugauagcuccgagaucacuugcgugugccgcgacaauuggcacgggucuaacagaccaugggucagcuucaaucagaaccucgaauaucagauuggauacaucuguucaggcaucuuuggcgauaauccgaggcccaacgacaagaccgggaguugcggaccuguuuccagcaauggugcgaacggcgugaaaggguucucuuuuaaguauggaaacggcguauggauuggucggacaaagucaauaaguagccgcaaaggguucgagaugaucugggauccaaauggcuggaccggaacggacaacaauuuuuccauuaagcaagacaucgugggcauuaacgaauggucuggguacucggggagcuucguccagcaucccgagcugacuggucuggauuguauccgaccuugcuucuggguggaacucauaagaggcaggccaaaagagaauacaaucuggaccuccgggucaaguauuucuuuuuguggaguuaacagcgacacugugggcugguccuggcccgauggugcagaguuaccguucacaaucgacaaguga

SEQ ID NO: 142812 - RNA, 1410 nt, Artificial Sequence
  derived and/or modified sequence opt3 from neuraminidase__InfluenzaA__AEI86917
augaaccccaaucagaagaucauuaccauaggcagcaucugcaugacaauugggauggccaaccugauccuccaaauuggaaauaucauauccaucuggauuucucacucaauccagcuugguaaccagaaucagauugagacuuguaaccaaagugugaucacguacgaaaauaacaccugggucaaucagacauauguuaacauaagcaauacuaacuucgcugcaggccaguccgugguaucugugaaacuggccggaaauucgucauugugcccugucagcggaugggcgauuuacaguaaggacaacuccaucagaauuggcucuaaaggugauguguuuguuaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggugccaucucccuacaacucccguuuugaaucagucgccuggagcgcaagugccugccacgacggcaucaauuggcuuacaauugggaucucuggaccugauaacggugcuguggcaguacugaaguauaauggcauaauuaccgacacgaucaaguccuggagaaacaauaucuugaggacucaagagagcgagugugccugcguuaacgggucguguuucaccauuaugacagauggaccaucugacggccaggcuuccuacaaaaucuuucggauugaaaaggguaaaauagugaagucagucgagaugaaugcccccaacuaucauuacgaagagugcaguuguuacccugauagcuccgagaucacuugcgugugccgcgacaauuggcacgggucuaacagaccaugggugagcuucaaucagaaccucgaauaucagauuggauacaucuguucaggcaucuuuggcgauaauccgaggcccaacgacaaaaccgggaguugcggaccugucuccagcaauggugcgaacggcguuaagggguucucuuuuaaguauggaaacggcguguggauuggucggacaaaaucaauaaguagccgcaagggguucgagaugaucugggauccaaauggcuggaccggaacggacaacaauuuuuccauuaaacaagacaucguaggcauuaacgaauggucuggguacucggggagcuucgugcagcaucccgagcugacuggucuggauuguauccgaccuugcuucugggucgaacucauaagaggcaggccaaaggagaauacaaucuggaccuccgggucaaguauuucuuuuuguggagugaacagcgacacuguuggcugguccuggcccgauggugcagaguuaccguucacaaucgacaaauga

SEQ ID NO: 142813 - RNA, 1410 nt, Artificial Sequence; identical to SEQ ID NO: 142725
  derived and/or modified sequence opt3 from neuraminidase__InfluenzaA__AEI86927

SEQ ID NO: 142814 - RNA, 1410 nt, Artificial Sequence; identical to SEQ ID NO: 142799
  derived and/or modified sequence opt3 from neuraminidase__InfluenzaA__AEI86937

SEQ ID NO: 142815 - RNA, 1410 nt, Artificial Sequence
  derived and/or modified sequence opt3 from neuraminidase__InfluenzaA__AEI86947
augaaccccaaucagaagaucauuaccauaggcagcgugugcaugacaaucgggauggccaaccugauucuccaaaucggaaauauuaucuccauauggaucucucacucaauucagcuugguaacaaaaaucagaucgagacuuguaaccagagugucauuacguacgaaaauaacaccuggguuaaucaaacauaugugaacaucagcaauacuaacuucgcugcaggccaguccguagugucugucaagcuggccggaaauucgucauugugcccugugagcggaugggcgauauacaguaaagacaacuccauuagaaucggcucuaagggugauguuuuugugauuagggagccauucaucagcuguuccccguuagaaugccggaccuuuuuccugacacagggggcucuacucaaugacaaacauucaaacggaaccaucaaggaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaauccuggagaaacaauaucuugaggacucaggagagcgagugugccugcgugaacgggucguguuucaccgucaugacagauggaccaucugacggccaggcuuccuacaagaucuuucggauugaaaaagguaagaucgugaaaucaguggagaugaaugcccccaacuaucauuacgaagagugcaguuguuacccugauagcuccgagauuacuugcgucugccgcgacaauuggcacgggucuaacagaccauggguuagcuucaaucaaaaccucgaauaucagauaggauacaucuguucaggcauuuuuggcgauaauccgaggcccaacgacaagaccgggaguugcggaccuguguccagcaauggugcgaacggcguaaagggguucucuuuuaaauauggaaacggcguguggaucggucggacaaagucaaucaguagccgcaauggguucgagaugauuugggauccaaacggcuggaccggaacggacaauaacuuuuccauaaaacaggacaucgucggcauuaaggaauggucuggguacucggggagcuucgugcaacaucccgagcugacuggucuggauuguauccgaccuugcuucuggguugaacucauuagaggcaggccaaaagagaauacaaucuggaccuccgggucaaguauaucuuuuuguggagugaacagcgacacugucggcugguccuggcccgauggugcagaguuaccguucacaaucgacaaguga

SEQ ID NO: 142816 - RNA, 1410 nt, Artificial Sequence
  derived and/or modified sequence opt3 from neuraminidase__InfluenzaA__AEI86967
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugaugcuuuuguuauuagggagccauucaucagcuguuccccguuagaaugccggaccuuuuuccugacacagggggcccuacucaaugacaagcauucaaacggaaccaucaaagaucgcagucccuaucgaacucugaugagcuguccuauuggcgaggugccaucucccuacaacucccguuuugaaucagucgcauggagcgccagugcuugccacgacggcauaaauuggcuuacaaucgggauuucuggaccugauaacggugcaguggccguacugaaguauaauggcaucauaaccgacacgauuaaguccuggagaaacaauaucuugaggacucaagagagcgagugugcuugcguuaacgggucguguuucaccaucaugacagauggaccaucugacggccaggccuccuacaaaauuuuucggaucgaaaaggguaaaauugugaagucagucgagaugaaugcgcccaacuaucauuacgaagagugcaguuguuacccugauagcuccgagauaacuugcgugugccgcgacaauuggcacgggucuaacagaccaugggugagcuucaaucagaaccucgaauaucagaucggauacauuuguucaggcaucuuuggcgauaauccgaggcccaacgacaaaaccgggaguugcggaccugucuccagcaauggugcaaacggcguuaagggguucucuuuuaaguauggaaacggcguguggaucggucggacaaaaucaauuaguagccgcaagggguucgagaugauaugggauccaaauggcuggaccggaacggacaacaauuuuuccaucaaacaagacauuguaggcaucaacgaauggucuggguacucggggagcuucgugcagcaucccgagcugacuggucuggauuguauucgaccuugcuucugggucgaacucaucagaggcaggccaaaggagaauacaauauggaccuccgggucaaguaucucuuuuuguggagugaacagcgacacuguuggcugguccuggcccgauggugccgaguuaccguucacaauugacaaauga

SEQ ID NO: 142817 - RNA, 1410 nt, Artificial Sequence
  derived and/or modified sequence opt3 from neuraminidase__InfluenzaA__AEI86977
augaaccccaaucagaagaucauuaccauaggcagcgugugcaugacaaucgggauggccaaccugauucuccaaaucggaaauauuaucuccauauggaucucucacucaauucagcuugguaaccagaaucagaucggcacuuguaaccaaagugucauuacguacgagaauaacaccuggguuaaucagacauaugugaacaucagcaauacuaacuucgcugcagggcaguccguagugucugucaaacuggccggaaauucgucauugugcccugugagcggcugggcgauauacaguaaggacaacuccauuagaaucgguucuaaaggggauguuuuugugauuagggaaccauucaucagcuguuccccguuagagugccggaccuuuuuccugacacagggagcucuacucaaugacaagcauucaaacggcaccaucaaagaucgcagucccuaucgaacucugaugagcuguccuauuggcgaagucccaucucccuacaacucccguuuugagucaguggccuggagcgcaagugccugccacgacgggauaaauuggcuuacaaucggaauuucugguccugauaacggcgcuguagcaguucugaaguauaaugggaucauaaccgacacgauuaaguccuggagaaacaauaucuugaggacucaagaaagcgaguguaccugcgugaacggaucguguuucacagucaugacugauggcccaucugacggucaggccuccuacaaaaucuuuaagauugagaaagggaagaucgugaaaucaguggaaaugaaugcucccaacuaucauuacgaggaaugcaguuguuacccugauagcuccgagauuaccugcgucugccgggacaauuggcacggaucuaaccgcccauggguuagcuucaaucagaaccucgaguaucagauaggcuacaucuguucaggcauuuuuggggauaauccgagacccaacgacaagacaggaaguugcgguccuguguccagcaauggcgccaacgggguaaagggauucucuuuuaaauauggcaacgguguguggaucgggaggaccaagucaaucaguagccggaauggcuucgaaaugauuugggauccaaacggauggacgggcacugacaauaacuuuuccauaaaacaagacaucgucgggauuaaugaguggucuggauacucggguagcuucgugcagcaucccgaacugacaggccuggauuguauccgcccuugcuucuggguugagcucauucgagggagaccaaaggaaaacaccaucuggacuuccggaucaaguauaucuuuuuguggcgugaauagcgacacagucgguugguccuggcccgauggggcggaguuaccguucaccaucgacaaauga

SEQ ID NO: 142818 - RNA, 1410 nt, Artificial Sequence
  derived and/or modified sequence opt3 from neuraminidase__InfluenzaA__AEI86997
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaagaauggucuggguacucggggagcuucgugcagcaucccgagcugacuggucuggauuguauccgaccuugcuucuggguugaacucauuagaggcaggccaaaggagaauacaaucuggaccuccgggucaauaaucaguuuuuguggagugaacucugacacugucggcuggagcuggcccgauggugcagaguuaccguucacaauugacaaauga

SEQ ID NO: 142819 - RNA, 1410 nt, Artificial Sequence
  derived and/or modified sequence opt3 from neuraminidase__InfluenzaA__AEI87007
augaaccccaaucagaagaucauuaccauaggcagcgugugcaucacaauugggauggccaaccugauccuccaaauuggaaauaucauauccaucuggauuucucacucaauccagcuugguaaccagaaucagauugagacuuguaaccaaagugucaucacguacgaaaauaacaccuggguuaaucagacauaugugaacauaagcaauacuaacuucgcugcaggccaguccguagugucugucaaacuggccgggaauagcucauugugcccugugagcggaugggcgauuuacaguaaggacaacuccaucagaauuggcucuaaaggugauguuuuugugaucagggagccauucaucagcuguuccucauuagaaugccggaccuuuuuccugacacagggggcucuacucaaugacaagcauaguaacggaaccauuaaagaucgcagcccguaucgaacucugaugucuugucccauaggcgaggucccuuccccauacaacucacguuuugaaagcguggccuggagugcaucugccugccacgacggcaucuccuggcuuacaauugggaucagcggacccgauaauggugcuguagcaguucugaaguauaacggcauaauuaccgacacgaucaagucguggagaaauaacaucuugaggacucaagagucugagugugccugcgugaauggguccuguuucaccgucaugacagauggaccuucagacggccaggcuaguuacaaaauuuuucggaucgaaaaggguaaaauugugaagucgguggagaugaacgccccaaauuaucauuacgaagagugcuccuguuaccccgauucuagcgagauaacuugcgucugccgcgacaacuggcacgggucaaauagaccuuggguuaguuucaaccagaaucucgaauaucagaucggauacauuuguuccggcaucuuuggcgauaacccaaggccgaaugacaaaaccgggagcugcggacccgugucuucaaacggugcgaauggcguaaagggguucaguuuuaaguauggaaacggcguguggaucggucggacaaaaagcauuuccucucgcaacggguucgagaugauaugggauccuaauggcuggaccggaacggacaacaauuuuucgaucaagcaagacauugucggcaucaacgaauggagcggguacuccggaucauucgugcagcauccagagcugacuggucuggauuguauucgacccugcuucuggguugaacucaucagaggcaggccuaaagagaauacaauauggaccagugggucuagcaucuccuuuuguggagugaacucagacacugucggcuggagcuggccagauggugcagaguuacccuucacaauugacaaguga

SEQ ID NO: 142820 - RNA, 1410 nt, Artificial Sequence
  derived and/or modified sequence opt3 from neuraminidase__InfluenzaA__AEI87017
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauggcgacacugguggguggagcuggcccgauggcgcagaguuaccguucacaaucgacaaguga

SEQ ID NO: 142821 - RNA, 1410 nt, Artificial Sequence; identical to SEQ ID NO: 142725
  derived and/or modified sequence opt3 from neuraminidase__InfluenzaA__AEI87027

SEQ ID NO: 142822 - RNA, 1410 nt, Artificial Sequence; identical to SEQ ID NO: 142818
  derived and/or modified sequence opt3 from neuraminidase__InfluenzaA__AEI87037

SEQ ID NO: 142823 - RNA, 1410 nt, Artificial Sequence; identical to SEQ ID NO: 142802
  derived and/or modified sequence opt3 from neuraminidase__InfluenzaA__AEI87047

SEQ ID NO: 142824 - RNA, 1410 nt, Artificial Sequence
  derived and/or modified sequence opt3 from neuraminidase__InfluenzaA__AEI87057
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaagaauggucuggguacucggggagcuucgugcagcaucccgagcugacuggucuggauuguauccgaccuugcuucuggguugaacucauuagaggcaggccaaaggagaauacaaucuggaccuccgggucaaguauaucuuuuuguggagugaacagcgacacugucggcugguccuggcccgauggugcagaguuaccguucacaaucgacaaauga

SEQ ID NO: 142825 - RNA, 1410 nt, Artificial Sequence; identical to SEQ ID NO: 142273
  derived and/or modified sequence opt3 from neuraminidase__InfluenzaA__AEI87067

SEQ ID NO: 142826 - RNA, 1410 nt, Artificial Sequence
  derived and/or modified sequence opt3 from neuraminidase__InfluenzaA__AEI87077
augaaccccaaucagaagaucauuaccauaggcagcaucugcaugacaauugggauggccaaccugauccuccaaauuggaaauaucauauccaucuggauuucucacucaauccaguucgguaaccagaaucagauuggcacuuguaaccaaagugugaucacguacgagaauaacaccugggucaaucagacauauguuaacauaagcaauacuaacuuugcugcagggcaguccgugguaucugugaaacuugccggaaauucgucacugugcccugucagcggcugggcgauuuacaguaaggacaacuccaucagaauugguucuaaaggggauguguucguuaucagggaaccauuuaucagcuguuccccguuggagugccggaccuucuuuuuaacacagggagcucugcuaaaugacaagcauucaaacggcaccauuaaagaucgcagucccuaucgaacucucaugagcuguccuauaggcgaagugccaucucccuacaacucccguuucgagucagucgccuggagcgcaagugccugccacgacgggaucaauuggcugacaauuggaaucucugguccugauaacggcgcuguggcaguacuuaaguauaaugggauaauuaccgacacgaucaaguccuggagaaacaauauccugaggacucaagaaagcgagugugccugcguuaacggaucguguuuuaccauuaugacagauggcccaucugacggucaggcuuccuacaaaaucuuccggauugagaaggggaaaauagugaagucagucgaaaugaaugcccccaacuaucauuacgaggaaugcaguuguuacccugauagcuccgagaucacuugcgugugccgcgacaauuggcacggaucuaacagaccaugggugagcuuuaaucagaacuuggaguaucagauuggcuacaucuguucaggcaucuucggggauaauccgaggcccaacgacaaaaccggaaguugcgguccugucuccagcaauggcgcgaacgggguuaagggauuuucuuucaaguauggcaacgguguguggauugggcggacaaaaucaauaaguagccgcaagggcuuugaaaugaucugggauccaaauggauggaccggcacggacaacaauuucuccauuaaacaagacaucguagggauuaacgaguggucuggauacucggguagcuucgugcagcaucccgaacucacuggccuggauuguauccgaccuugcuuuugggucgagcugauaagagggaggccaaaggaaaauacaaucuggaccuccggaucaaguauuucuuucuguggcgugaacagcgacacuguugguugguccuggcccgauggggcagagcucccguuuacaaucgacaaauga

SEQ ID NO: 142827 - RNA, 1410 nt, Artificial Sequence
  derived and/or modified sequence opt3 from neuraminidase__InfluenzaA__AEI87087
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccuauaagcggaugggcgauuuacaguaaggacaacuccaucagaauuggcucuaaaggugauguguuuguuaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggugccaucucccuacaacucccguuuugaaucagucgccuggagcgcaagugccugccacgacggcaucaauuggcuuacaauugggaucucuggaccugauaacggugcuguggcaguacugaaguauaauggcauaauuaccgacacgaucaaguccuggagaaacaauaucuugaggacucaagagagcgagugugccugcguuaacgggucguguuucaccgugaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcaauggguucgagaugauaugggauccaaacggcuggaccggaacggacaauaacuuuuccaucaagcaagacauugugggcaucaaagaauggucuggguacucggggagcuucguccagcaucccgagcugacuggucuggauuguauucgaccuugcuucuggguggaacucaucagaggcaggccaaaggagaauacaauauggaccuccgggucaaucauuaguuuuuguucuguuaacagcgacacugugggaugguccuggcccgauggcgcagaguuaccguucacaaucgacaaauga

SEQ ID NO: 142828 - RNA, 1410 nt, Artificial Sequence; identical to SEQ ID NO: 142799
  derived and/or modified sequence opt3 from neuraminidase__InfluenzaA__AEI87097

SEQ ID NO: 142829 - RNA, 1410 nt, Artificial Sequence; identical to SEQ ID NO: 142799
  derived and/or modified sequence opt3 from neuraminidase__InfluenzaA__AEI87107

SEQ ID NO: 142830 - RNA, 1413 nt, Artificial Sequence
  derived and/or modified sequence opt3 from neuraminidase__InfluenzaA__AEI91968
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucgauggagccaacggcguuaaagguuucaguuauaaguacgggaauggcguguggaucggaagaacuaaauccaacaggcugcggaagggcuuugagaugauuugggaccccaauggguggacaaacaccgacagcgauuucucuguaaaacaggacguggucgcuauaacugauuggucaggauauagugguagcuuugugcagcacccugaacucacaggcuuagacugcaucaagccauguuucuggguugagcuggugcgcgggcuuccccgagaaaacaccacgauuuggaccuccggaucuucgaucagcuucugcggcgucaauuccgauacagccaacuggucauggccugacggugcagaguugccauuuacuauugauaaguga

SEQ ID NO: 142831 - RNA, 1410 nt, Artificial Sequence; identical to SEQ ID NO: 138754
  derived and/or modified sequence opt3 from neuraminidase__InfluenzaA__AEI91983

SEQ ID NO: 142832 - RNA, 1410 nt, Artificial Sequence; identical to SEQ ID NO: 141240
  derived and/or modified sequence opt3 from neuraminidase__InfluenzaA__AEI91984

SEQ ID NO: 142833 - RNA, 1410 nt, Artificial Sequence
  derived and/or modified sequence opt3 from neuraminidase__InfluenzaA__AEI92004
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcguauggcguaaagggguucucuuuuaaguacggaaacggcguguggaucggucggacaaaaucaaucaguagccgcaacggguucgagaugauuugggauccaaauggcuggaccggaacggacaacaauuuuuccauaaagcaagacaucgucggcauuaacgaauggucuggguauucggggagcuucgugcagcaucccgagcugacuggucuggauuguauccgaccuugcuucuggguugaacucauuagaggcaggccaaaagagaauacaaucuggaccuccgggucaaguauaucuuuuuguggagugaacagcgacacugucggcugguccuggcccgauggugcagaguuaccguucacaaucgacaaguga

SEQ ID NO: 142834 - RNA, 1413 nt, Artificial Sequence
  derived and/or modified sequence opt3 from neuraminidase__InfluenzaA__AEI92023
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagaaaauaauuacguacgagaacucuaccugggugaaucauacauaugucaacaucaauaacacuaauguuguggcaggggaagacaagaccucgguaacacuugccggaaacucaagccuguguaguauuuccggcugggcgaucuacaccaaagauaauucuaucagaauugguagcaagggggacguguucgucauaagggagccuuuuaucuccugcucacacuuggaaugucggacuuucuuuuuaacacaaggagcucugcuaaacgauaaacauaguaauggcaccgugaaggaccgcagcccauaucgagcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaauauaauggaauaauuacuggcaccaucaagagcuggaaaaagcagaucuugcguacacaggagucggagugcguguguaugaacgguucuugcuuuacuauuaugaccgaugggcccuccaauaaagccgcgucauacaagaucuucaagauugaaaaaggaaagguaacaaaaaguauagagcucaacgcaccuaauuuuuauuacgaagaguguagcugcuacccagacaccggcaucguuaugugugugugcagagauaacuggcauggcuccaauaggcccugggucucuuucaaccagaaucuggacuaucaaauuggguacaucugcagcggaguguuuggugauaacccucggccagaggacggcgaagggucauguaauccggugacggucgauggaacuaacggcguuaaggguuucaguuauaaauacgggaauggcguguggaucggacgcacaaaguccaacagacugaggaaaggcuuugagaugauuugggaccccaauggguggaccaacacugacagcgauuucucuguaaagcaggacguggucgccauaacagauuggucaggauauagugguagcuuugugcagcacccugaacucaccggcuuagacugcauccggccauguuucuggguugagcuggugcgcgggcuuccccgagaaaacacgaccauuuggacauccggaucuucgaucagcuucugcggcgucaauuccgauacugcuaacuggucauggccugacggugccgaguugccauuuaccauugauaaguga

SEQ ID NO: 142835 - RNA, 1410 nt, Artificial Sequence
  derived and/or modified sequence opt3 from neuraminidase__InfluenzaA__AEJ10403
augaaccccaaucagaagaucauuaccauaggcagcgugugcaucacaauugggauggccaaccugauccuccaaauuggaaauaucauauccaucuggauuucucacucaauccagcuugguaaccagaaucagauugagacuuguaaccaaagugucaucacguacgaaaauaacaccuggguuaaucagacauaugugaacauaagcaauacuaacuucgcugcaggccaguccguagugucugucaaacuggccggaaauucgucauugugcccugugagcggaugggcgauuuacaguaaggacaacuccaucagaauuggcucuaaaggugauguuuuugugaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggucccaucucccuacaacucccguuuugaaucaguggccuggagcgcaagugccugccacgacggcaucucuuggcuuacaauugggaucuccggaccugauaauggugcuguagcaguucugaaguauaacggcauaauuaccgacacgaucaagagcuggagaaauaacaucuugaggacucaagagucggagugugccugcgugaaugggucuuguuucaccgucaugacagauggaccauccgacggccaggcuucauacaaaauuuuucggaucgaaaaggguaaaauugugaagaguguggagaugaacgcccccaauuaucauuacgaagagugcagcuguuacccugauuccucugagauaacuugcgucugccgcgacaacuggcacgggagcaauagaccauggguuucauucaaccagaaucucgaauaucagaucggauacauuuguaguggcaucuuuggcgauaacccgaggcccaaugacaaaaccggguccugcggaccugugagcgcgaacggugcaaauggcguaaagggguucucuuuuaaguauggaaacggcguguggaucggucggacaaaaucaauuaguagccgcaacggguucgagaugauaugggauccaaauggcuggaccggaacggacaacaauuuuuccaucaagcaagacauugucggcaucaacgaauggucuggguacucggggagcuucgugcagcaucccgagcugacuggucuggauuguauucgaccuugcuucuggguugaacucaucagaggcaggccaaaagagaauacaauauggaccuccgggucaaguaucucuuuuuguggagugaacagcgacacugucggcugguccuggcccgauggugccgaguuaccguucacaauugacaaguga

SEQ ID NO: 142836 - RNA, 1410 nt, Artificial Sequence; identical to SEQ ID NO: 142802
  derived and/or modified sequence opt3 from neuraminidase__InfluenzaA__AEJ10413

SEQ ID NO: 142837 - RNA, 1410 nt, Artificial Sequence; identical to SEQ ID NO: 142824
  derived and/or modified sequence opt3 from neuraminidase__InfluenzaA__AEJ10423

SEQ ID NO: 142838 - RNA, 1410 nt, Artificial Sequence
  derived and/or modified sequence opt3 from neuraminidase__InfluenzaA__AEJ10433
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauauaggauaggauacaucuguucaggcauuuuuggcgauaauccgcggcccaacgacaaaaccgggaguugcggaccuguguccagcaauggugcgaacggcguaaagggguucucuuuuaaguauggaaacggcguguggaucggucgcacaaaaucaaucaguagccgaaauggguucgagaugauuugggauccaaacggcuggaccggaacggacaauaacuuuuccauaaagcaggacaucauuggcaucaaugaauggucuggguacucggggagcuucguccaacaucccgagcugacuggucuggauuguauuagaccuugcuucuggguggaacucaucaggggccggccaaaagagaacacaauauggaccuccgggucaaguaucucuuuuuguggaguuaauagcggcacuguggguugguccuggcccgacggggcagaguuaccguucacaauugauaaguga

SEQ ID NO: 142839 - RNA, 1410 nt, Artificial Sequence; identical to SEQ ID NO: 142273
  derived and/or modified sequence opt3 from neuraminidase__InfluenzaA__AEJ10443

SEQ ID NO: 142840 - RNA, 1410 nt, Artificial Sequence; identical to SEQ ID NO: 142273
  derived and/or modified sequence opt3 from neuraminidase__InfluenzaA__AEJ10453

SEQ ID NO: 142841 - RNA, 1410 nt, Artificial Sequence; identical to SEQ ID NO: 142725
  derived and/or modified sequence opt3 from neuraminidase__InfluenzaA__AEJ10463

SEQ ID NO: 142842 - RNA, 1410 nt, Artificial Sequence
  derived and/or modified sequence opt3 from neuraminidase__InfluenzaA__AEJ10473
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaaaaccuggguuaaccagacauaugugaauaucagcaacacuaauuucgcugcaggccaguccguagugucugucaagcuggccgggaacucgucauugugcccugugagcggaugggcgauauacaguaaagacaauuccauuagaaucggcucuaagggugauguuuuugugauuagggagccauucaucagcuguuccccguuagaaugccggaccuuuuuccugacacagggggcucuacucaacgacaaacauucaaauggaaccaucaaggaucgcagucccuaucgaacucugaugagcuguccuauuggcgaggucccaucucccuacaacucccguuuugaaucaguggccuggagcgcaagugccugccacgacggcauaaacuggcuuacaaucgggauuucuggaccugauaauggugcuguagcaguucugaaguauaacggcaucauaaccgacacgauuaaauccuggagaaauaacaucuugaggacucaagagagcgagugugccugcgugaaugggucguguuucaccgucaugacagauggaccaucugacggccaggcuuccuacaagaucuuucggauugaaaaagguaagaucgugaaaucaguggagaugaacgcccccaauuaucauuacgaagagugcaguuguuacccugauagcuccgagauuacuugcgucugccgcgacaacuggcacgggucuaauagaccauggguuagcuucaaccagaaucucgaauaucagauaggauacaucuguucaggcauuuuuggcgauaacccgaggcccaaugacaagaccgggaguugcggaccuguguccagcaacggugcgaauggcguaaagggguucucuuuuaaauauggaaacggcguguggaucggucggacaaagucaaucaguagccgcaacggguucgagaugauuugggauccaaauggcuggaccggaacggacaacaaauuuuccauaaagcaagacaucgucggcauuaaugaauggucuggguacucggguagcuucgugcagcaucccgagcugacuggacugaacuguauccgaccuugcuucuggguugaacucauuagaggcaggccaaaagagaauacaaucuggaccuccgggucaaguauaucuuuuuguggagugaacagcgauacugucggcugguccuggcccgacggugcagaguuaccguucacaaucgauaaguga

SEQ ID NO: 142843 - RNA, 1410 nt, Artificial Sequence; identical to SEQ ID NO: 142273
  derived and/or modified sequence opt3 from neuraminidase__InfluenzaA__AEJ10503

SEQ ID NO: 142844 - RNA, 1410 nt, Artificial Sequence; identical to SEQ ID NO: 138754
  derived and/or modified sequence opt3 from neuraminidase__InfluenzaA__AEJ10523

SEQ ID NO: 142845 - RNA, 1410 nt, Artificial Sequence; identical to SEQ ID NO: 138754
  derived and/or modified sequence opt3 from neuraminidase__InfluenzaA__AEJ10533

SEQ ID NO: 142846 - RNA, 1410 nt, Artificial Sequence; identical to SEQ ID NO: 138754
  derived and/or modified sequence opt3 from neuraminidase__InfluenzaA__AEJ10543

SEQ ID NO: 142847 - RNA, 1410 nt, Artificial Sequence; identical to SEQ ID NO: 138754
  derived and/or modified sequence opt3 from neuraminidase__InfluenzaA__AEJ10553

SEQ ID NO: 142848 - RNA, 1410 nt, Artificial Sequence; identical to SEQ ID NO: 141029
  derived and/or modified sequence opt3 from neuraminidase__InfluenzaA__AEJ10563

SEQ ID NO: 142849 - RNA, 1410 nt, Artificial Sequence; identical to SEQ ID NO: 141029
  derived and/or modified sequence opt3 from neuraminidase__InfluenzaA__AEJ10573

SEQ ID NO: 142850 - RNA, 1410 nt, Artificial Sequence; identical to SEQ ID NO: 141029
  derived and/or modified sequence opt3 from neuraminidase__InfluenzaA__AEJ10583

SEQ ID NO: 142851 - RNA, 1410 nt, Artificial Sequence
  derived and/or modified sequence opt3 from neuraminidase__InfluenzaA__AEJ36305
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaccaguagccgcaauggguucgagaugaucugggauccaaacggcuggacgggaacugacaauuccuuuucuauuaagcaagacauagucggcaucaacgaauggucgggguacagcggauccuucgugcagcaucccgagcugacaggucuggauuguauucgaccuugcuucuggguugaacucaucagaggcaggccaaaagagaauaccauuuggacuucagggaguucuaucagcuuuuguggagugaacuccgacacagucggcuggucauggcccgauggugcagaguuaccguucaccauagacaaguga

SEQ ID NO: 142852 - RNA, 1410 nt, Artificial Sequence; identical to SEQ ID NO: 138754
  derived and/or modified sequence opt3 from neuraminidase__InfluenzaA__AEJ37856

SEQ ID NO: 142853 - RNA, 1410 nt, Artificial Sequence; identical to SEQ ID NO: 138754
  derived and/or modified sequence opt3 from neuraminidase__InfluenzaA__AEJ37866

SEQ ID NO: 142854 - RNA, 1410 nt, Artificial Sequence; identical to SEQ ID NO: 138754
  derived and/or modified sequence opt3 from neuraminidase__InfluenzaA__AEJ37876

SEQ ID NO: 142855 - RNA, 1410 nt, Artificial Sequence; identical to SEQ ID NO: 142802
  derived and/or modified sequence opt3 from neuraminidase__InfluenzaA__AEJ37886

SEQ ID NO: 142856 - RNA, 1410 nt, Artificial Sequence
  derived and/or modified sequence opt3 from neuraminidase__InfluenzaA__AEJ37896
augaaccccaaucagaagaucauuaccauaggcagcgugugcaucacaauugggauggccaaccugauccuccaaauuggaaauaucauauccaucuggauuucucacucaauccagcuugguaaccagaaucagauugagacuuguaaccaaagugucaucacguacgaaaauaacaccuggguuaaucagacauaugugaacauaagcaauacuaacuucgcugcaggccaguccguagugucugucaaacuggccggaaauucgucauugugcccugugagcgggugggcgauuuacaguaaggacaacuccaucagaauuggcucuaaaggugauguuuuugugaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggucccaucucccuacaacucccguuuugaaucaguggccuggagcgcaagugccugccacgacggcaucucuuggcuuacaauugggaucuccggaccugauaauggugcuguagcaguucugaaguauaacggcauaauuaccgacacgaucaagagcuggagaaauaacaucuugaggacucaagagucggagugugccugcgugaaugggucuuguuucaccgucaugacagauggaccauccgacggccaggcuucauacaaaauuuuucggaucgaaaagggucgcauugugaaaaguguggagaugaacgcccccaauuaucauuacgaagagugcagcuguuacccugauuccucugagauaacuugcgucugcagagacaacuggcacgggagcaauaggccauggguuucauucaaccagaaucucgaauaucagaucggauacauuuguaguggcaucuuuggcgauaacccgcggcccaaugacaagaccggguccugcggaccugugagcucuaacggugcgaauggcguaaaaggguucucauuuaaguauggaaacggcguguggaucggucgcacaaagaguauuagcucccgaaacggguucgagaugauaugggauccaaauggcuggaccggaacggacaacaauuuuucuaucaaacaagacauugucggcaucaacgaauggucgggguacagcggauccuucgugcagcaucccgagcugacuggucuggauuguauuagaccuugcuucuggguugaacucaucaggggccggccaaaggagaauacaauauggaccucagggaguucuaucagcuuuuguggagugaacuccgacacugucggcuggucauggcccgauggugcagaguuaccguucacaauugacaaauga

SEQ ID NO: 142857 - RNA, 1410 nt, Artificial Sequence; identical to SEQ ID NO: 142802
  derived and/or modified sequence opt3 from neuraminidase__InfluenzaA__AEJ37906

SEQ ID NO: 142858 - RNA, 1410 nt, Artificial Sequence; identical to SEQ ID NO: 142802
  derived and/or modified sequence opt3 from neuraminidase__InfluenzaA__AEJ37916

SEQ ID NO: 142859 - RNA, 1410 nt, Artificial Sequence; identical to SEQ ID NO: 142802
  derived and/or modified sequence opt3 from neuraminidase__InfluenzaA__AEJ37926

SEQ ID NO: 142860 - RNA, 1410 nt, Artificial Sequence; identical to SEQ ID NO: 140656
  derived and/or modified sequence opt3 from neuraminidase__InfluenzaA__AEJ37936

SEQ ID NO: 142861 - RNA, 1410 nt, Artificial Sequence; identical to SEQ ID NO: 138754
  derived and/or modified sequence opt3 from neuraminidase__InfluenzaA__AEJ37946

SEQ ID NO: 142862 - RNA, 1410 nt, Artificial Sequence; identical to SEQ ID NO: 142802
  derived and/or modified sequence opt3 from neuraminidase__InfluenzaA__AEJ37956

SEQ ID NO: 142863 - RNA, 1410 nt, Artificial Sequence; identical to SEQ ID NO: 142802
  derived and/or modified sequence opt3 from neuraminidase__InfluenzaA__AEJ37966

SEQ ID NO: 142864 - RNA, 1410 nt, Artificial Sequence; identical to SEQ ID NO: 138754
  derived and/or modified sequence opt3 from neuraminidase__InfluenzaA__AEJ37976

SEQ ID NO: 142865 - RNA, 1410 nt, Artificial Sequence; identical to SEQ ID NO: 142802
  derived and/or modified sequence opt3 from neuraminidase__InfluenzaA__AEJ37986

SEQ ID NO: 142866 - RNA, 1410 nt, Artificial Sequence; identical to SEQ ID NO: 141426
  derived and/or modified sequence opt3 from neuraminidase__InfluenzaA__AEK21372

SEQ ID NO: 142867 - RNA, 1413 nt, Artificial Sequence; identical to SEQ ID NO: 142220
  derived and/or modified sequence opt3 from neuraminidase__InfluenzaA__AEK21383

SEQ ID NO: 142868 - RNA, 1410 nt, Artificial Sequence; identical to SEQ ID NO: 140656
  derived and/or modified sequence opt3 from neuraminidase__InfluenzaA__AEK21399

SEQ ID NO: 142869 - RNA, 1410 nt, Artificial Sequence; identical to SEQ ID NO: 138754
  derived and/or modified sequence opt3 from neuraminidase__InfluenzaA__AEK21409

SEQ ID NO: 142870 - RNA, 1410 nt, Artificial Sequence; identical to SEQ ID NO: 142725
  derived and/or modified sequence opt3 from neuraminidase__InfluenzaA__AEK21419

SEQ ID NO: 142871 - RNA, 1410 nt, Artificial Sequence; identical to SEQ ID NO: 142802
  derived and/or modified sequence opt3 from neuraminidase__InfluenzaA__AEK21429

SEQ ID NO: 142872 - RNA, 1410 nt, Artificial Sequence
  derived and/or modified sequence opt3 from neuraminidase__InfluenzaA__AEK21439
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccaagaaacaagacauagucggcaucaaugaauggucuggguacucggggagcuucgugcagcaucccgagcugacuggucuggauuguauucgaccuugcuucuggguugaacucaucagaggcaggccaaaggagaacacaauuuggaccuccgggucaaguaucucuuuuuguggagugaauagcgacacugucggcugguccuggcccgauggugcagaguuaccguucacaauagacaaauga

SEQ ID NO: 142873 - RNA, 1410 nt, Artificial Sequence; identical to SEQ ID NO: 142802
  derived and/or modified sequence opt3 from neuraminidase__InfluenzaA__AEK21449

SEQ ID NO: 142874 - RNA, 1410 nt, Artificial Sequence; identical to SEQ ID NO: 140656
  derived and/or modified sequence opt3 from neuraminidase__InfluenzaA__AEK21459

SEQ ID NO: 142875 - RNA, 1410 nt, Artificial Sequence; identical to SEQ ID NO: 142802
  derived and/or modified sequence opt3 from neuraminidase__InfluenzaA__AEK21469

SEQ ID NO: 142876 - RNA, 1410 nt, Artificial Sequence; identical to SEQ ID NO: 142802
  derived and/or modified sequence opt3 from neuraminidase__InfluenzaA__AEK21479

SEQ ID NO: 142877 - RNA, 1410 nt, Artificial Sequence; identical to SEQ ID NO: 138754
  derived and/or modified sequence opt3 from neuraminidase__InfluenzaA__AEK21489

SEQ ID NO: 142878 - RNA, 1410 nt, Artificial Sequence; identical to SEQ ID NO: 142470
  derived and/or modified sequence opt3 from neuraminidase__InfluenzaA__AEK28776

SEQ ID NO: 142879 - RNA, 1410 nt, Artificial Sequence
  derived and/or modified sequence opt3 from neuraminidase__InfluenzaA__AEK28787
augaaccccaaucagaagaucauuaccauaggcagcgugucccugacaaucucuacuauuugcuucuuuaugcagaucgccauucucaucacgaccgucacacuucacuucaaacaguacgaguuuuauucaccuccaaacaaucagguuaugcugugugaaccgacuauaaucgagagaaacauuaccgaaaucguguacuugacaaauaccacuauugagaaggaaaucugccccaaauuagcugaguauaggaacuggaguaagccucagugugacauaacaggguucgcaccauuuagcaaagauaauuccauucggcugucugccggaggugacaucuggguaacccgcgagcccuacgugucgugcgauccugacaaguguuaucaauucgcgcuaggccaggggacgacucucaacaauguccauucaaacaauaccgugcgagaucguacaccauacagaacucugcuuaugaacgaacugggaguucccuuucacuugggcaccaaacaggugugcauugcuuggagcaguuccucuugucaugacgguaaggccuggcuccacgucugcaucacaggggaugacaagaaugcaaccgccagcuucaucuauaacggaaggcugguggauuccguaguuucauggaguaaagagauucugcggacgcaggaaagcgagugugugugcauaaauggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuacccucgcuacccaggcguuagaugugugugcagggacaacuggaagggguccaaccggccgauaguagauauuaauaucaaagaccacagcaucgugucgucuuaugucuguuccggacuggugggcgacacgccccgcaagaacgauucaaguagcuccucucauugccuugacccuaauaacgaggaaggugggcacggaguuaaaggcugggcuuucgaugacggcaaugauguguggauggggcgaaccauuaacgagacaagcagauugggauacgagacuuuuaaggucaucgaagguuggucaaauccaaaaaguaagcugcagauuaacaggcaagugauaguagaccggggcaaucguuccggguauagcggaaucuucucuguugagggccgcucauguauuaacagaugcuuuuacguggaacuaaucaggggucggaaagaggaaaccgagguccucuggacaaguaauagcaucguggucuucugugggacuuccggcaccuauggaacaggcucuuggcccgauggggccgaccugaaccuuaugccuauuuga

SEQ ID NO: 142880 - RNA, 1410 nt, Artificial Sequence
  derived and/or modified sequence opt3 from neuraminidase__InfluenzaA__AEK28798
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcaacgcuucugggaaggcagauacuaaaauccucuuuauugaggaaggaaagaucgugcauacauccaccuuaucagguagcgcccaacacgucgaggaaugcaguugcuauccucgcuacccaggcguuagaugugugugcagggacaauuggaaggggucuaaccggccgauaguagauauuaauaucaaagaccacuccaucgugagcucguacgucuguucuggacuggugggcgacacgccccgcaagaacgauuccucaaguagcucccauugcucugacccuaauaacgaggaaggugggcacggaguuaaaggcugggcuuucgaugacggcaaugauguguggauggggcgaaccauuagcgagaagucaagacuuggauaugagacauuuaaagucaucgaagguuggaguaacccaaaguccaaauugcagauuaauaggcaagugauaguagaccggggcaaccguagcggguacucuggaaucuucucaguugagggcaagaguuguauuaaucgcugcuuuuauguggaacugaucagagguaggaaggaggaaacugagguccuauggaccagcaacuccaucguggucuucugugggacaucuggcacuuacggaaccggcucguggcccgauggggccgacauuaaucucaugccuauauga

SEQ ID NO: 142881 - RNA, 1410 nt, Artificial Sequence
  derived and/or modified sequence opt3 from neuraminidase__InfluenzaA__AEK28809
augaaccccaaucagaagaucauuaccauaggcagcgugucccugacaaucucuacuauuugcuucuuuaugcaaaucgccauucucaucacgaccgucacaguucacuucaaacaguacgaguuuaacucaccuccaaauaaccaggugaugcuuugugaaccgacuauaaucgagagaaauauuaccgaaaucguauaucugacaaacaccacuauugagaaggaaaucugccccaaauuggcugaguacaggaauuggaguaagccucagugugacauaacaggguucgcaccauuuagcaaagauaacuccauucgguuaucugccggaggugacaucugggugacccgcgagcccuaugucucgugcgauccugacaaguguuaccaauucgcgcugggccaggggacgacucuaaauaacgugcauucaaauaacaagguucgagaucguaccccauauagaacacuccugaugaaugaacuuggagugcccuuucaccugggcacuaaacaggucugcauugcuuggagcaguuccucuugucaugacgguaaggccugguugcacgugugcaucaccggggaugacaaaaacgcaacagccagcuucaucuacaauggaaggcucguagauuccguugugucauggaguaaggagauucugcggacccaggaaagcgagugugucugcauaaacggcacguguacuguggugaugacagacggcucugcuuccgggaaagcagauaccaagauccuguuuauugaggaaggaaagaucguccauacuucaacacucagcgguagugcccaacacguugaggaaugcucuugcuauccucgcuacccaggcgugagauguguaugcagggacaacuggaaaggguccaaucggccgauaguggauauuaacaucaaggaccacagcaucgucucgucuuacguguguuccggauuaguuggcgacacgccccgcaaaaaugauucaaguagcuccucucauugccuggacccuaacaaugaggaaggugggcacggagugaagggcugggcuuucgaugacggcaacgaugucuggauggggcgaaccauuagcgagaaaucaagacuuggauaugagaccuuuaaggugaucgaagguuggaguaauccaaaauccaaguugcagauuaacaggcagguaauaguugaccggggcaaucguagcggguacucuggaaucuucucaguggagggcaagaguuguauuaaccgcugcuuuuaugucgaacugaucagagguaggaaagaggaaacagaggugcuauggacuagcaauuccaucgucguguucugugggaccucuggcacauacggaacuggcucguggcccgauggggccgacauuaaccucaugccuauauga

SEQ ID NO: 142882 - RNA, 1410 nt, Artificial Sequence
  derived and/or modified sequence opt3 from neuraminidase__InfluenzaA__AEK28819
augaaccccaaucagaagaucauuaccauaggcagcgugucccugacaaucucuacuauuugcuucuuuaugcagaucgccauucucaucacgaccgucacacuucacuucaaacaguacgaguuuaacuauccuccaaauaaccagguuaugcugugugaaccgacuauaaucgagagaaauauuaccgaaaucguguacuugacaaacaccacuauugagaaggaaaucugccccaaauuagcugaguauaggaauuggucaaagccucagugugacauaacaggguucgcaccauuuaguaaagauaacagcauucggcuguccgccggaggugacaucuggguaacccgcgagcccuacgugucuugcgauccugacaaguguuaucaauucgcgcuaggccaggggacgacucucaauaacguccauucgaauaacaccgugcgagaacguacaccauacagaacucugcuuaugaaugagcugggaguucccuuucacuugggcaccaaacaggugugcauugcuuggucaagcaguuccugucaugaugguaaggccuggcuccacgucugcaucacaggggacgauaagaacgcaaccgccucuuucaucuauaauggaaggcugguggacagcguaguuuccuggucaaaagaaauucugcggacgcaggagagugagugugugugcauaaacggcacuuguacagucgugaugaccgauggcagcgcuucugggaaggcagacacuaaaauccucuuuauugaagagggaaagaucgugcauacauccaccuuaucagguagcgcccaacacgucgaagagugcaguugcuacccucgcuacccaggcguuagaugugugugcagggauaacuggaaggggucuaaucggccgauaguagacauuaacaucaaagaucacuccaucgugagcucguaugucuguucuggacuggugggcgacacgccccgcaagaaugacuccucaaguagcucccauugccuugauccuaacaaugaagagggugggcacggaguuaaaggcugggcuuucgacgauggcaacgacguguggauggggcgaaccauuucugaaaagagcagauugggauacgagacauuuaaagucaucgaggguuggucaaauccaaagaguaaacugcagauuaacaggcaagugauaguagaucggggcaaucguuccggguauagcggaaucuucucuguugaaggcaagucauguauuaaccgcugcuuuuacguggagcuaaucagagguaggaaggaagagacugagguccucuggaccaguaauagcaucguggucuucugugggacauccggcacuuauggaaccggcucuuggcccgacggggccgauauuaaccugaugccuauauga

SEQ ID NO: 142883 - RNA, 1410 nt, Artificial Sequence
  derived and/or modified sequence opt3 from neuraminidase__InfluenzaA__AEK28830
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaauuuagcugaguacaggaacuggaguaaaccucagugugacauaacaggguucgcaccauuuagcaaggauaauuccauucggcugucugccggaggugacaucuggguaacccgcgagcccuaugugucgugcgauccugacaaauguuaccaauucgcgcuaggccaggggacgacucucaacaauguccauucaaacaauaccgugcgaggacguacaccauauagaacucugcuuaugaacgaacugggcguucccuuucacuuggguaccaaacaggugugcauugcuuggagcaguuccucuugucaugaugggaaggccuggcuccacgucugcaucacaggagacgauaagaaugcaaccgccagcuucaucuacaacggcaggcugguggacuccguaguuucauggaguaaggagauucugcggacgcaggaaagcgagugugugugcauaaacggcacuuguacagucgugaugaccgaugggucugcuuccggaaaagcagacacuaagauccucuuuauugaggaagguaaaaucgugcauacaucaaccuuaagcggcagugcccaacacgucgaggaaugcucuugcuauccucgcuacccagggguuagaugugugugcagggauaauuggaagggauccaaccggccgauaguagacauuaauaucaaggaucacagcaucgugucgucuuacgucuguuccggccuggugggugacacgccccgcaaaaacgacucaaguagcuccucucauugccuugauccuaauaacgaggaagggggacacggcguuaagggcugggcuuucgacgaugggaaugacguguggaugggacgaaccauuagcgagaaaucaagauuggguuaugagacauuuaaggucaucgaaggcuggaguaacccaaaauccaagcugcagauuaauaggcaagugauaguagaucgggggaaccguagcggauacucuggcaucuucucaguugaggguaaaaguuguauuaaucgcugcuuuuauguggaacuaaucagagggaggaaggaggaaacugagguccucuggaccagcaacuccaucguggucuucuguggcacaucuggaacuuacggcaccgggucguggcccgacggagccgauauuaaucugaugccuauauga

SEQ ID NO: 142884 - RNA, 1410 nt, Artificial Sequence
  derived and/or modified sequence opt3 from neuraminidase__InfluenzaA__AEK28841
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacugucaauaacgugcauucaaauaacaccguucgaggacguacaccauauagaacucuccugaugaaugaacuuggcgugcccuuucaccuggguaccaagcaggucugcauugcuuggagcaguuccucuugucaugaugggaaagccugguugcacgugugcaucacaggagacgauaagaacgcaaccgccagcuucaucuacaauggcaggcucguagacuccguugugucauggaguaaagagauucugcggacgcaggaaagcgagugugucugcauaaacggcacuuguacaguggugaugaccgaugggucugcuuccggaaaggcagacacuaaaauccuguuuauugaggaagguaagaucguccauacaucaacccucagcggcagugcccaacacguugaggaaugcucuugcuauccucgcuacccaggggugagauguguaugcagggauaacuggaagggauccaaucggccgauaguggacauuaacaucaaagaucacagcaucgucucgucuuacguguguuccggcuuaguuggugacacgccccgcaagaaugacucaaguagcuccucucauugccuggauccuaacaaugaggaagggggacacggcgugaaaggcugggcuuucgacgaugggaacgacgucuggaugggacgaaccauuagcgagaagucaagacuugguuaugagacauuuaaagugaucgaaggcuggaguaaucauaaguccaaauugcagauuaacaggcagguaauaguugaucgggggaaucguagcggauacucuggcaucuucucaguggaggguaagaguuguauuaaccgcugcuuuuaugucgaacugaucagagggaggaaggaggaaacugaggugcuauggaccagcaauuccaucgucguguucuguggcacaucuggaacuuacggcaccgggucguggccagacggagccgaucucaaccugaugcccauuuga

SEQ ID NO: 142885 - RNA, 1410 nt, Artificial Sequence
  derived and/or modified sequence opt3 from neuraminidase__InfluenzaA__AEK28852
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagaagaauauuaccgaaaucguguauuugacaaacaccacuauugagaaagaaaucugccccaaguuagcugaguacagaaauuggaguaaaccucagugugacauaacaggguucgcaccauuuagcaaggauaacuccauuaggcugucugccggaggugacaucuggguaacccgggagcccuaugugucgugcgauccugacaaguguuaccaauucgcgcuaggccaggggacgacucucaauaacguccauucaaauaaccgcgugcgagaucguaccccauauagaacacugcuuaugaaugaacugggaguucccuuucacuugggcacuaaacaggugugcauugcuuggagcaguuccucuugucaugacgguaaggccuggcuccacgucugcaucaccggggaugacaaaaacgcaacagccagcuucaucuacaauggaaggcugguggauuccguaguuucauggaguaaggagauucugcggacccaggaaagcgagugugugugcauaaacggcacguguacugucgugaugacagacggcucugcuuccgggaaagcagauaccaagauccucuuuauugaggaaggaaagaucgugcauacuucaacauuaagcgguagugcccaacacgucgaggaaugcucuugcuauccucgcuacccaggcguuagaugugugugcagggacaacuggaaaggguccaaucggccgauaguagauauuaacaucaaggaccacagcaucgugucgucuuacgucuguuccggacuggugggcgacacccccaggaaaaaugauucaaguagcuccucucauugccuugacccuaacaaugaggaaggugggcacggaguuaagggcugggcuuucgaugacggcaacgauguguggauggggcgaacgauuagcgagaaaucaagauugggauaugagaccuuuaaggucaucgaagguuggaguaauccaaaauccaagcugcagauuaaccgccaggugauaguagaccggggcaaucguagcggguacucuggaaucuucucaguugagggcaagaguuguauuaaccgcugcuuuuauguggaacuaaucagagguaggaaagaggaaacagagguccucuggacuagcaauuccaucguggucuucugugggaccucuggcacauacggaacuggcucguggcccgauggggccgacauuaaccugaugccuauauga

SEQ ID NO: 142886 - RNA, 1410 nt, Artificial Sequence; identical to SEQ ID NO: 140500
  derived and/or modified sequence opt3 from neuraminidase__InfluenzaA__AEK28863

SEQ ID NO: 142887 - RNA, 1410 nt, Artificial Sequence
  derived and/or modified sequence opt3 from neuraminidase__InfluenzaA__AEK28874
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaaggugcgagaucguaccccauauagaacacugcuuaugaaugaacugggaguucccuuucacuugggcacuaaacaggugugcauugcuuggagcaguuccucuugucaugacgguaaggccuggcuccacgucugcaucaccggggaugacaaaaacgcaacagccagcuucaucuacaauggaaggcugguggauuccguaguuucauggaguaaggagauucugcggacccaggaaagcgagugugugugcauaaacggcacguguacugucgugaugacagacggcucugcuuccgggaaagcagauaccaagauccucuuuauugaggaaggaaagaucgugcauacuucaacauuaagcgguagugcccaacacgucgaggaaugcucuugcuauccucgcuacccaggcguuagaugugugugcagggacaacuggaaaggguccaaucggccgauaguagauauuaacaucaaggaccacagcaucgugucgucuuacgucuguuccggacuggugggcgacacccccaggaaaaaugauucaaguagcuccucucauugccuugacccuaacaaugaggaaggugggcacggaguuaagggcugggcuuucgaugacggcaacgauguguggauggggcgaacgauuagcgagaaaucaagauugggauaugagaccuuuaaggucaucgaagguuggaguaaucauaaauccaagcugcagauuaaccgccaggugauaguagaccggggcaaucguagcggguacucuggaaucuucucaguugagggcaagaguuguauuaaccgcugcuuuuauguggaacuaaucagagguaggaaagaggaaacagagguccucuggacuagcaauuccaucguggucuucugugggaccucuggcacauacggaacuggcucguggccagauggggccgaccugaaccuuaugcccauuuga

SEQ ID NO: 142888 - RNA, 1410 nt, Artificial Sequence
  derived and/or modified sequence opt3 from neuraminidase__InfluenzaA__AEK28885
augaaccccaaucagaagaucauuaccauaggcagcgugucccugacaaucucuacuauuugcuucuuuaugcagaucgccauucucaucacgaccgucacacuucacuucaaacaguacgaguuuaaccugccuccaaauaaccagguuauguugugugaaccgacuauaaucgagagaaauauuaccgaaaucguguauuuaacaaacaccacuauugagaaggaaaucugccccaaacuggcugaguacaggaauuggucaaagccucagugugacauaacaggguucgcaccauuuaguaaagauaacagcauucggcuauccgccggaggugacaucuggguaacccgcgagcccuaugugucuugcgauccugacaaguguuaccaauucgcgcucggccaggggacgacucugaauaacguccauucgaauaacaccgugcgagaucguacaccauauagaacucuucugaugaaugaauugggaguucccuuucaccucggcaccaaacaggugugcauugcuuggucaagcaguuccugucaugacgguaaggccuggcugcacgucugcaucacaggggaugacaagaacgcaaccgccucuuucaucuacaauggaaggcugguggauagcguaguuuccuggucaaaagagauucuccggacgcaggaaagugagugugugugcauaaacggcacuuguacagucgugaugaccgacggcagcgcuucugggaaggcagauacuaaaaucuuauuuauugaggaaggaaagaucgugcauacauccacccugucagguagcgcccaacacgucgaggaaugcaguugcuauccucgcuacccaggcguuagaugugugugcagggacaacuggaaggggucuaaucggccgauaguagauauuaacaucaaagaccacuccaucgugagcucguacgucuguucuggacuugugggcgacacgccccgcaagaaugauuccucaaguagcucccauugcuuggacccuaacaaugaggaaggugggcacggaguuaaaggcugggcuuucgaugacggcaacgauguguggauggggcgaaccauuucugaaaagagcagacugggauaugagacauuuaaagucaucgaggguuggucaaauccaaagaguaaacuacagauuaacaggcaagugauaguagaccggggcaaucguuccggguacagcggaaucuucucuguugagggcaagucauguauuaaccgcugcuuuuauguggaacucaucagagguaggaaggaggaaacugagguccuguggaccaguaauagcaucguggucuucugugggacauccggcacuuacggaaccggcucuuggcccgauggggccgacauuaaccuuaugccuauauga

SEQ ID NO: 142889 - RNA, 1410 nt, Artificial Sequence; identical to SEQ ID NO: 140625
  derived and/or modified sequence opt3 from neuraminidase__InfluenzaA__AEK28896

SEQ ID NO: 142890 - RNA, 1410 nt, Artificial Sequence
  derived and/or modified sequence opt3 from neuraminidase__InfluenzaA__AEK28907
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagaagaauauuaccgaaaucguguauuugacaaacaccacuauugagaaagaaaucugccccagauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaagucaagauugggauaugagacauuuaaagucaucgaagguuggaguaauccaaaguccaaacugcagauuaacaggcaagugauaguagaccggggcaaucguagcggguacucuggaaucuucucaguugagggcaagaguuguauuaaccgcugcuuuuauguggaacuaaucagagguaggaaggaggaaacugagguccucuggaccagcaauuccaucguggucuucugugggacaucuggcacuuacggaaccggcucguggcccgauggggccgacauuaaccugaugccuauauga

SEQ ID NO: 142891 - RNA, 1410 nt, Artificial Sequence; identical to SEQ ID NO: 138615
  derived and/or modified sequence opt3 from neuraminidase__InfluenzaA__AEK28918

SEQ ID NO: 142892 - RNA, 1410 nt, Artificial Sequence; identical to SEQ ID NO: 139921
  derived and/or modified sequence opt3 from neuraminidase__InfluenzaA__AEK28929

SEQ ID NO: 142893 - RNA, 1410 nt, Artificial Sequence
  derived and/or modified sequence opt3 from neuraminidase__InfluenzaA__AEK28951
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaagucaagaaguggauaugagacauuuaaagucaucgaagguugguccaaucauaagagcaaauugcagauuaacaggcaagugauaguagaccggggcaaucguucuggguacucaggaaucuucaguguugagggcaagagcuguauuaaccgcugcuuuuauguggaacugaucagagguaggaaggaggaaacugaggcccuauggaccuccaauucuaucgucguguucugugggacaucgggcacuuacggaaccggcagcuggccagauggggcggaccucaaccugaugcccauuuga

SEQ ID NO: 142894 - RNA, 1410 nt, Artificial Sequence
  derived and/or modified sequence opt3 from neuraminidase__InfluenzaA__AEK28962
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguaucccacaaacaccacuauugagaaggaaaucugcccuaaauuggcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccauuagcgagaagucaagacuuggauaugagacauuuaaagucaucgaagguuggaguaaucccaaguccaaauugcagauuaacaggcaagugauaguagaccggggcaaucguagcggguacucuggaaucuucucaguugagggcaagaguuguauuaaccgcugcuuuuauguggaacugaucagagguaggaaggaggaaacugagguccuauggaccagcaauuccaucguggucuucugugggacaucuggcacuuacggaaccggcucguggccugauggggccgacauuaaccucaugccaauauga

SEQ ID NO: 142895 - RNA, 1410 nt, Artificial Sequence
  derived and/or modified sequence opt3 from neuraminidase__InfluenzaA__AEK28973
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaagucaagauugggauaugagacauuuaaagucaucgaagguuggaguaaucauaaguccaaacugcagauuaacaggcaagugauaguagaccggggcaaucguagcggguacucuggaaucuucucaguugagggcaagaguuguauuaaccgcugcuuuuauguggaacuaaucagagguaggaaggaggaaacugagguccucuggaccagcaauuccaucguggucuucugugggacaucuggcacuuacggaaccggcucguggccagauggggccgaccugaacuucaugcccauuuga

SEQ ID NO: 142896 - RNA, 1410 nt, Artificial Sequence
  derived and/or modified sequence opt3 from neuraminidase__InfluenzaA__AEK28984
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccguacggcugucugccggaggugacauuugggugacccgcgagcccuaugucucgugcgauccugacaaguguuaccaauucgcgcuaggccaggggacgacucucaauaacgugcauucaaauaacaccguucgagaucguacaccauauagaacucugcuuaugaaugaacugggagugcccuuucacuugggcaccaagcaggucugcaucgcuuggagcaguuccucuugucaugacgguaaagccuggcuccacgugugcauuacaggggaugacaagaacgcaaccgccagcuucaucuacaauggaaggcugguagauuccguugugucauggaguaaagagauccugcggacgcaggaaagcgagugugucugcauuaacggcacuuguacaguggugaugaccgacggcucugcuuccgggaaggcagauacuaaaauacucuuuaucgaggaaggaaagauuguccauacaucaaccuuaagcgguagugcccaacacguugaggaaugcucuugcuauccucgcuacccaggcgugagauguguaugcagggacaacuggaagggguccaaucggccgaucguggauauaaacauuaaagaccacagcaucgucucgucuuacguguguuccggacugguuggcgacacgccccgcaagaaugauucaaguagcuccucucauugccuugacccuaacaaugaggaaggugggcacggagugaaaggcugggcuuucgaugacggcaacgaugucuggauggggcgaaccaucagcgagaagucaagauugggauaugagacauuuaaagugauugaagguuggaguaauccaaaguccaaacugcagaucaacaggcagguaauuguugaccggggcaaucguagcggguacucuggaauauucucaguggagggcaagaguuguaucaaccgcugcuuuuaugucgaacuaauuagagguaggaaggaggaaacugaggugcucuggaccagcaauuccaucgucguguucugugggacaucuggcacuuacggaaccggcucguggcccgauggggccgacaucaaccugaugccuauuuga

SEQ ID NO: 142897 - RNA, 1410 nt, Artificial Sequence; identical to SEQ ID NO: 142896
  derived and/or modified sequence opt3 from neuraminidase__InfluenzaA__AEK28995

SEQ ID NO: 142898 - RNA, 1410 nt, Artificial Sequence; identical to SEQ ID NO: 141534
  derived and/or modified sequence opt3 from neuraminidase__InfluenzaA__AEK29006

SEQ ID NO: 142899 - RNA, 1410 nt, Artificial Sequence
  derived and/or modified sequence opt3 from neuraminidase__InfluenzaA__AEK29028
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaacggcacuuguacagucgugaugaccgauggcucugcuuccgggaaggcagacacuaaaauccucuuuauugaggaaggaaagaucgugcauacaucaaccuuaagcgguagugcccaacacgucgaggaaugcucuugcuauccucgcuacccaggcguuagaugugugugcagggauaauuggaagggguccaaccggccgauaguagacauuaauaugaaagaucacagcaucgugucgucuuacgucuguuccggacuggugggcgacacgccccgcaagaacgacucaaguagcuccucucauugcuucgauccuaaugacgaggaaggugggcacggaguuaaaggcugggcuuuugaugacggcaacgauguguggauggggcgaaccaucagcgagaagucaagacuuggauaugagacauucaaagucauugaagguuggaguaauccaaaguccaaauugcagaucaacaggcaagugauuguagaccggggcaaucguagcggguacucuggaauauuuucaguugagggcaagaguuguaucaaccgcugcuucuauguggaacugauuagagguaggaaggaggaaacugagguccuauggaccagcaauuccaucguggucuucugugggacaucuggcacuuacggaaccggcucguggcccgauggggccgacaucaaccucaugccuauuuga

SEQ ID NO: 142900 - RNA, 1410 nt, Artificial Sequence
  derived and/or modified sequence opt3 from neuraminidase__InfluenzaA__AEK29050
augaaccccaaucagaagaucauuaccauaggcagcgugucccugacaaucucuacuauuugcuucuuuaugcagaucgccauucucaucacgaccgucacacuucacuucaaacaguacgaguuuaacccuccaccgaauaaccagguuaugcugugugaacccacuauaaucgagagaaauauuaccgaaaucguguauuugacaaacaccacuauugagaaggaaaucugcccuaaauuagcugaguacaggaauuggucaaagccacagugugacauaacaggguucgcacccuuuaguaaagauaacagcauucggcuguccgccggaggugacaucuggguaacccgcgagccuuaugugucuugcgauccagacaaguguuaccaauucgcgcuaggccaggggacgacucucaauaacguccauucgaauaacaccgugcgagaucguacacccuauagaacucugcuuaugaaugaacugggaguuccuuuucacuugggcaccaaacaggugugcauugcuuggucaagcaguuccugucaugacgguaaggccuggcuccacgucugcaucacaggggaugacaagaacgcaaccgccucuuucaucuacaauggaaggcugguggauagcguaguuuccuggucaaaagagauucugcggacgcaggaaagugagugugugugcauaaacggcacuuguacagucgugaugaccgacggcagcgcuucugggaaggcagauacuaaaauccucuuuauugaggaaggaaagaucgugcauacauccaccuuaucagguagcgcccaacacgucgaggaaugcaguugcuauccacgcuacccgggcguuagaugugugugcagggacaacuggaaggggucuaaucggcccauaguagauauuaacaucaaagaccacuccaucgugagcucguacgucuguucuggacuggugggcgacacgccucgcaagaaugauuccucaaguagcucccauugccuugacccaaacaaugaggaaggugggcacggaguuaaaggcugggcuuucgaugacggcaacgauguguggauggggcgaaccauuaaugagacaucuagauugggauaugagacuuuuaaggucaucgaagguuggagcaaccccaaaucaaagcugcagauuaauaggcaagugauaguagaccggggcaaccguaguggguacuccggaaucuucagcguugagggcaaaucuuguauuaaucgcugcuuuuauguggaacuaaucagagguaggaaggaggaaaccgagguccucuggacaucaaacaguaucguggucuucugugggacuagcggcaccuacggaacaggcuccuggccugauggggccgaccugaaucuuaugccaauuuga

SEQ ID NO: 142901 - RNA, 1410 nt, Artificial Sequence
  derived and/or modified sequence opt3 from neuraminidase__InfluenzaA__AEK29061
augaaccccaaucagaagaucauuaccauaggcagcgugucccugacaaucucuacuauuugcuucuuuauccaaauugccauccucauaacgaccgucacacuucacuucaaacaguacgaguuuaacucaccuccaaauaaccagguuaugcugugugaaccgacuaucauugagaagaauaucaccgaaauuguguauuugacaaacaccacuaucgagaaagaaauaugccccaaguuagcugaguacagaaauuggaguaaaccucagugugacauuacaggguucgcaccauuuagcaaggauaacuccaucaggcugucugccggaggugacauuuggguaacccgggagcccuaugugucgugcgauccugacaaguguuaccaauucgcgcuaggccaggggacgacucucaauaacguccauucaaauaacaucgugcgcgaucgaaccccauaucguacacugcuuaugaaugaacugggaguucccuuucacuugggcacuaaacaggugugcaucgcuuggagcaguuccucuugucaugacgguaaggccuggcuccacgucugcauuaccggggaugacaaaaacgcaacagccagcuucauauacaauggaagacugguggauuccguaguuucauggaguaaggagauccugaggacccaggaaagcgagugugugugcauuaacggcacguguacugucgugaugacagacggcucugcuuccgggaaagcagauaccaagauccucuuuauagaggaaggaaagauugugcauacuucaacauuaagcgguagugcccaacacgucgaggaaugcucuugcuauccucgguacccaggcguucgcugugugugcagagacaacuggaaaggguccaauaggccgaucguagauaucaacauuaaggaccacagcaucgugucgucuuacgucuguuccggacuggugggcgacacgccccggaaaaaugauucaaguagcuccucucauugccuugacccuaacaaugaggaaggugggcacggaguuaagggcugggcuuucgaugacggcaacgauguguggauggggcgcaccauuaaugagaccagccgauugggauaugagacauuuaaagucauagaagguuggucaaacccaaagaguaaacugcagaucaauagacaggugauuguagacaggggcaaccgguccggguacagcggaaucuucucuguugagggcaagucauguaucaaucguugcuuuuauguggaacuaauucgcgguagaaaggaggaaacugagguccucuggaccaguaacagcauaguggucuucugugggacauccggcacuuacggaaccggcucuuggcccgauggggccgaccugaaucuuaugccuaucuga

SEQ ID NO: 142902 - RNA, 1410 nt, Artificial Sequence
  derived and/or modified sequence opt3 from neuraminidase__InfluenzaA__AEK29083
augaaccccaaucagaagaucauuaccauaggcagcgugucccugacaaucucuacuauuugcuucuuuauccaaauugccauccucauaacgaccgucacacuucacuucaaacaguacgaguuuaacucaccuccaaauaaccagguuaugcugugugaaccgacuaucauugagaagaauaucaccgaaauuguguauuugacaaacaccacuaucgagaaagaaauaugccccaaguuagcugaguacagaaauuggaguaaaccucagugugacauuacaggguucgcaccauuuagcaaggauaacuccaucaggcugucugccggaggugacauuuggguaacccgggagcccuaugugucgugcgauccugacaaguguuaccaauucgcgcuaggccaggggacgacucucaauaacguccauucaaauaacaccgugcgcgaucgaacaccauaucguacucugcuuaugaaugaacugggaguucccuuucacuugggcaccaaacaggugugcaucgcuuggagcaguuccucuugucaugacgguaaggccuggcuccacgucugcaucacaggggaugacaaaaacgcaaccgccagcuucauuuacaauggaagacugguggauuccguaguuucauggaguaaggagauacugaggacgcaggaaagcgagugugugugcaucaacggcacuuguacagucgugaugaccgacggcucugcuuccgggaaagcagauacuaagauucucuuuaucgaggaaggaaagauagugcauacaucaaccuuaagcgguagugcccaacacgucgaggaaugcucuugcuauccucgguacccaggcguucgcugugugugcagagacaacuggaaaggguccaauaggccgauuguagauaucaacaucaaggaccacagcauugugucgucuuacgucuguuccggacuggugggcgacacgccccggaaaaaugauucaaguagcuccucucauugccuugacccuaacaaugaggaaggugggcacggaguuaagggcugggcuuucgaugacggcaacgauguguggauggggcgcaccaucaaugagacaagccgauugggauaugagacuuuuaaagucauugaagguuggucaaacccaaagaguaaacugcagauaaauagacaggugaucguagacaggggcaaccgguccggguacagcggaauuuucucuguugagggcaagucauguaucaaucguugcuuuuauguggaacuaauccgcgguagaaaggaggaaaccgagguccucuggacaaguaacagcauuguggucuucugugggacuuccggcaccuacggaacaggcucuuggcccgauggggccgaccugaaucuuaugccuauauga

SEQ ID NO: 142903 - RNA, 1410 nt, Artificial Sequence; identical to SEQ ID NO: 141426
  derived and/or modified sequence opt3 from neuraminidase__InfluenzaA__AEK29094

SEQ ID NO: 142904 - RNA, 1410 nt, Artificial Sequence; identical to SEQ ID NO: 141534
  derived and/or modified sequence opt3 from neuraminidase__InfluenzaA__AEK29127

SEQ ID NO: 142905 - RNA, 1410 nt, Artificial Sequence; identical to SEQ ID NO: 141534
  derived and/or modified sequence opt3 from neuraminidase__InfluenzaA__AEK29138

SEQ ID NO: 142906 - RNA, 1410 nt, Artificial Sequence
  derived and/or modified sequence opt3 from neuraminidase__InfluenzaA__AEK29182
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuaaugagacaagcagauugggauaugagacuuuuaaggucaucgaagguuggucaaacccaaaaaguaagcuacaggugaauaggcagguaauuguugaccggggcaaccguuccggguacagcggaauauucucuguggagggcaaaucauguaucaaucgcugcuuuuaugucgaacugauuagagguaggaaggaggaaaccgaggugcucuggacaaguaacagcaucgucguguucugugggacuuccggcaccuacggaacaggcucuuggcccgauggggccgaccugaaucuuaugccuaucuga

SEQ ID NO: 142907 - RNA, 1410 nt, Artificial Sequence
  derived and/or modified sequence opt3 from neuraminidase__InfluenzaA__AEK29204
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcaaacacuaaagugcucuuuaucgaggaaggaaagauuguccauacaucaaccuuaagcgguagugcccaacacguugaggaaugcucuugcuauccucgcuacccaggcgugagauguguaugcagggauaauuggaagggguccaaccggccgaucguggacauaaauauuaaagaucacagcaucgucucgucuuacguguguuccggacugguuggcgacacgccccgcaagaacgacucaaguagcuccucucauugccuugauccuaauaacgaggaaggugggcacggagugaaaggcugggcuuucgacgauggcaaugacgucuggauggggcgaaccaucaacgagacaagcagauugggauaugagacuuuuaaggugauugaagguuggucaaauccaaaaaguaagcugcagaucaacaggcagguaauuguugaucggggcaaucguuccggguacagcggaauauucucuguggagggcaaaucauguaucaaccgcugcuuuuaugucgaacuaauuagagguaggaaggaggaaaccgaggugcucuggacaaguaauagcaucgucguguucugugggacuuccggcaccuacggaacaggcucuuggcccgacggggccgaucugaaccuuaugccuaucuga

SEQ ID NO: 142908 - RNA, 1410 nt, Artificial Sequence
  derived and/or modified sequence opt3 from neuraminidase__InfluenzaA__AEK29215
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgaaaucguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaacggcacuuguacagucgugaugaccgauggcucugcuuccgggaaggcagacacuaaaauccucuuuauugaggaaggaaagaucgugcauacaucaaccuuaagcgguagugcccaacacgucgaggaaugcucuugcuauccucgcuacccaggcguuagaugugugugcagggauaauuggaagggguccaaccggccgauaguagacauuaauaucaaagaucacagcaucgugucgucuuacgucuguuccggacuggugggcgacacgccccgcaagaacgacucaaguagcuccucucauugccuugauccuaauaacgaggaaggugggcacggaguuaaaggcugggcuuucgacgauggcaaugacguguggauggggcgaaccauuaacgagacaagcagauugggauaugagacuuuuaaggucaucgaagguuggucaaauccaaaaaguaagcugcagauuaacaggcaagugauaguagaucggggcgaccguuccggguacagcggaaucuucucuguugagggcaaaucauguauuaaucgcugcuuuuauguggaacuaaucagagguaggaaggaggaaaccgagguccucuggacaaguaacagcaucguggucuucugugggacuuccggcaccuacggaacaggcucuuggcccgauggggccgaccugaaucuuaugccuauuuga

SEQ ID NO: 142909 - RNA, 1410 nt, Artificial Sequence; identical to SEQ ID NO: 142907
  derived and/or modified sequence opt3 from neuraminidase__InfluenzaA__AEK29237

SEQ ID NO: 142910 - RNA, 1410 nt, Artificial Sequence; identical to SEQ ID NO: 141534
  derived and/or modified sequence opt3 from neuraminidase__InfluenzaA__AEK29248

SEQ ID NO: 142911 - RNA, 1410 nt, Artificial Sequence; identical to SEQ ID NO: 141534
  derived and/or modified sequence opt3 from neuraminidase__InfluenzaA__AEK29259

SEQ ID NO: 142912 - RNA, 1410 nt, Artificial Sequence; identical to SEQ ID NO: 141534
  derived and/or modified sequence opt3 from neuraminidase__InfluenzaA__AEK29270

SEQ ID NO: 142913 - RNA, 1413 nt, Artificial Sequence
  derived and/or modified sequence opt3 from neuraminidase__InfluenzaA__AEK59839
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggcuuggauggcugacgauugguaucuccggcccagacaacggggccguggcugucuugaaauauaacggaauaauuacuggcaccaucaagagcuggaaaaagcagauccucagaacacaggaaucggagugcguguguaugaaugguucuugcuuuacuauuaugaccgaugggcccuccaacggagccgcgucauacaaaaucuucaagauugagaagggcaaaguaacaaagaguauagaacugaaugcaccuaacuuucacuaugaggaauguagcugcuacccagacaccggcaucguuaugugugugugcagggauaauuggcacggguccaaccggcccugggucucuuucaaucagaaccuggacuaccaaauuggauauaucugcagcgguguguuuggcgauaauccucgcccaaaagacggggagggaucauguaacccggugacggucgauggcgccgacgguguuaagggguucaguuacaaauaugacaauggcguguggaucggaagaacuaaguccaacaggcuccggaaaggcuuugagaugauuugggaucccaauggguggacaaacaccgacagcgauuucucuguaaagcaggacguggucgcuauaacugauuggucaggauacagugguagcuuugugcagcauccugaauuaacaggccuggacugcauccgcccauguuucuggguugagcuugugcgaggguugcccagagaaaauaccacgauuuggaccuccggaucuucgaucagcuucugcggcgucaacuccgauacagccaacuggucauggccugacggugcagagcugccauuuacuauugauaaguga

SEQ ID NO: 142914 - RNA, 1410 nt, Artificial Sequence
  derived and/or modified sequence opt3 from neuraminidase__InfluenzaA__AEK98375
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccggggaggcagacacuaagauucucuuuaucgaagagggaaaaauagugcauacaucaaccuuaagcgguagugcccaacacguggaagagugcucuugcuauccucgcuacccaggcgucagauguguuugcagggauaacuggaagggguccaaccggccgauuguggacaucaauaucaaggaccacagcauuguaucgucuuacguguguuccggacuggucggcgauacgccccgcaaaaacgacucaaguagcuccucucauugccuugauccuaauaacgaagagggugggcacggagugaagggcugggcuuucgacgauggcaaugacguuuggauggggcgaaccaucagcgagaaaucaagauugggauaugaaacauuuaaggugauugaggguuggaguaacccaaaauccaagcugcagacuaauaggcaggucauaguggaucggggcaaccguagcggguacucuggaaucuucucaguagaaggcaaaaguuguauuaaucgcugcuuuuauguugagcuaaucagagguaggaaggaagagaccgaggugcucuggacaagcaacuccaucgucguguucugugggacuucuggcaccuacggaacaggcucguggcccgacggggccgauauuaaucugaugccuauauga

SEQ ID NO: 142915 - RNA, 1410 nt, Artificial Sequence; identical to SEQ ID NO: 138615
  derived and/or modified sequence opt3 from neuraminidase__InfluenzaA__AEK98377

SEQ ID NO: 142916 - RNA, 1410 nt, Artificial Sequence; identical to SEQ ID NO: 138057
  derived and/or modified sequence opt3 from neuraminidase__InfluenzaA__AEK98379

SEQ ID NO: 142917 - RNA, 1410 nt, Artificial Sequence
  derived and/or modified sequence opt3 from neuraminidase__InfluenzaA__AEK98381
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugauggugaggccuggcuccacgucugcaucacaggggacgauaagaaugcaaccgccagcuucaucuacaacggaaggcugguggacuccauuguaucauggaguaaggaaauacugcggacgcaggagagcgaguguguuugcaucaauggcacuuguacaguggucaugaccgauggcucugcuuccggggaagcagacacuaaaauucucuuuaucgaggaaggaaagauagugcauacaucaaccuuaagcgguagugcccaacacguggaggaaugcucuugcuauccucgcuacccaggcgucagauguguuugcagggauaacuggaaaggguccaaccggccgauuguggacaucaauaucaaggaccacagcauuguaucgucuuacguguguuccggacuggucggcgauacgccccgcaagaacgacucaaguagcuccucucauugccuugauccuaauaacgaggagggugggcacggagugaaaggcugggcuuucgacgauggcaaugacguuuggauggggcgaaccaucagcgaaaagucaagauugggauaugagacauuuaaagugauugaagguuggaguaacccaaaguccaaacugcagauaaauaggcaggucaucguggaucggggcaaccguagcggguacucuggaauuuucucaguagagggcaagaguuguaucaaucgcugcuuuuauguugaacuaaucagagguaggaaagaggagacugaagugcucuggaccagcaacuccauugucguguucugugggacaucuggcacuuacggaaccggcucguggcccgacggggccgauauaaaucugaugccuaucuga

SEQ ID NO: 142918 - RNA, 1410 nt, Artificial Sequence; identical to SEQ ID NO: 138057
  derived and/or modified sequence opt3 from neuraminidase__InfluenzaA__AEK98383

SEQ ID NO: 142919 - RNA, 1410 nt, Artificial Sequence; identical to SEQ ID NO: 138615
  derived and/or modified sequence opt3 from neuraminidase__InfluenzaA__AEK98385

SEQ ID NO: 142920 - RNA, 1410 nt, Artificial Sequence
  derived and/or modified sequence opt3 from neuraminidase__InfluenzaA__AEK98387
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugauugauuccgugguaucauggaguaaagagauacugcggacgcaggaaagcgaguguguuugcaucaacggcacuuguacaguggucaugaccgacggcucugcuuccgggaaggcagauacuaaaauucucuuuaucgaggaaggaaagauagugcauacaucaaccuuaagcgguagugcccaacacguggaggaaugcucuugcuauccucgcuacccaggcgucagauguguuugcagggacaacuggaagggguccaaucggccgauuguggauaucaacaucaaagaccacagcauuguaucgucuuacguguguuccggacuggucggcgacacgccccgcaagaaugauucaaguagcuccucucauugccuugacccuaacaaugaggaaggugggcacggagugaaaggcugggcuuucgaugacggcaacgauguuuggauggggcgaaccaucaaugagacaagcagauugggauaugagacuuuuaaggugauugaagguuggucaaacccaaaaaguaagcugcagauaaauaggcaggucaucguggaccggggcaaccguuccggguacagcggaauuuucucuguagagggcaaaucauguaucaaucgcugcuuuuauguugaacuaaucagagguaggaaggaggaaaccgaggugcucuggacaaguaacagcauugucguguucugugggacuuccggcaccuacggaacaggcucuuggcccgauggggccgaccugaaucuuaugccuauauga

SEQ ID NO: 142921 - RNA, 1410 nt, Artificial Sequence; identical to SEQ ID NO: 138615
  derived and/or modified sequence opt3 from neuraminidase__InfluenzaA__AEK98389

SEQ ID NO: 142922 - RNA, 1410 nt, Artificial Sequence
  derived and/or modified sequence opt3 from neuraminidase__InfluenzaA__AEK98393
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgcuucgucuuacguguguuccggacuggucggcgacacgccccgcaagaaugauucaaguagcuccucucauugccuugacccuaacaaugaggaaggugggcacggagugaaaggcugggccuucgaugacggcaacgauguuuggauggggcgaaccauuaaugagacaagcagauugggauaugagacuuuuaaggugaucgaagguuggucaaacccaaaaaguaagcugcagauuaauaggcaggucauaguggaccggggcaaccguuccggguacagcggaaucuucucuguagagggcaaaucauguauuaaucgcugcuuuuauguugaacuaaucagagguaggaaggaggaaaccgaggugcucuggacaaguaacagcaucgucguguucugugggacuuccggcaccuacggaacaggcucuuggcccgauggggcggaccugaaucuuaugccuauuuga

SEQ ID NO: 142923 - RNA, 1410 nt, Artificial Sequence; identical to SEQ ID NO: 141534
  derived and/or modified sequence opt3 from neuraminidase__InfluenzaA__AEK98395

SEQ ID NO: 142924 - RNA, 1410 nt, Artificial Sequence
  derived and/or modified sequence opt3 from neuraminidase__InfluenzaA__AEK98397
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaacggcacuuguacagucgugaugaccgauggcucugcuuccgggaaggcagacacuaaaauccucuuuauugaggaaggaaagaucgugcauacaucaaccuuaagcgguagugcccaacacgucgaggaaugcucuugcuauccucgcuacccaggcguuagaugugugugcagggauaauuggaagggguccaaccggccgauaguagacauuaauaugaaagaucacagcaucgugucgucuuacgucuguuccggacuggugggcgacacgccccgcaagaacgacucaaguagcuccucucauugccuugauccuaauaacgaggaaggugggcacggaguuaaaggcugggcuuucgacgauggcaaugacguguggauggggcgaaccaucagcgagaagucaagauugggauaugagacauuuaaagucauugaagguuggaguaacccaaaguccaaacugcagaucaauaggcaagugauuguagaucggggcaaccguagcggguacucuggaauauucucaguugagggcaagaguuguaucaaucgcugcuuuuauguggaacuaauuagagguaggaaggaggaaacugagguccucuggaccagcaacuccaucguggucuucugugggacaucuggcacuuacggaaccggcucguggcccgacggggccgauaucaauuucaugccuauuuga

SEQ ID NO: 142925 - RNA, 1410 nt, Artificial Sequence; identical to SEQ ID NO: 138615
  derived and/or modified sequence opt3 from neuraminidase__InfluenzaA__AEK98399

SEQ ID NO: 142926 - RNA, 1410 nt, Artificial Sequence; identical to SEQ ID NO: 138528
  derived and/or modified sequence opt3 from neuraminidase__InfluenzaA__AEK98403

SEQ ID NO: 142927 - RNA, 1410 nt, Artificial Sequence
  derived and/or modified sequence opt3 from neuraminidase__InfluenzaA__AEK98405
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccauuguaucauggaguaaagagauacugcggacgcaggaaagcgaguguguuugcaucaacggcacuuguacaguggucaugaccgacggcucugcuuccgggaaggcagauacuaaaauucucuuuaucgaggaaggaaagauagugcauacaucaaccuuaagcgguagugcccaacacguggaggaaugcucuugcuauccucgcuacccaggcgucagauguguuugcagggacaacuggaagggguccaaucggccgauuguggauaucaacaucaaagaccacagcauuguaucgucuuacguguguuccggacuggucggcgacacgccccgcaagaaugauucaaguagcuccucucauugccuugacccuaacaaugaggaaggugggcacggagugaaaggcugggcuuucgaugacggcaacgauguuuggauggggcgaaccaucagcgagaagucaagauugggauaugagacauuuaaagugauugaagguuggaguaauccaaaguccaaacugcagauaaacaggcaggucaucguggaccgggauaaucguagcggcuacucugggauuuucucaguagagggaaagaguuguaucaaccgcugcuuuuauguugaacuaaucagaggcaggaaggaggaaacugaggugcucuggaccagcaauuccauugucguguucugugguacaucugggacuuacggcaccggaucguggcccgacggcgccgauauaaaccugaugccuaucuga

SEQ ID NO: 142928 - RNA, 1410 nt, Artificial Sequence
  derived and/or modified sequence opt3 from neuraminidase__InfluenzaA__AEK98407
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgaguucguacaccauauagaacucugcuuaugaaugaacugggagugcccuuucacuugggcaccaagcaggucugcauugcuuggagcaguuccucuugucaugaugguaaagccuggcuccacgugugcaucacaggggacgauaagaacgcaaccgccagcuucaucuacaauggaaggcugguagacuccauuguuucauggaguaaagagauacugcggacgcaggaaagcgagugugugugcaucaacggcacuuguacagucgugaugaccgauggcucugcuuccgggaaggcagacacuaaaauucucuuuaucgaggaaggaaagauagugcauacaucaaccuuaagcgguagugcccaacacgucgaggaaugcucuugcuauccucgcuacccaggcguuagaugugugugcagggauaacuggaagggguccaaucggccgauuguagacaucaacaucaaagaucacagcauugugucgucuuacgucuguuccggacuggugggcgacacgccccgcaagaaugacucaaguagcuccucucauugccuugauccuaacaaugaggaaggugggcacggaguuaaaggcugggcuuucgacgauggcaacgacguguggauggggcgaaccaucagcgagaagucaagauugggauaugagacauuuaaagucauugaagguuggaguaauccaaaguccaaacugcagauaaacaggcaagugaucguagaucgggacaaucguagcggcuacucugggauuuucucaguugagggaaagaguuguaucaaccgcugcuuuuauguggaacuaaucagaggcaggaaggaggaaacugagguccucuggaccagcaauuccauuguggucuucugugguacaucugggacuuacggcaccggaucguggcccgauggcgccgacauaaaccugaugccuaucuga

SEQ ID NO: 142929 - RNA, 1410 nt, Artificial Sequence; identical to SEQ ID NO: 136343
  derived and/or modified sequence opt3 from neuraminidase__InfluenzaA__AEL11690

SEQ ID NO: 142930 - RNA, 1410 nt, Artificial Sequence; identical to SEQ ID NO: 141029
  derived and/or modified sequence opt3 from neuraminidase__InfluenzaA__AEL89300

SEQ ID NO: 142931 - RNA, 1410 nt, Artificial Sequence; identical to SEQ ID NO: 141029
  derived and/or modified sequence opt3 from neuraminidase__InfluenzaA__AEL89310

SEQ ID NO: 142932 - RNA, 1410 nt, Artificial Sequence; identical to SEQ ID NO: 141029
  derived and/or modified sequence opt3 from neuraminidase__InfluenzaA__AEL89320

SEQ ID NO: 142933 - RNA, 1410 nt, Artificial Sequence; identical to SEQ ID NO: 141029
  derived and/or modified sequence opt3 from neuraminidase__InfluenzaA__AEL89330

SEQ ID NO: 142934 - RNA, 1410 nt, Artificial Sequence; identical to SEQ ID NO: 141029
  derived and/or modified sequence opt3 from neuraminidase__InfluenzaA__AEL89340

SEQ ID NO: 142935 - RNA, 1410 nt, Artificial Sequence; identical to SEQ ID NO: 141029
  derived and/or modified sequence opt3 from neuraminidase__InfluenzaA__AEL89350

SEQ ID NO: 142936 - RNA, 1410 nt, Artificial Sequence; identical to SEQ ID NO: 141029
  derived and/or modified sequence opt3 from neuraminidase__InfluenzaA__AEL89360

SEQ ID NO: 142937 - RNA, 1410 nt, Artificial Sequence; identical to SEQ ID NO: 141029
  derived and/or modified sequence opt3 from neuraminidase__InfluenzaA__AEL89370

SEQ ID NO: 142938 - RNA, 1410 nt, Artificial Sequence; identical to SEQ ID NO: 141029
  derived and/or modified sequence opt3 from neuraminidase__InfluenzaA__AEL89394

SEQ ID NO: 142939 - RNA, 1410 nt, Artificial Sequence; identical to SEQ ID NO: 141029
  derived and/or modified sequence opt3 from neuraminidase__InfluenzaA__AEL89404

SEQ ID NO: 142940 - RNA, 1410 nt, Artificial Sequence; identical to SEQ ID NO: 141029
  derived and/or modified sequence opt3 from neuraminidase__InfluenzaA__AEL89414

SEQ ID NO: 142941 - RNA, 1410 nt, Artificial Sequence; identical to SEQ ID NO: 141029
  derived and/or modified sequence opt3 from neuraminidase__InfluenzaA__AEL89424

SEQ ID NO: 142942 - RNA, 1410 nt, Artificial Sequence; identical to SEQ ID NO: 141029
  derived and/or modified sequence opt3 from neuraminidase__InfluenzaA__AEL89434

SEQ ID NO: 142943 - RNA, 1410 nt, Artificial Sequence; identical to SEQ ID NO: 141029
  derived and/or modified sequence opt3 from neuraminidase__InfluenzaA__AEL89444

SEQ ID NO: 142944 - RNA, 1410 nt, Artificial Sequence; identical to SEQ ID NO: 141029
  derived and/or modified sequence opt3 from neuraminidase__InfluenzaA__AEL89454

SEQ ID NO: 142945 - RNA, 1410 nt, Artificial Sequence; identical to SEQ ID NO: 141029
  derived and/or modified sequence opt3 from neuraminidase__InfluenzaA__AEL89464

SEQ ID NO: 142946 - RNA, 1410 nt, Artificial Sequence; identical to SEQ ID NO: 141029
  derived and/or modified sequence opt3 from neuraminidase__InfluenzaA__AEL89474

SEQ ID NO: 142947 - RNA, 1410 nt, Artificial Sequence
  derived and/or modified sequence opt3 from neuraminidase__InfluenzaA__AEL89484
augaaccccaaucagaagaucauuaccauaggcagcgugugcaugacaaucgggauggccaaccugaugcuccaaauuggaaauaucauuuccaucuggauaucucacucaauccagcuugguaaccagaaucagauugagacuuguaaccaaagugucaucacguacgaaaauaacaccuggguuaaucagacauaugugaacauuagcaauacuaacuucgcugcaggccaguccguagugucugucaaacuggccggaaauucgucauugugcccugugagcggaugggcgaucuacaguaaggacaacuccauaagaauuggcucuaaaggugauguuuuugugaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggucccaucucccuacaacucccguuuugaaucaguggccuggagcgcaagugccugccacgacggcauuaauuggcuuacaauagggaucucuggaccugauaacggugcuguagcaguucugaaguauaauggcauuaucaccgacacgauaaaguccuggagaaacaauauuuugaggacucaagagagcgagugugccugcgugaacgggucguguuucaccgucaugacagauggaccaucugacggccaggcuuccuacaaaaucuuucggaucgaaaaggguaaaauugugaagucaguggagaucaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucacaaucgacaaguga

SEQ ID NO: 142948 - RNA, 1410 nt, Artificial Sequence; identical to SEQ ID NO: 142818
  derived and/or modified sequence opt3 from neuraminidase__InfluenzaA__AEL89494

SEQ ID NO: 142949 - RNA, 1410 nt, Artificial Sequence; identical to SEQ ID NO: 142824
  derived and/or modified sequence opt3 from neuraminidase__InfluenzaA__AEL89514

SEQ ID NO: 142950 - RNA, 1410 nt, Artificial Sequence; identical to SEQ ID NO: 142802
  derived and/or modified sequence opt3 from neuraminidase__InfluenzaA__AEL89524

SEQ ID NO: 142951 - RNA, 1410 nt, Artificial Sequence
  derived and/or modified sequence opt3 from neuraminidase__InfluenzaA__AEL89534
augaaccccaaucagaagaucauuaccauaggcagcgugugcaugacaaucgggauggccaaccugauucuccaaaucggaaauauuaucuccauauggaucucucacucaauucagcuugguaaccagaaucagaucggcacuuguaaccaaagugucauuacguacgagaauaacaccuggguuaaucagacauaugugaacaucagcaauacuaacuucgcugcagggcaguccguagugucugucaaacuggccggaaauucgucauugugcccugugagcggcugggcgauauacaguaaggacaacuccauuagaaucgguucuaaaggggauguuuuugugauuagggaaccauucaucagcuguuccccguuagagugccggaccuuuuuccugacacagggagcucuacucaaugacaagcauucaaacggcaccaucaaagaucgcagucccuaucgaacucugaugagcuguccuauuggcgaagucccaucucccuacaacucccguuuugagucaguggccuggagcgcaagugccugccacgacgggauaaauuggcuuacaaucggaauuucugguccugauaacggcgcuguagcaguucugaaguauaaugggaucauaaccgacacgauuaaguccuggagaaacaauaucuugaggacucaagaaagcgagugugccugcgugaacggaucguguuucaccgucaugacagauggcccaucugacggucaggcuuccuacaaaaucuuucggauugagaaggggaaaaucgugaagucaguggaaauuaaugcccccaacuaucauuacgaggaaugcaguuguuacccugauagcuccgagauaacuugcgucugccgcgacaauuggcacggaucuaacagaccauggguuagcuucaaucagaaccucgaguaucagaucggcuacauuuguucaggcaucuuuggggauaauccgaggcccaacgacaaaaccggaaguugcgguccuguguccagcaauggcgcgaacgggguaaagggauucucuuuuaaguauggcaacgguguguggaucgggcggacaaaaucaauuaguagccgcaauggcuucgaaaugauaugggauccaaacggauggaccggcacggacaauaacuuuuccaagaaacaagacaucgucgggauuaaugaguggucuggauacucggguagcuucgugcagcaucccgaacugacuggccuggauuguauccgaccuugcuucuggguugagcucauuagagggaggccaaaggaaaacacaaucuggaccuccggaucaaguauaucuuuuuguggcgugaauagcgacacugucgguugguccuggcccgauggggcagaguuaccguucacaaucgacaaauga

SEQ ID NO: 142952 - RNA, 1410 nt, Artificial Sequence; identical to SEQ ID NO: 142824
  derived and/or modified sequence opt3 from neuraminidase__InfluenzaA__AEL89544

SEQ ID NO: 142953 - RNA, 1410 nt, Artificial Sequence; identical to SEQ ID NO: 142824
  derived and/or modified sequence opt3 from neuraminidase__InfluenzaA__AEL89554

SEQ ID NO: 142954 - RNA, 1410 nt, Artificial Sequence
  derived and/or modified sequence opt3 from neuraminidase__InfluenzaA__AEL89564
augaaccccaaucagaagaucauuaccauaggcagcgugugcaucacaauugggauggccaaccugauccuccaaauuggaaauaucauauccaucuggauuucucacucaauccagcuugguaaccagaaucagauugagacuuguaaccaaagugucguuacguacgaaaauaacaccugggugaaucagacauauguaaacaucagcaauacuaacuucgcugcaggccaguccguggucucugugaaacuggccgggaauagcucauugugcccuguuagcggaugggcgauauacaguaaggacaacuccauuagaaucggcucuaaaggugauguguuugucauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggugccaucucccuacaacucccguuuugaaucaguagccuggagcgcaagugccugccacgacggcauaucuuggcuuacaaucgggauuuccggaccugauaauggugcuguugcagugcugaaguauaacggcaucauaaccgacacgauuaagagcuggagaaauaacaucuugaggacucaagagucggagugugccugcgucaaugggucuuguuucaccgugaugacagauggaccauccgacggccaggcuucauacaaaaucuuucggauugaaaaggguaaaaucgugaagagugucgagaugaacgcccccaauuaucauuacgaagagugcagcuguuacccugauuccucugagauuacuugcguuugccgcgacaacuggcacgggagcaauagaccaugggugucauucaaccagaaucucgaauaucagauaggauacaucuguaguggcauuuuuggcgauaacccgaggcccaaugacaaaaccggguccugcggaccuguaagcucuaacggugcgaauggcgugaagggguucucauuuaaguauggaaacggcgucuggaucggucggacaaaaaguaucagcucccgcaacggguucgagaugauuugggauccaaauggcuggaccggaacggacaacaauuuuucuauaaagcaagacaucgugggcauuaacgaauggucgggguacagcggauccuucguucagcaucccgagcugacuggucuggauuguauccgaccuugcuucuggguggaacucauuagaggcaggccaaaagagaauacaaucuggaccucagggaguucuauaucguuuuguggagucaacuccgacacugugggcuggucauggcccgauggugcagaguuaccguucacaaucgacaaguga

SEQ ID NO: 142955 - RNA, 1410 nt, Artificial Sequence; identical to SEQ ID NO: 142824
  derived and/or modified sequence opt3 from neuraminidase__InfluenzaA__AEL89574

SEQ ID NO: 142956 - RNA, 1410 nt, Artificial Sequence; identical to SEQ ID NO: 142824
  derived and/or modified sequence opt3 from neuraminidase__InfluenzaA__AEL89584

SEQ ID NO: 142957 - RNA, 1410 nt, Artificial Sequence; identical to SEQ ID NO: 139771
  derived and/or modified sequence opt3 from neuraminidase__InfluenzaA__AEL89604

SEQ ID NO: 142958 - RNA, 1410 nt, Artificial Sequence; identical to SEQ ID NO: 142273
  derived and/or modified sequence opt3 from neuraminidase__InfluenzaA__AEL89624

SEQ ID NO: 142959 - RNA, 1410 nt, Artificial Sequence
  derived and/or modified sequence opt3 from neuraminidase__InfluenzaA__AEL89634
augaaccccaaucagaagaucauuaccauaggcagcgugugcaucacaauugggauggccaaccugauccuccaaauuggaaauaucauauccaucuggauuucucacucaauccagcuugguaaccagaaucagauugagacuuguaaccaaagugucaucacguacgaaaauaacaccuggguuaaucagacauaugugaacauaagcaauacuaacuucgcugcaggccaguccguagugucugucaaacuggccggaaauucgucauugugcccugugagcgggugggcgauuuacaguaaggacaacuccaucagaauuggcucuaaaggugauguuuuugugaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggucccaucucccuacaacucccguuuugaaucaguggccuggagcgcaagugccugccacgacggcaucucuuggcuuacaauugggaucuccggaccugauaauggugcuguagcaguucugaaguauaacggcauaauuaccgacacgaucaagagcuggagaaauaacaucuugaggacucaagagucggagugugccugcgugaaugggucuuguuucaccgucaugacagauggaccauccgacggccaggcuucauacaaaauuuuucggaucgaaaaggguaaaauugugaagaguguggagaugaacgcccccaauuaucauuacgaagagugcagcuguuacccugauuccucugagauaacuugcgucugccgcgacaacuggcacgggagcaauagaccauggguuucauucaaccagaaucucgaauaucagaucggauacauuuguaguggcaucuuuggcgauaacccgaggcccaaugacaaaaccggguccugcggaccugugagcucuaacggugcgaauggcguaaagggguucucauauaaguacggaaacggcguguggaucggucggacaaaaaguauuagcucccgcaacggguuugagaugauaugggauccaaauggcuggaccggaacggacaacaauuucucuaucaagcaagacauugucggcaucaacgaauggucgggguauagcggauccuuugugcagcaucccgagcugacuggucuggauuguauucgaccuugcuucuggguugaacucaucagaggcaggccaaaagagaauacaauauggaccucagggaguucuaucagcuucuguggagugaacuccgacacugucggcuggucauggcccgauggugcagaguuaccguuuacaauugacaaguga

SEQ ID NO: 142960 - RNA, 1410 nt, Artificial Sequence; identical to SEQ ID NO: 141029
  derived and/or modified sequence opt3 from neuraminidase__InfluenzaA__AEL89644

SEQ ID NO: 142961 - RNA, 1410 nt, Artificial Sequence; identical to SEQ ID NO: 142725
  derived and/or modified sequence opt3 from neuraminidase__InfluenzaA__AEL89654

SEQ ID NO: 142962 - RNA, 1410 nt, Artificial Sequence; identical to SEQ ID NO: 142273
  derived and/or modified sequence opt3 from neuraminidase__InfluenzaA__AEL89664

SEQ ID NO: 142963 - RNA, 1410 nt, Artificial Sequence; identical to SEQ ID NO: 142273
  derived and/or modified sequence opt3 from neuraminidase__InfluenzaA__AEL89674

SEQ ID NO: 142964 - RNA, 1410 nt, Artificial Sequence; identical to SEQ ID NO: 142273
  derived and/or modified sequence opt3 from neuraminidase__InfluenzaA__AEL89694

SEQ ID NO: 142965 - RNA, 1410 nt, Artificial Sequence
  derived and/or modified sequence opt3 from neuraminidase__InfluenzaA__AEL89704
augaaccccaaucagaagaucauuaccauaggcagcgugugcaugacaaucgggauggccaaccugauucuccaaaucggaaauauuauccuuauauggaucucccacucuauucagcuggguaaccagaaucagaucgagacuuguaaccaaucagucauuacguacgaaaauaacaccuggguuaaucagacauaugugaacaucaguaauacuaacuucgcugcaggccagagcguaguguccgucaaauuggccggaaauucuucguuaugcccugugucagggugggcgauauacagcaaggacaacaguauuagaaucggcuccaaaggugauguuuuugugauuagggagccauucaucucuuguagcccgcuggaaugccggaccuuuuuccuaacacagggggcucuccugaaugacaagcauuccaacggaaccaucaaagaucgcucacccuaucgaacucuuaugaguuguccuauuggcgaggucccaagccccuacaacucucguuuugaauccguggccuggucagcaagcgccugccacgacggcauaaauuggcugacaaucgggauuaguggaccugauaacggugcuguagcaguuuugaaguauaauggcaucauaaccgacacgauuaagucuuggagaaacaauauccucaggacucaagaguccgagugugccugcgugaacgggagcuguuucaccgucaugacagauggaccaaaugacggccaggcuucguacaaaaucuuucggauugaaaaggguaaaaucgugaagucuguggagaugaacgcccccaauuaucauuacgaagagugcuccuguuacccugauucaagugagauuacuugcgucugccgcgacaacuggcacgggagcaauagaccauggguuuccuucaaccagaaucuggaauaucagauaggauacaucuguucuggcauuuuuggcgauaacccgaggcccaaugacaaaaccgggagcugcggaccugugucaaguaacggugcgaacggcguaaagggguucuccuuuaaguauggaaauggcguguggaucggucggacaaaaagcaucucuucacgcaacggguucgagaugauuugggauccaaauggcuggaccggaacggacaacaauuuuagugucaagcaagacauaaucggcauuaacgaauggagcggguacuccggaucuuucgugcagcaucccgagcugacuggucucgauuguauccgaccuugcuucuggguugaauuaauuagaggcaggccaaaagagaauacaaucuggaccucggggagcuccauaucauuuuguggagugaacagugacacugucggcuggucuuggcccgauggugcagagcugccguucacaaucgacaaguga

SEQ ID NO: 142966 - RNA, 1410 nt, Artificial Sequence; identical to SEQ ID NO: 142965
  derived and/or modified sequence opt3 from neuraminidase__InfluenzaA__AEL89714

SEQ ID NO: 142967 - RNA, 1410 nt, Artificial Sequence; identical to SEQ ID NO: 142273
  derived and/or modified sequence opt3 from neuraminidase__InfluenzaA__AEL89744

SEQ ID NO: 142968 - RNA, 1410 nt, Artificial Sequence
  derived and/or modified sequence opt3 from neuraminidase__InfluenzaA__AEL89754
augaaccccaaucagaagaucauuaccauaggcagcgugugcaucacaauugggauggccaaccugauccuccaaauuggaaauaucauauccaucuggauuucucacucaauccagcuugguaaccagaaucagauugagacuuguaaccaaagugucaucacguacgaaaauaacaccuggguuaaucagacauaugugaacauaagcaauacuaacuucgcugcaggccaguccguagugucugucaaacuggccggaaauucgucauugugcccugugagcgggugggcgauuuacaguaaggacaacuccaucagaauuggcucuaaaggugauguuuuugugaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggucccaucucccuacaacucccguuuugaaucaguggccuggagcgcaagugccugccacgacggcaucucuuggcuuacaauugggaucuccggaccugauaauggugcuguagcaguucugaaguauaacggcauaauuaccgacacgaucaagagcuggagaaauaacaucuugaggacucaagagucggagugugccugcgugaaugggucuuguuucaccgucaugacagauggaccauccgacggccaggcuucauacaaaauuuuucggaucgaaaaggguaaaauugugaagaguguggagaugaacgcccccaauuaucauuacgaagagugcagcuguuacccugauuccucugagauaacuugcgucugccgcgacaacuggcacgggagcaauagaccauggguuucauucaaccagaaucucgaauaucagaucggauacauuuguaguggcaucuuuggcgauaacccgaggcccaaugacaaaaccggguccugcggaccugugagcucuaacggugcgaauggcguaaagggguucucauuuaaguauggaaacggcguguggaucggucggacaaaaaguauuagcucccgcaacggguucgagaugauaugggauccaaauggcuggaccggaacggacaacaauuuuucuaucaagcaagacauugucggcaucaacgaauggucgggguacagcggauccuucgugcagcaucccgagcugacuggucuggauuguauucgaccuugcuucuggguugaacucaucagaggcaggccaaaagagaauacaauauggaccucagggaguucuaucagcuuuuguggagugaacuccgacacugucggcuggucauggcccgauggugcagaguuaccguucauuaucgacaaguga

SEQ ID NO: 142969 - RNA, 1410 nt, Artificial Sequence; identical to SEQ ID NO: 141029
  derived and/or modified sequence opt3 from neuraminidase__InfluenzaA__AEL89774

SEQ ID NO: 142970 - RNA, 1410 nt, Artificial Sequence
  derived and/or modified sequence opt3 from neuraminidase__InfluenzaA__AEL89784
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucagucugcgcaauggguucgagaugauuugggauccaaacggcuggaccggaacggacaauaacuuuagcgucaagcaagacauaaucggcauuaaugaaugguccggguacucuggaucguucgugcagcaucccgagcugacuggucucgauuguauccgaccuugcuucuggguugaauuaauuagaggcaggccaaaagagaacacaaucuggaccagcggguccucaauaaguuuuuguggagucaauucugacacugugggcuggagcuggcccgauggugcagagcugccguucacaaucgacaaguga

SEQ ID NO: 142971 - RNA, 1410 nt, Artificial Sequence
  derived and/or modified sequence opt3 from neuraminidase__InfluenzaA__AEL89794
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucggucggacaaaaaguauuagcucccgcaagggguucgagaugauaugggauccaaacggcuggaccggaacggacaauaacuuuucuaucaaacaagacauugugggcaucaaugaauggucgggguacagcggauccuucguccagcaucccgagcugacuggucuggauuguauucgaccuugcuucuggguggaacucaucagaggcaggccaaaggagaacacaauauggaccucagggaguucuaucagcuuuuguggaguuaauuccgacgcagugggcuggucauggcccgauggugccgaguuaccguucacuauugacaaauga

SEQ ID NO: 142972 - RNA, 1410 nt, Artificial Sequence; identical to SEQ ID NO: 142725
  derived and/or modified sequence opt3 from neuraminidase__InfluenzaA__AEL89804

SEQ ID NO: 142973 - RNA, 1410 nt, Artificial Sequence
  derived and/or modified sequence opt3 from neuraminidase__InfluenzaA__AEL89815
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccgucaagcaagacauaaucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucacaaucgacaaguga

SEQ ID NO: 142974 - RNA, 1410 nt, Artificial Sequence
  derived and/or modified sequence opt3 from neuraminidase__InfluenzaA__AEL89825
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacggggcgaacagaccauggguuucuuucaaucagaaccucgaauaucagauaggauacaucuguagcggcauuuuuggcgauaauccgaggcccaacgacaaaaccgggucaugcggaccugugaguuccaauggugcaaacggcguaaagggguucagcuuuaaguauggaaacggcguguggaucggucggacaaaaucuaucucaagucgcaauggguucgagaugauuugggauccaaacggcuggaccggaacggacaauaacuuuagcauaaagcaagacaucgucggcauuaaugaaugguccggguacucuggaucguucgugcagcaucccgagcugacuggucuggauuguauccgaccuugcuucuggguugaacucauuagaggcaggccaaaagagaacacaaucuggaccagcggguccucaauaaguuuuuguggagucaauucugacacugugggcuggagcuggcccgauggugccgaguuaccguucacaaucgacaaguga

SEQ ID NO: 142975 - RNA, 1410 nt, Artificial Sequence
  derived and/or modified sequence opt3 from neuraminidase__InfluenzaA__AEL89835
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacucauccuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugugugcgucaaugggucuuguuucaccaucaugacagauggaccauccgacggccaggccucauacaaaauuuuucggaucgaaaaggguaaaauugugaagaguguggagaugaacgcucccaauuaucauuacgaagagugcagcuguuacccugauuccucugagauaacuugcgucugccgcgacaacuggcacgggagcaauagaccauggguuucauucaaccagaaucucgaauaucagaucggauacauuuguaguggcaucuuuggcgauaacccgaggcccaaugacaaaaccggguccugcggaccugugagcucuaacggugccaauggcguaaagggguucucauuuaaguauggaaacggcguguggaucggucggacaaaaaguauuagcucccgcaagggguucgagaugauaugggauccaaacggcuggaccggaacggacaauaacuuuucuaucaaacaagacauugucggcaucaaugaauggucgggguacagcggauccuucgugcagcaucccgagcugacuggucuggauuguauucgaccuugcuucuggguugaacucaucagaggcaggccaaaggagaacacaauauggaccucagggaguucuaucagcuuuuguggagugaauagcgacacugucggcuggucauggcccgauggugcggaguuaccguucacaauugacaaauga

SEQ ID NO: 142976 - RNA, 1410 nt, Artificial Sequence
  derived and/or modified sequence opt3 from neuraminidase__InfluenzaA__AEL89845
augaaccccaaucagaagaucauuaccauaggcagcgugugcaugacaaucgggauggccaaccugauucuccaaaucggaaauauuaucuccauauggaucucucacucaauucagcuugguaacaaaaaucagaucgagacuuguaaccagagugucauuacguacgaaaauaacaccuggguuaaucaaacauaugugaacaucagcaauacuaacuucgcuaccggccaguccguagugucugucaagcuggcaggaaauucgucauugugcccugugagcggaugggccauauacaguaaagacaacuccauuagaaucggcucuaagggugauguuuuugugauuagggagccauucaucagcuguuccccguuagaaugccggacauuuuuccugacccagggggcgcuacucaaugacaaacauucaaacggaacuaucaaggaucgcagucccuaucgaacacugaugagcuguccuauuggcgaggcuccaucucccuacaacucccguuuugaaucagucgccuggagcgcaagugccugccacgacggcauaaauuggcuuaccaucgggauuucuggaccugauaacggugcuguggcaguacugaaguauaauggcaucauaacggacacuauuaaauccuggagaaacaauaucuugaggacccaggagagcgagugugccugcguuaacgggucguguuucacagugaugacugauggaccaucugacggccaggcuuccuacaagaucuuucggauugaaaaagguaagaucgucaaaucaguggagaugaaugcccccaacuaucauuacgaagagugcaguuguuacccugauagcuccgagauuaccugcgugugccgcgacaauuggcacgggucuaacagaccaugggucagcuucaaucaaaaccucgaauaucagauaggauacaucuguucaggcauuuuuggcgauaauccgaggcccaacgacaagaaggggaguugcggaccuguuuccagcaauggugcgaacggcgugaaaggguucucuuuuaaguauggaaacggcguauggaucggucggacaaaaucaaucaguagccgcaauggguucgagaugauuugggauccaaacggcuggaccggaacggacaauaacuuuuccauaaagcaggacaucgugggcauuaaugaauggucuggguacucggggagcuucguccaacaucccgagcugacuggucuggauuguauccgaccuugcuucuggguggaacucauuagaggcaggccaaaagagaacacaaucuggaccuccgggucaaguauaucuuuuuguggaguuaauagcgacacugugggcugguccuggcccgauggugcagaguuaccguucacaaucgacaaguga

SEQ ID NO: 142977 - RNA, 1410 nt, Artificial Sequence; identical to SEQ ID NO: 142974
  derived and/or modified sequence opt3 from neuraminidase__InfluenzaA__AEL89855

SEQ ID NO: 142978 - RNA, 1410 nt, Artificial Sequence; identical to SEQ ID NO: 142273
  derived and/or modified sequence opt3 from neuraminidase__InfluenzaA__AEL93581

SEQ ID NO: 142979 - RNA, 1410 nt, Artificial Sequence
  derived and/or modified sequence opt3 from neuraminidase__InfluenzaA__AEL93591
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaucuggccgggaacucgucauugugcccugugagcggaugggcgauauacaguaaagacaauuccauuagaaucggcucuaagggugauguuuuugugauuagggagccauucaucagcuguuccccguuagaaugccggaccuuuuuccugacacagggggcucuacucaacgacaaacauucaaacggaaccaucaaggaucgcagucccuaucgaacucugaugagcuguccuauuggcgaggucccaucucccuacaauucccguuuugaaucaguggccuggagcgcaagugccugccacgacggcauaaacuggcuuacaaucgggauuucuggaccugauaauggugcuguagcaguucugaaauauaacggcaucauaaccgacacgauuaaguccuggagaaauaacaucuugaggacucaagagagcgagugugccugcgugaaugggucguguuucaccaucaugacagauggaccaucugacggccaggcuuccuacaagauuuuucggaucgaaaaagguaagauugucaaaucaguggagaugaacgcccccaauuaucauuacgaagagugcaguuguuacccugauagcuccgagauaacuugcgugugccgcgacaacuggcacgggucuaauagaccaugggucagcuucaaccagaaucucgaauaucagaucggauacauuuguucaggcaucuuuggcgauaacccgaggcccaaugacaagaccgggaguugcggaccuguuuccagcaacggugcgaacggcgugaaaggguucucuuuuaaguauggaaauggcguauggaucggucggacaaagucaauuaguagccgcaaaggguucgagaugauaugggauccaaacggcuggaccggaacggacaauaacuuuuccaucaagcaagacauugugggcaucaaugaauggucuggguacucggguagcuucguccagcaucccgagcugacuggacuggauuguauucgaccuugcuucuggguggaacucaucagaggcaggccaaaagagaacacaauauggaccuccgggucaaguaucucuuuuuguggaguuaauagcgacacugugggcugguccuggcccgauggugcagaguuaccguucacaauugacaaguga

SEQ ID NO: 142980 - RNA, 1410 nt, Artificial Sequence; identical to SEQ ID NO: 142725
  derived and/or modified sequence opt3 from neuraminidase__InfluenzaA__AEL93601

SEQ ID NO: 142981 - RNA, 1410 nt, Artificial Sequence; identical to SEQ ID NO: 142273
  derived and/or modified sequence opt3 from neuraminidase__InfluenzaA__AEL93611

SEQ ID NO: 142982 - RNA, 1410 nt, Artificial Sequence; identical to SEQ ID NO: 142273
  derived and/or modified sequence opt3 from neuraminidase__InfluenzaA__AEL93621

SEQ ID NO: 142983 - RNA, 1410 nt, Artificial Sequence; identical to SEQ ID NO: 142273
  derived and/or modified sequence opt3 from neuraminidase__InfluenzaA__AEL93631

SEQ ID NO: 142984 - RNA, 1410 nt, Artificial Sequence
  derived and/or modified sequence opt3 from neuraminidase__InfluenzaA__AEL93641
augaaccccaaucagaagaucauuaccauaggcagcgugugcaucacaauugggauggccaaccugauccuccaaauuggaaauaucauauccaucuggauuucucacucaauccagcuugguaaccagaaucagauugagacuuguaaccaaagugucaucacguacgaaaauaacaccuggguuaaucagacauaugugaacauaagcaauacuaacuucgcugcaggccaguccguagugucugucaaacuggccggaaauucgucauugugcccugugagcgggugggcgauuuacaguaaggacaacuccaucagaauuggcucuaaaggugauguuuuugugaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggucccaucucccuacaacucccguuuugaaucaguggccuggagcgcaagugccugccacgacggcaucucuuggcuuacaauugggaucuccggaccugauaauggugcuguagcaguucugaaguauaacggcauaauuaccgacacgaucaagagcuggagaaauaacaucuugaggacucaagagucggagugugccugcgugaaugggucuuguuucaccgucaugacagauggaccauccgacggccaggcuucauacaaaauuuuucggaucgaaaaggguaaaauugugaagaguguggagaugaacgcccccaauuaucauuacgaagagugcagcuguuacccugauuccucugagauaacuugcgucugccgcgacaacuggcacgggagcaauagaccauggguuucauucaaccauaaucucgaauaucagaucggauacauuuguaguggcaucuuuggcgauaacccgaggcccaaugacaaaaccggguccugcggaccugugagcucuaacggugcgaauggcguaaagggguucucauuuaaguauggaaacggcguguggaucggucggacaaaaaguauuagcucccgcaacggguucgagaugauaugggauccaaauggcuggaccggaacggacaacaauuuuucuaucaagcaggacauugucggcaucaacgaauggucgggguacagcggauccuucgugcaacaccccgagcugacuggucuggauuguauucgaccuugcuucuggguugaacucaucagaggccagccaaaagagaauacaauauggaccucagggaguucuaucagcuuuuguggagugaacuccgacacugucggcuggucauggcccgauggugcagaguuaccguucacaauugacaaguga

SEQ ID NO: 142985 - RNA, 1410 nt, Artificial Sequence; identical to SEQ ID NO: 142824
  derived and/or modified sequence opt3 from neuraminidase__InfluenzaA__AEL94890

SEQ ID NO: 142986 - RNA, 1410 nt, Artificial Sequence
  derived and/or modified sequence opt3 from neuraminidase__InfluenzaA__AEL95429
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagcccccaccgaacucugaugucuuguccuauuggcgaggucccaucccccuauaacucacguuuugaaagcguggccuggagugcaucugccugccaugacggcauaaacuggcuuacaaucgggauuuccggaccugauaauggugcuguagcaguucugaaguacaacggcaucauaaccgacacgauuaagagcuggagaaauaacaucuugaggacucaagagucggagugugccugcgugaaugggucuuguuucaccaucaugacagauggaccauccgacggccaggcuucauauaaaauuuuucggaucgaaaaggguaaaauugucaagaguguggagaugaacgcccccaauuaccacuaugaagagugcagcuguuacccugauuccucugagauaacuugcgugugccgcgacaacuggcaugggagcaauagaccaugggucucauucaaccagaaucucgaauaccagaucggauauauuuguaguggcaucuuuggcgauaacccgaggcccaaugacaaaaccggguccugcggaccuguuagcucuaacggugcgaauggcgugaagggguucucauuuaaguacggaaacggcguauggaucggucggacaaaaaguauuagcucccgcaagggguucgagaugauaugggauccaaacggcuggaccggaacggacaauaacuuuucuaucaaacaagacauugugggcaucaaugaauggucgggguauagcggauccuucguccagcaccccgagcugacuggucuggauuguauucgaccuugcuucuggguggaacucaucagaggcaggccaaaggagaacacaauauggaccucagggaguucuaucagcuuuuguggaguuaauuccgacacugugggcuggucauggcccgauggugcagaguuaccguucacaauugacaaauga

SEQ ID NO: 142987 - RNA, 1410 nt, Artificial Sequence
  derived and/or modified sequence opt3 from neuraminidase__InfluenzaA__AEL97634
augaaccccaaucagaagaucauuaccauaggcagcgugugcaugacaaucgggauggccaaccugauucuccaaaucggaaauauuaucuccauaugggucucucacucaauccagcuugguaaccagaaucagauugagacuuguaaccaaaguguuaucacguacgaaaauaacaccugggugaaucagacauauguaaacauuagcaauacuaacuucgcugcaggccaguccguggucucugugaaacuggccggaaauucgucauugugcccuguuagcggaugggcgaucuacaguaaggacaacuccauaagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucugacggccaggcuuccuacaaaaucuuucggaucgaaaaggguaaaauugugaagucagucgagaugaaugcccccaacuaucauuacgaagagugcaguuguuacccugauagcuccgagaucacuugcguuugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacaauaacuuuuccauuaagcaagacauagugggcguuaaugaauggucuggguacucggggagcuucgugcagcaucccgagcugacuggucuggauuguauccgaccuugcuucugggucgaacucauuagaggcaggccaaaagagaacacaaucuggaccuccgggucaaguauuucuuuuuguggagugaauagcgacacuguaggcugguccuggcccgauggugcagaguuaccguucacaaucgacaaguga

SEQ ID NO: 142988 - RNA, 1410 nt, Artificial Sequence; identical to SEQ ID NO: 138754
  derived and/or modified sequence opt3 from neuraminidase__InfluenzaA__AEL99667

SEQ ID NO: 142989 - RNA, 1410 nt, Artificial Sequence; identical to SEQ ID NO: 138754
  derived and/or modified sequence opt3 from neuraminidase__InfluenzaA__AEL99677

SEQ ID NO: 142990 - RNA, 1410 nt, Artificial Sequence; identical to SEQ ID NO: 137792
  derived and/or modified sequence opt3 from neuraminidase__InfluenzaA__AEM53471

SEQ ID NO: 142991 - RNA, 1413 nt, Artificial Sequence; identical to SEQ ID NO: 138469
  derived and/or modified sequence opt3 from neuraminidase__InfluenzaA__AEM60040

SEQ ID NO: 142992 - RNA, 1413 nt, Artificial Sequence; identical to SEQ ID NO: 138059
  derived and/or modified sequence opt3 from neuraminidase__InfluenzaA__AEM60061

SEQ ID NO: 142993 - RNA, 1410 nt, Artificial Sequence
  derived and/or modified sequence opt3 from neuraminidase__InfluenzaA__AEM60072
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccacuaucauagagagaaacaucaccgaaauuguauauuugacaaauaccacuaucgagaaggaaauuuguccuaaauuaguggaguacaggaacuggaguaagccacagugcaaaaucacaggguucgcacccuuuagcaaggacaauuccauacggcugucugccggaggugauauuugggucacccgcgagccuuaugugucgugugacccaggcaagugcuaccaauucgcgcuagggcagggaacgacucucaacaaucgacauucaaacgauaccguucacgaccguacacccuauagaacucugcuuaugaaugaacugggcgugccuuuucauuuggguaccaaacaggucuguaucgcuuggagcaguuccucuugccacgaugggaaggccuggcuccauguguguguaacaggacacgacgagaacgcaaccgccagcuucauuuacgauggcaggcugguugacuccaucggcucauggaguaaaaauauccugcggacgcaggaaagcgagugcguguguauuaacgggacuugcacagucgugaugaccgauggaucugcuuccgagcgcgcagacacuaagauacucuuuaucgaagaggguaaaauugugcacaucucaccauuaagcggcagugcccaacaugucgaagagugcucuuguuauccgagauaccccgggguuaggugcgugugucgggauaauuggaagggauccaaccgcccuauaguagacauuaacgugaaggauuacagcaucgucucgucuuaugugugcuccggccugguuggugacacaccacgaaagaaugacagaucaaguagcuccuacuguaggaaccccaauaacgaaaaagggucucacggagugaaaggcugggcuuucgaugacggcaaugaugucuggauggggcggaccaucggagaggagcuucguagcgguuaugaaacguuuaaggugauuggcggguggucaaccccuaacaguaaauugcagaucaaucgccagguaauuguugacuccggaaacagaagcggcuacucugguauauucucaguggaggggaagaguugcaucaauagguguuuuuaugucgaacugauucggggccgagagcaggaaacacgcgugugguggacuagcaacuccaucgucguguucugcggaaccucuggcacauacgggacuggaucguggccagauggugccgacaucaaucuaaugcccauuuga

SEQ ID NO: 142994 - RNA, 1410 nt, Artificial Sequence; identical to SEQ ID NO: 138754
  derived and/or modified sequence opt3 from neuraminidase__InfluenzaA__AEM62774

SEQ ID NO: 142995 - RNA, 1410 nt, Artificial Sequence; identical to SEQ ID NO: 138754
  derived and/or modified sequence opt3 from neuraminidase__InfluenzaA__AEM62783

SEQ ID NO: 142996 - RNA, 1410 nt, Artificial Sequence
  derived and/or modified sequence opt3 from neuraminidase__InfluenzaA__AEM62792
augaaccccaaucagaagaucauuaccauaggcagcgugugcaugacaaucgggauggccaaccugauucuccaaaucggaaauauuaucuccauauggaucucucacucaauucagcuugguagucagaaccagaucgagacuuguaaucaaagcgucauuacguacgaaaacaauaccuggguuaaccagacauaugugaauaucuccaacacuaauuucgcugcaggccagucuguaauaucggugagacuggccgggaacagcucauugugcccugucaguggaugggcgauuuacuccaaagacaauucuaucaggauuggcagcaagggugauguguuuguuauccgggagccauucaucuccuguucaccguuagaaugccgcaccuuuuuccugacacagggggcucuacucaacgacaaacauaguaauggaaccauuaaggaucgaagccccuaucguacucugaugucuuguccuauaggcgaggugccaucccccuacaacucaagauuugaaagcgucgccuggagugcaucugccugccacgacggcaucaacuggcuuacaauugggaucuccggaccugauaauggugcuguggcaguacugaaauauaacggcauaauuaccgacacgaucaagagcuggaggaauaacaucuugcggacucaagagucggagugugccugcguuaaugggucuuguuucaccgugaugacagauggaccauccgacggccaggcuucauacaagauuuuucgcaucgaaaaagguaagauugucaaaaguguggagaugaacgcccccaauuaucauuacgaagagugcagcuguuacccugauuccucugagauaacuugcgugugcagagacaacuggcacgggagcaauaggccaugggucucauucaaccagaaucucgaauaucagaucggauacauuuguaguggcaucuuuggcgauaacccgcggcccaaugacaagaccggguccugcggaccuguuagcucuaacggugcgaauggcgugaaaggguucucauuuaaguauggaaacggcguauggaucggucgcacaaagaguauuagcucccgaaacggguucgagaugauaugggauccaaauggcuggaccggaacggacaacaauuuuucuaucaaacaagacauuaucggcauuaacgaauggucgggguacagcggauccuucgugcagcaucccgagcugacuggucuggauuguaucagaccuugcuucugggucgaacucauaaggggccggccaaaggagaauacaaucuggaccucagggaguucuauuagcuuuuguggagugaacuccgacacuguuggcuggucauggcccgauggugcagaguuaccguucacaaucgacaaauga

SEQ ID NO: 142997 - RNA, 1410 nt, Artificial Sequence; identical to SEQ ID NO: 138754
  derived and/or modified sequence opt3 from neuraminidase__InfluenzaA__AEM62801

SEQ ID NO: 142998 - RNA, 1410 nt, Artificial Sequence
  derived and/or modified sequence opt3 from neuraminidase__InfluenzaA__AEM62810
augaaccccaaucagaagaucauuaccauaggcagcgugugcaugacaaucgggaugggaaaccugauucuccaaaucgguaauauuaucuccauauggaucucucacucaauucagcuuggcaaccagaaucagaucgagacuuguaaccaaagugucauuacguacgaaaauaacaccuggguuaaucagacauaugugaacaucagcaauacuaacuucgccgcugggcaguccguagugucugucaaacuggcaggaaauucgucauugugcccugugagcggcugggccauauacaguaaggacaacuccauuagaaucgguucuaaaggggauguuuuugugauuagggagccauucaucagcuguuccccguuagaaugccggaccuuuuuccugacacagggagcgcuacucaaugacaagcauucaaacggcaccaucaaagaucgcagucccuaucgaacucugaugagcuguccuauuggcgaggucccaucucccuacaacucccguuuugaaucaguggcuuggagcgccagugcaugccacgacgggauaaauuggcuuacaaucggaauuucugguccugauaacggcgccguagcuguucugaaguauaaugggaucauaaccgacacgauuaaguccuggagaaacaauaucuugaggacucaagagagcgagugugcaugcgugaacggaucguguuucaccgucaugacagauggcccaucugacggucaggccuccuacaaaaucuuucggauugaaaaggggaaaaucgugaagucaguggagaugaaugcucccaacuaucauuacgaagagugcaguuguuacccugauagcuccgagauuacuugcgucugccgcgacaauuggcacggaucuaacagaccauggguuagcuucaaucagaaccucgaauaucagauaggcuacaucuguucaggcauuuuuggggauaauccgaggcccaacgacaaaaccggaaguugcgguccuguguccagcaauggcgccaacgggguaaagggauucucuuuuaaguauggcaacgguguguggaucgggcggacaaaaucaaucaguagccgcaauggcuucgagaugauuugggauccaaacggauggaccggcacggacaauaacuuuuccauaaagcaagacaucgucgggauuaaugaauggucuggauacucggguagcuucgugcagcaucccgagcugacuggccuggauuguauccgaccuugcuucuggguugaacucauuagagggaggccaaaagagaacacaaucuggaccuccggaucaaguauaucuuuuuguggcgugaauagcgacacugucgguugguccuggcccgauggggcggaguuaccguucacaaucgacaaguga

SEQ ID NO: 142999 - RNA, 1410 nt, Artificial Sequence
  derived and/or modified sequence opt3 from neuraminidase__InfluenzaA__AEM62819
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaaugacaccuggguuaaccagacauaugugaauaucagcaacacuaauuucgcugcaggccaguccguagugucugucaaacuggccgggaacucgucauugugcccugugagcggaugggcgauauacaguaaggauaauuccauuagaaucggcucuaaaggugacguuuuugugauuagggagccauucaucagcuguuccccguuagaaugccggaccuuuuuccugacacagggggcucuacucaacgauaagcauucaaauggaaccaucaaagaccgcagucccuaucgaacucugaugagcuguccuauuggcgaggucccaucucccuacaacucccguuuugaaucaguggccuggagcgcaagugccugccacgauggcauaaacuggcuuacaaucgggauuucuggaccugacaauggugcuguagcaguucugaaguauaacggcaucauaaccgauacgauuaaguccuggagaaauaacaucuugaggacucaagagagcgagugugccugcgugaaugggucguguuucaccgucaugacagacggaccaucugauggccaggcuuccuacaaaaucuuucggauugaaaaggguaaaaucgugaagucaguggagaugaacgcccccaauuaucauuacgaagagugcaguuguuacccugacagcuccgagauuacuugcgucugccgcgauaacuggcacgggucuaauagaccauggguuagcuucaaccagaaucucgaauaucagauaggauacaucuguucaggcauuuuuggcgacaacccgaggcccaaugauaaaaccgggaguugcggaccuguguccagcaacggugcgaauggcguaaagggguucucuuuuaaguauggaaacggcguguggaucggucggacaaaaucaaucaguagccgcaacggguucgagaugauuugggacccaaauggcuggaccggaacggacaacaauuuuuccauaaagcaagauaucgucggcauuaacgaauggucuggguacucggguagcuucgugcagcaucccgagcugacuggacuggacuguauccgaccuugcuucuggguugaacucauuagaggcaggccaaaagagaauacaaucuggaccuccgggucaaguauaucuuuuuguggagugaacagcgauacugucggcugguccuggcccgacggugcagaguuaccguucacaaucgauaaguga

SEQ ID NO: 143000 - RNA, 1410 nt, Artificial Sequence; identical to SEQ ID NO: 138754
  derived and/or modified sequence opt3 from neuraminidase__InfluenzaA__AEM62828

SEQ ID NO: 143001 - RNA, 1410 nt, Artificial Sequence; identical to SEQ ID NO: 139337
  derived and/or modified sequence opt3 from neuraminidase__InfluenzaA__AEM62837

SEQ ID NO: 143002 - RNA, 1410 nt, Artificial Sequence; identical to SEQ ID NO: 138754
  derived and/or modified sequence opt3 from neuraminidase__InfluenzaA__AEM62846

SEQ ID NO: 143003 - RNA, 1410 nt, Artificial Sequence
  derived and/or modified sequence opt3 from neuraminidase__InfluenzaA__AEM62855
augaaccccaaucagaagaucauuaccauaggcagcgugugcaucacaauugggauggccaaccugauccuccaaauuggaaauaucauauccaucuggauuucucacucaauccagcuugguaaccagaaucagauugagacuuguaaccaaagugucaucacguacgaaaauaacaccuggguuaaucagacauaugugaacauaagcaauacuaacuucgcugcaggccaguccguagugucugucaaacuggccggaaauucgucauugugcccugugagcgggugggcgauuuacaguaaggacaacuccguuagaaucggcucuaaaggugauguguuugucauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggugccaucucccuacaacucccguuuugaaucaguagccuggagcgcaagugccugccacgacggcauaaauuggcuuacaaucgggauuucuggaccugauaacggugcuguugcagugcugaaguauaauggcaucauaaccgacacgauuaaguccuggagaaacaauaucuugaggacucaagagagcgagugugccugcgucaacgggucguguuucaccgugaugacagauggaccaucuaauggccaggcuuccuacaaaaucuuucggauugaaaaggguaaaaucgugaagucagucgagaugaacgcccccaauuaucauuacgaagagugcaguuguuacccugacagcggggagauuacuugcguuugccgcgauaacuggcacggauccaauagaccaugggugucuuucaaccagaaucucgaauaucagauaggcuacaucuguagcggcauuuuuggggacaacccgaggcccaaugauaaaaccggaucaugcgguccuguaaguuccaacggcgcgaacggggugaagggauucagcuuuaaguauggcaauggugucuggaucgggcggacaaaaucuaucucaagucgcaacggcuucgagaugauuugggacccaaauggauggaccggcacggauaacaauuuuagcauaaagcaagacaucguggggauuaacgaaugguccggauacucugguucguucguucagcaucccgagcugacuggccuggacuguauccgaccuugcuucuggguggaacucauuagagggaggccaaaagagaauacaaucuggaccagcggauccucaauaaguuuuuguggcgucaacucugauacuguggguuggagcuggcccgacggggcagaguuaccguucacaaucgauaaguga

SEQ ID NO: 143004 - RNA, 1410 nt, Artificial Sequence
  derived and/or modified sequence opt3 from neuraminidase__InfluenzaA__AEM62864
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuuucggaccugauaacggugcuguagcaguucugaaguauaauggcaucauaaccgacacgauuaagucuuggagaaacaauaucuugaggacucaagaguccgagugugccugcgugaacgggagcuguuuuaccgucaugacagauggaccaucggacggccaggcuucuuacaaaaucuuccggauugaaaaggguaaaaucgugaaguccguggagaugaaugcccccaacuaucauuacgaagagugcucauguuacccugauaguagcgagauuacuugcgucugccgcgacaauuggcacggguccaacagaccauggguuucuuuuaaucagaaccucgaauaucagauaggauacaucuguagcggcauuuucggcgauaauccgaggcccaacgacaaaaccgggucaugcggaccugugaguuccaauggugcgaacggcguaaagggguuuagcuucaaguauggaaacggcguguggaucggucggacaaaaucuaucucaagucgcaauggguuugagaugauuugggauccaaacggcuggaccggaacggacaauaacuucagcauaaagcaagacaucgucggcauuaaugaaugguccggguacucuggaucguucgugcagcaucccgagcugacuggucuggauuguauccgaccuugcuuuuggguugaacucauuagaggcaggccaaaagagaacacaaucuggaccagcggguccucaauaaguuucuguggagucaauucugacacugugggcuggagcuggcccgauggugcagaguuaccguuuacaaucgacaaguga

SEQ ID NO: 143005 - RNA, 1410 nt, Artificial Sequence
  derived and/or modified sequence opt3 from neuraminidase__InfluenzaA__AEM62872
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccuucaauggugcgaacggcguaaagggguuuagcuucaaguauggaaacggcguguggaucggucggacaaaaucuaucucaagucgcaauggguuugagaugauuugggauccaaacggcuggaccggaacggacaauaacuucagcauaaagcaagacaucgucggcauuaaugaaugguccggguacucuggaucguucgugcagcaucccgagcugacuggucuggauuguauccgaccuugcuuuuggguugaacucauuagaggcaggccaaaagagaacacaaucuggaccagcggguccucaauaaguuucuguggagucaauucugacacugugggcuggagcuggcccgauggugcagaguuaccguuuacaaucgacaaguga

SEQ ID NO: 143006 - RNA, 1410 nt, Artificial Sequence; identical to SEQ ID NO: 138754
  derived and/or modified sequence opt3 from neuraminidase__InfluenzaA__AEM92310

SEQ ID NO: 143007 - RNA, 1410 nt, Artificial Sequence; identical to SEQ ID NO: 140216
  derived and/or modified sequence opt3 from neuraminidase__InfluenzaA__AEM92320

SEQ ID NO: 143008 - RNA, 1410 nt, Artificial Sequence
  derived and/or modified sequence opt3 from neuraminidase__InfluenzaA__AEM92340
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcaagggguucgagaugauaugggauccaaauggcuggacccgaacggacaacaauuuuuccaucaaacaagacauugugggaaucaacgaauggucuggcuacucggggagcuucguccagcaucccgagcugacuggacuggauuguauuagaccuugcuucuggguggaacucaucaggggucggccaaaggagaauacaauauggaccuccggcucaaguaucucuuuuugugggguuaacagcgacacugugggaugguccuggcccgauggcgcagaguuaccguucacaauugacaaauga

SEQ ID NO: 143009 - RNA, 1410 nt, Artificial Sequence; identical to SEQ ID NO: 140216
  derived and/or modified sequence opt3 from neuraminidase__InfluenzaA__AEM92350

SEQ ID NO: 143010 - RNA, 1410 nt, Artificial Sequence
  derived and/or modified sequence opt3 from neuraminidase__InfluenzaA__AEM92360
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcagagcaguccguagugucugucaaacuggccggcaauucgucauugugcccugugagcgggugggcgauauacaguaaggacaacuccauuagaaucggaucuaaaggcgauguuuuugugauuagggaaccauucaucagcuguuccccguuagagugccggaccuuuuuccugacacagggugcucuacucaaugacaagcauucaaacgggaccaucaaagaucgcagucccuaucgaacucugaugagcuguccuauuggagaagucccaucucccuacaacucccguuuugagucaguggccuggagcgcaagugccugccacgacggcauaaauuggcuuacaaucggcauuucugggccugauaacggagcuguagcaguucugaaguauaaugguaucauaaccgacacgauuaaguccuggagaaacaauaucuugaggacucaagagagcgaaugugccugcgugaacggcucguguuucaccaucaugacagaugggccaucugacggacaggcuuccuacaaaauuuuucggaucgagaagggcaaaauugucaagucaguggaaaugaaugcccccaacuaucauuacgaggagugcaguuguuacccugauagcuccgaaauaacuugcgugugccgcgacaauuggcacgguucuaacagaccaugggucagcuucaaucagaaccucgaguaucagaucggguacauuuguucaggaaucuuuggcgauaauccgaggcccaacgacaaaaccggcaguugcgggccuguuuccagcaauggagcgaacggugugaagggcuucucuuuuaaguaugggaacggaguauggaucggccggacaaaaucaauuaguagccgcaaggguuucgaaaugauaugggauccaaauggguggaccggcacggacaacaauuuuuccaucaaacaagacauugugggaaucaacgaguggucuggcuacucggggagcuucguccagcaucccgaacugacuggacuggauuguauucgaccuugcuucuggguggagcucaucagagguaggccaaaggagaauacaauauggaccuccggcucaaguaucucuuuuugugggguuaacagcgacacugugggaugguccuggcccgauggcgcagaauuaccguucacaauugacaaauga

SEQ ID NO: 143011 - RNA, 1410 nt, Artificial Sequence; identical to SEQ ID NO: 143008
  derived and/or modified sequence opt3 from neuraminidase__InfluenzaA__AEM92370

SEQ ID NO: 143012 - RNA, 1410 nt, Artificial Sequence; identical to SEQ ID NO: 143008
  derived and/or modified sequence opt3 from neuraminidase__InfluenzaA__AEM92380

SEQ ID NO: 143013 - RNA, 1410 nt, Artificial Sequence
  derived and/or modified sequence opt3 from neuraminidase__InfluenzaA__AEM92399
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcacaaauuggcuuaccauagggaucucuggaccugauaacggugcuguagcaguucugaaguauaauggcauuaucacggacacuauaaaguccuggagaaacaauauuuugaggacccaagagagcgagugugccugcgugaacgggucguguuucacagucaugacugauggaccaucugacggccaggcuuccuacaaaaucuuucggaucgaaaaggguaaaauugugaagucaguggagaugaaugcccccaacuaucauuacgaagagugcaguuguuacccugauagcuccgagauuaccugcgucugccgcgacaauuggcacgggucuaacagaccauggguuagcuucaaucagaaccucgaauaucagaucggauacauauguucaggcaucuuuggcgauaauccgaggcccaacgacaaaacagggaguugcggaccugugcuguccaauggugcgaacggcguaaagggguucagcuuuaaguauggaaacggcguguggauuggucggaccaaaucuaucucaagucgcaauggguucgagaugaucugggauccaaacggcuggacgggaacugacaauaacuuuagcauuaagcaagacauagucggcaucaaugaaugguccggguacucuggaucguucgugcagcaucccgagcugacaggucucgauuguauucgaccuugcuucuggguugaauuaaucagaggcaggccaaaagagaacaccauuuggacuagcggguccucaaucaguuuuuguggagucaauucugacacagugggcuggagcuggcccgauggugcagagcugccguucaccauagacaaguga

SEQ ID NO: 143014 - RNA, 1410 nt, Artificial Sequence; identical to SEQ ID NO: 143013
  derived and/or modified sequence opt3 from neuraminidase__InfluenzaA__AEM92409

SEQ ID NO: 143015 - RNA, 1410 nt, Artificial Sequence; identical to SEQ ID NO: 139178
  derived and/or modified sequence opt3 from neuraminidase__InfluenzaA__AEM92419

SEQ ID NO: 143016 - RNA, 1410 nt, Artificial Sequence
  derived and/or modified sequence opt3 from neuraminidase__InfluenzaA__AEM92430
augaaccccaaucagaagaucaugaccauuggcagcgugugcaugacaauagggauggccaaccugauccuccaaauuggaaauaucauuuccaucuggauaucucacucaauccagcuugguaaccagaaucagauugagacuuguaaccaaagugucaucacguacgaaaauaacaccuggguuaaucagacauaugugaacauuagcaauacuaacuucgcugcaggccaguccguagugucugucaaacuggccggaaauucgucauugugcccugugagcggaugggcgaucuacaguaaggacaacuccauaagaauuggcucuaaaggugauguuuuugugaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggucccaucucccuacaacucccguuuugaaucaguggccuggagcgcaagugccugccacgacggcauuaauuggcuuacaauagggaucucuggaccugauaacggugcuguagcaguucugaaguauaauggcauuaucaccgacacgauaaaguccuggagaaacaauauuuugaggacucaagagagcgagugugccugcgugaacgggucguguuucaccgucaugacagauggaccaucugacggccaggcuuccuacaaaaucuuucggaucgaaaaggguaaaauugugaagucaguggagaugaaugcccccaacuaucauuacgaagagugcaguuguuacccugauagcuccgagaucacuugcgucugccgcgacaauuggcacgggucuaacagaccauggguuagcuucaaucagaaccucgaauaucagauuggauacauauguucaggcaucuuuggcgauaauccgaggcccaacgacaaaaccgggaguugcggaccuguguccagcaauggugcgaacggcguaaagggguucucuuuuaaguauggaaacggcguguggauuggucggacaaaaucaaucaguagccgcaauggguucgagaugaucugggauccaaacggcuggaccggaacggacaauaacuuuuccauuaagcaagacauagucggcaucaaugaauggucuggguacucggggagcuucgugcagcaucccgagcugacuggucuggauuguauucgaccuugcuucuggguugaacucaucagaggcaggccaaaagagaacacaauuuggaccuccgggucaaguaucucuuuuuguggagugaauagcgacacugucggcugguccuggcccgauggugcagaguuaccguucacaauagacaaguga

SEQ ID NO: 143017 - RNA, 1410 nt, Artificial Sequence
  derived and/or modified sequence opt3 from neuraminidase__InfluenzaA__AEM92440
augaaccccaaucagaagaucauuaccauaggcagcgugugcaucacaauugggauggccaaccugauccuccaaauuggaaauaucauauccaucuggauuucucacucaauccagcuugguaaccagagucagauugagacuuguaaucaaagcgucaucacguacgaaaacaauaccuggguuaaccagacauaugugaauauauccaacacuaauuucgcugcaggccagucuguagugucggucaaacuggccgggaacagcucauugugcccugugaguggaugggcgauuuacuccaaggacaauucuaucagaauuggcagcaaaggugauguuuuugugaucagggagccauucaucuccuguucaccguuagaaugccggaccuuuuuccugacacagggggcucuacucaacgacaagcauaguaauggaaccauuaaagaucgcagccccuaucgaacucugaugucuuguccuauaggcgaggucccaucccccuacaacucacguuuugaaagcguggccuggagugcaucugccugccacgacggcaucaacuggcuuacaauugggaucuccggaccugauaauggugcuguagcaguucugaaguauaacggcauaauuaccgacacgaucaagagcuggagaaauaacaucuugaggacucaagagucggagugugccugcgugaaugggucuuguuucaccauuaugacagauggaccauccgacggccaggcuucauacaaaaucuuucggauugaaaaggguaaaauagucaagaguguggagaugaucgcccccaacuaucauuacgaagagugcagcuguuacccugauuccucugagauuacuugcgugugccgcgacaauuggcacgggagcaacagaccaugggucucauucaaucagaaccucgaauaucagaucggauacaucuguaguggcauuuuuggcgauaauccgaggcccaacgacaaaaccggguccugcggaccuguuagcucuaauggugcgaacggcgugaagggguucucauuuaaguauggaaauggcguauggauaggucggacaaaaaguaucagcucccgcaagggguucgagaugauuugggauccaaacggcuggaccggaacggacaacaauuuuucuaucaaacaagacauugugggcaucaacgaauggucgggguacagcggauccuucguccagcaucccgagcugacuggucuggauuguauacgaccuugcuucuggguggaacucaucagaggcaggccaaaggagaauacaauuuggaccucagggaguucuaucagcuuuuguggaguuaacuccgacacugugggcuggucauggcccgauggugcagaguuaccguucacaauugacaaauga

SEQ ID NO: 143018 - RNA, 1410 nt, Artificial Sequence; identical to SEQ ID NO: 142974
  derived and/or modified sequence opt3 from neuraminidase__InfluenzaA__AEM92450

SEQ ID NO: 143019 - RNA, 1410 nt, Artificial Sequence; identical to SEQ ID NO: 142974
  derived and/or modified sequence opt3 from neuraminidase__InfluenzaA__AEM92460

SEQ ID NO: 143020 - RNA, 1410 nt, Artificial Sequence; identical to SEQ ID NO: 142725
  derived and/or modified sequence opt3 from neuraminidase__InfluenzaA__AEM92470

SEQ ID NO: 143021 - RNA, 1410 nt, Artificial Sequence; identical to SEQ ID NO: 142725
  derived and/or modified sequence opt3 from neuraminidase__InfluenzaA__AEM92480

SEQ ID NO: 143022 - RNA, 1410 nt, Artificial Sequence
  derived and/or modified sequence opt3 from neuraminidase__InfluenzaA__AEM92490
augaaccccaaucagaagaucauuaccauaggcagcgugugcaugaucauugggauggccaaccugaugcuccaaaucggaaauauuaucuccauauggaucucucacucaauucagcuugguaaccagaaucagaucgagacauguaaccaaagugucauuacuuacgaaaauaacacguggguuaaucagaccuaugugaacaucagcaauacaaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacucagggggcucuacucaaugacaagcauucaaacggaacaaucaaagaucgcagucccuaucgaacccugaugagcuguccuauuggcgaggucccaucucccuacaacucccguuuugaaucaguggccuggagcgcaagugccugccacgacggcauaaauuggcuuacuaucgggauuucuggaccugauaacggugcuguagcaguucugaaguauaauggcaucauaacagacaccauuaaguccuggagaaacaauaucuugaggacgcaagagagcgagugugccugcgugaacgggucguguuucacuaucaugaccgauggaccaucugacggccaggcuuccuacaaaauuuuucggaucgaaaaggguaaaauugucaagucaguggagaugaaugcccccaacuaucauuacgaagagugcaguuguuacccugauagcuccgagauaacaugcgugugccgcgacaauuggcacgggucuaacagaccaugggucagcuucaaucagaaccucgaauaucagaucggauacauuuguucaggcaucuuuggcgauaauccgaggcccaacgacaaaacugggaguugcggaccuguuuccagcaauggugcgaacggcgugaagggguucucuuuuaaguauggaaacggcguauggaucggucggaccaaaucaauuaguagccgcaauggguucgagaugauaugggauccaaacggcuggacaggaaccgacaauaacuuuuccaucaagcaagacauugugggcaucaaugaauggucuggguacucggggagcuucguccagcaucccgagcugacgggucuggauuguauucgaccuugcuucuggguggaacucaucagaggcaggccaaaagagaacacuauauggacauccgggucaaguaucucuuuuuguggaguuaauagcgacaccgugggcugguccuggcccgauggugcagaguuaccguucacuauugacaaguga

SEQ ID NO: 143023 - RNA, 1410 nt, Artificial Sequence
  derived and/or modified sequence opt3 from neuraminidase__InfluenzaA__AEM92500
augaaccccaaucagaagaucauuaccauaggcagcgugugcaugaucauugggauggccaaccugaugcuccaaaucggaaauauuaucuccauauggaucucucacucaauucagcuugguaaccagaaucagaucgagacauguaaccaaagugucauuacuuacgaaaauaacacguggguuaaucagaccuaugugaacaucagcaauacaaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacucagggggcucuacucaaugacaagcauucaaacggaacaaucaaagaucgcagucccuaucgaacccugaugagcuguccuauuggcgaggucccaucucccuacaacucccguuuugaaucaguggccuggagcgcaagugccugccacgacggcauaaauuggcuuacuaucgggauuucuggaccugauaacggugcuguagcaguucugaaguauaauggcaucauaacagacaccauuaaguccuggagaaacaauaucuugaggacgcaagagagcgagugugccugcgugaacgggucguguuucacuaucaugaccgauggaccaucugacggccaggcuuccuacaaaauuuuucggaucgaaaaggguaaaauugucaagucaguggagaugaaugcccccaacuaucauuacgaagagugcaguuguuacccugauagcuccgagauaacaugcgugugccgcgacaauuggcacgggucuaacagaccaugggucagcuucaaucagaaccucgaauaucagaugggauacaucuguucaggcauuuuuggcgauaauccgaggcccaacgacaaaacugggaguugcggaccuguuuccagcaauggugcgaacggcgugaagggguucucuuuuaaguauggaaacggcguauggaucggucggaccaaaucaaucaguagccgcaauggguucgagaugauuugggauccaaacggcuggacaggaaccgacaauaaguuuuccauaaaacaagacaucgugggcauuaacgaauggucuggguacucggggagcuucguccagcaucccgagcugacgggucuggauuguauccgaccuugcuucuggguggaacucauuagaggcaggccaaaggagaauacuaucuggacauccgggucaaguauaucuuuuuguggaguuaacagcgacaccgugggcugguccuggcccgauggugcagaguuaccguucacuaucgacaaauga

SEQ ID NO: 143024 - RNA, 1410 nt, Artificial Sequence
  derived and/or modified sequence opt3 from neuraminidase__InfluenzaA__AEM92520
augaaccccaaucagaagaucauuaccauaggcagcgugugcaugacaaucgggauggccaaccugaugcuccaaauuggaaauaucauuuccaucuggauaucucacucaauccagcuugguaaccagaaucagauugagacuuguaaccaaagugucaucacguacgaaaauaacaccuggguuaaucagacauaugugaacauuagcaauacuaacuucgcugcaggccaguccguagugucugucaaacuggccggaaauucgucauugugcccugugagcggaugggcgaucuacaguaaggacaacuccauaagaauuggcucuaaaggugauguuuuugugaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggucccaucucccuacaacucccguuuugaaucaguggccuggagcgcaagugccugccacgacggcauuaauuggcuuacaauagggaucucuggaccugauaacggugcuguagcaguucugaaguauaauggcauuaucaccgacacgauaaaguccuggagaaacaauauuuugaggacucaagagagcgagugugccugcgugaacgggucguguuucaccgucaugacagauggaccaucugacggccaggcuuccuacaaaaucuuucggaucgaaaaggguaaaauugugaagucaguggagaugaaugcccccaacuaucauuacgaagagugcaguuguuacccugauagcuccgagaucacuugcgucugccgcgacaauuggcacgggucuaacagaccauggguuagcuucaaucagaaccucgaauaucagauuggauacauauguucaggcaucuuuggcgauaauccgaggcccaacgacaaaaccgggaguugcggaccuguguccagcaauggugcgaacggcguaaagggguucucuuuuaaguauggaaacggcguguggauuggucggacaaaaucaaucaguagccgcaauggguucgagaugaucugggauccaaacggcuggaccggaacggacaauaacuuuuccauuaagcaagacauaaucggcauuaaugaauggucuggguacucggggagcuucguccagcaucccgagcugacuggucuggauuguauccgaccuugcuucuggguggaacucauuagaggcaggccaaaagagaacacaaucuggaccuccgggucaaguauaucuuuuuguggaguuaauagcgacacugugggcugguccuggcccgauggugcagaguuaccguucacaaucgacaaguga

SEQ ID NO: 143025 - RNA, 1410 nt, Artificial Sequence; identical to SEQ ID NO: 142725
  derived and/or modified sequence opt3 from neuraminidase__InfluenzaA__AEM92550

SEQ ID NO: 143026 - RNA, 1410 nt, Artificial Sequence
  derived and/or modified sequence opt3 from neuraminidase__InfluenzaA__AEM92570
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaagguaauguuuuugugauuagggagccauucaucagcuguuccccguuagaaugccggaccuuuuuccugacacagggggcucuacucaacgauaagcauucaaacggaaccaucaaagaccgcagucccuaucgaacucugaugagcuguccuauuggcgaggucccaucucccuacaauucccguuuugaaucaguggccuggagcgcaagugccugccacgauggcauaaacuggcuuacaaucgggauuucuggaccugacaauggugcuguagcaguucugaaguauaacggcaucauaaccgauacgauuaaguccuggagaaauaacaucuugaggacucaagagagcgagugugccugcgugaaugggucguguuucaccaucaugacagacggaccaucugauggccaggcuuccuacaaaauuuuucggaucgaaaaggguaaaauugucaagucaguggagaugaacgcccccaauuaucauuacgaagagugcaguuguuacccugacagcuccgagauaacuugcgugugccgcgauaacuggcacgggucuaauagaccaugggucagcuucaaccagaaucucgaauaucagaucggauacauuuguucaggcaucuuuggcgacaacccgaggcccaaugauaaaaccgggaguugcggaccuguuuccagcaacggugcgaacggcgugaagggguucucuuuuaaguauggaaauggcguauggaucggucggacaaaaucaauuaguagccgcaagggguucgagaugauaugggacccaaacggcuggaccggaacggauaauaacuuuuccaucaaacaagacauugugggcaucaaugaauggucuggguacucggggagcuucguccagcaucccgagcugacuggucuggacuguauucgaccuugcuucuggguggaacucaucagaggcaggccaaaggagaacacaauauggaccuccgggucaaguaucucuuuuuguggaguuaauagcgauacugugggcugguccuggcccgacggugcagaguuaccguucacaauugauaaauga

SEQ ID NO: 143027 - RNA, 1410 nt, Artificial Sequence
  derived and/or modified sequence opt3 from neuraminidase__InfluenzaA__AEM92580
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucuaauggccaggcuuccuacaaaauuuuucggaucgaaaaggguaaaauugucaagucaguggagaugaacgcccccaauuaucauuacgaagagugcaguuguuacccugacagcuccgagauaacuugcgugugccgcgauaacuggcacgggucuaauagaccaugggucagcuucaaccagaaucucgaauaucagaucggauacauuuguucaggcaucuuuggcgacaacccgaggcccaaugauaaaaccgggaguugcggaccuguuuccagcaacggugcgaacggcgugaagggguucucuuuuaaguauggaaauggcguauggaucggucggacaaaaucaauuaguagccgcaagggguucgagaugauaugggacccaaacggcuggaccggaacggauaauaacuuuuccaucaaacaagacauugugggcaucaaugaauggucuggguacucggggagcuucguccagcaucccgagcugacuggucuggacuguauucgaccuugcuucuggguggaacucaucagaggcaggccaaaggagaacacaauauggaccuccgggucaaguaucucuuuuuguggaguuaauagcgauacugugggcugguccuggcccgacggugcagaguuaccguucacaauugauaaauga

SEQ ID NO: 143028 - RNA, 1410 nt, Artificial Sequence; identical to SEQ ID NO: 142725
  derived and/or modified sequence opt3 from neuraminidase__InfluenzaA__AEM92590

SEQ ID NO: 143029 - RNA, 1410 nt, Artificial Sequence; identical to SEQ ID NO: 142725
  derived and/or modified sequence opt3 from neuraminidase__InfluenzaA__AEM92600

SEQ ID NO: 143030 - RNA, 1410 nt, Artificial Sequence
  derived and/or modified sequence opt3 from neuraminidase__InfluenzaA__AEM92610
augaaccccaaucagaagaucauuaccauaggcagcgugugcaugacaaucgggauggccaaccugaugcuccaaauuggaaauaucauuuccaucuggauaucucacucaauccagcuugguaaccagaaucagauugagacuuguaaccaaagugucaucacguacgaaaauaacaccuggguuaaucagacauaugugaacauuagcaauacuaacuucgcugcaggccaguccguagugucugucaaacuggccggaaauucgucauugugcccugugagcggaugggcgaucuacaguaaggacaacuccauaagaauuggcucuaaaggugauguuuuugugaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggucccaucucccuacaacucccguuuugaaucaguggccuggagcgcaagugccugccacgacggcauuaauuggcuuacaauagggaucucuggaccugauaacggugcuguagcaguucugaaguauaauggcauuaucaccgacacgauaaaguccuggagaaacaauauuuugaggacucaagagagcgagugugccugcgugaacgggucguguuucaccgucaugacagauggaccaucugacggccaggcuuccuacaaaaucuuucggaucgaaaaggguaaaauugugaagucaguggagaugaaugcccccaacuaucauuacgaagagugcaguuguuacccugauagcuccgagaucacuugcgucugccgcgacaauuggcacgggucuaacagaccauggguuagcuucaaucagaaccucgaauaucagauuggauacauauguucaggcaucuuuggcgauaauccgaggcccaacgacaaaaccgggaguugcggaccuguguccagcaauggugcgaacggcguaaagggguucucuuuuaaguauggaaacggcguguggauuggucggacaaaaucaaucaguagccgcaauggguucgagaugaucugggauccaaacggcuggaccggaacggacaauaacuuuuccauuaagcaagacauagucggcaucaaugaauggucuggguacucggggagcuucgugcagcaucccgagcugacuggucuggauuguauucgaccuugcuucuggguugaacucaucagaggcaggccaaaagagaacacaauuuggaccuccgggucaaguaucucuuuuuguggagugaauagcgacacugucuccuggucauggcccgauggcgcagaguuaccguucacaauagacaaguga

SEQ ID NO: 143031 - RNA, 1410 nt, Artificial Sequence
  derived and/or modified sequence opt3 from neuraminidase__InfluenzaA__AEM92620
augaaccccaaucagaagaucauuaccauaggcagcgugugcaugaucauugggauggccaaccugaugcuccaaaucggaaauauuaucuccauauggaucucucacucaauucagcuugguaaccagaaucagaucgagacauguaaccaaagugucauuacuuacgaaaauaacacguggguuaaucagaccuaugugaacaucagcaauacaaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacucagggggcucuacucgacgauaagcauucaaauggaacaaucaaagaccgcagucccuaucgaacccugaugagcuguccuauuggcgaggucccaucucccuacaacucccguuuugaaucaguggccuggagcgcaagugccugccacgauggcauaaacuggcuuacuaucgggauuucuggaccugacaauggugcuguagcaguucugaaguauaacggcaucauaacagauaccauuaaguccuggagaaauaacaucuugaggacgcaagagagcgagugugccugcgugaaugggucguguuucacuaucaugaccgacggaccaucugauggccaggcuuccuacaaaauuuuucggaucgaaaaggguaaaauugucaagucaguggagaugaacgcccccaauuaucauuacgaagagugcaguuguuacccugacagcuccgagauaacaugcgugugccgcgauaacuggcacgggucuaauagaccaugggucagcuucaaccagaaucucgaauaucagaugggauacaucuguucaggcauuuuuggcgacaacccgaggcccaaugauaaaacugggaguugcggaccuguuuccagcaacggugcgaauggcgugaagggguucucuuuuaaguauggaaacggcguauggaucggucggaccaaaucaaucaguagccgcaacggguucgagaugauuugggacccaaauggcuggacaggaaccgacaacaaguuuuccauaaaacaagauaucgugggcauuaaugaauggucuggguacucggggagcuucguccagcaucccgagcugacgggucuggacuguauccgaccuugcuucuggguggaacucauuagaggcaggccaaaggagaacacuaucuggacauccgggucaaguauaucuuuuuguggaguuaauagcgauaccgugggcugguccuggcccgacggugcagaguuaccguucacuaucgauaaauga

SEQ ID NO: 143032 - RNA, 1410 nt, Artificial Sequence
  derived and/or modified sequence opt3 from neuraminidase__InfluenzaA__AEM92650
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucugacggccaggcuuccuacaaaaucuuucggaucgaaaaggguaaaauugugaagucagucgagaugaaugcccccaacuaucauuacgaagagugcaguuguuacccugauagcuccgagaucacuugcguuugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacacuaaguuuuccauuaaacaagacauagugggcaucaaugaauggucuggguacucggggagcuucguucagcaucccgagcugacaggucuggauuguauucgaccuugcuucuggguggaacucaucagaggcaggccaaaggagaacaccauuuggacuuccgggucaaguaucucuuuuuguggagucaauagcgacacagugggcugguccuggcccgauggugcagaguuaccguucaccauagacaaauga

SEQ ID NO: 143033 - RNA, 1410 nt, Artificial Sequence; identical to SEQ ID NO: 141426
  derived and/or modified sequence opt3 from neuraminidase__InfluenzaA__AEM98410

SEQ ID NO: 143034 - RNA, 1410 nt, Artificial Sequence; identical to SEQ ID NO: 141426
  derived and/or modified sequence opt3 from neuraminidase__InfluenzaA__AEM98421

SEQ ID NO: 143035 - RNA, 1410 nt, Artificial Sequence; identical to SEQ ID NO: 141426
  derived and/or modified sequence opt3 from neuraminidase__InfluenzaA__AEM98432

SEQ ID NO: 143036 - RNA, 1410 nt, Artificial Sequence; identical to SEQ ID NO: 142802
  derived and/or modified sequence opt3 from neuraminidase__InfluenzaA__AEN55401

SEQ ID NO: 143037 - RNA, 1410 nt, Artificial Sequence; identical to SEQ ID NO: 141029
  derived and/or modified sequence opt3 from neuraminidase__InfluenzaA__AEN55411

SEQ ID NO: 143038 - RNA, 1410 nt, Artificial Sequence
  derived and/or modified sequence opt3 from neuraminidase__InfluenzaA__AEN55421
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaagacagucuguagugucggucaaacuggccggcaacucauccuugugcccugugagugggugggcgauauacuccaaggacaauucuauuaggaucggaagcaaaggcgauguuuuugugauucgggagccauucaucuccuguucaccguuagaaugccgcaccuuuuuccugacacagggugcucuacucaacgacaagcauaguaaugggaccaucaaagaucgaagccccuaucguacucugaugucuuguccuauuggagaggucccaucccccuacaacucaagauuugaaagcguggccuggagugcaucugccugccacgacggcauaaacuggcuuacaaucggcauuuccgggccugauaauggagcuguagcaguucugaaguauaacgguaucauaaccgacacgauuaagagcuggaggaauaacaucuugcggacucaagagucggagugugugugcgucaauggcucuuguuucaccaucaugacagaugggccauccgacggacaggccucauacaaaauuuuucgcaucgaaaagggcaaaauugugaagaguguggagaugaacgcucccaauuaucauuacgaagagugcagcuguuacccugauuccucugagauaacuugcgucugcagagacaacuggcacgguagcaauaggccauggguuucauucaaccagaaucucgaauaucagaucggguacauuuguaguggaaucuuuggcgauaacccgcggcccaaugacaaaaccggcuccugcgggccugugagcucuaacggagccaaugguguaaagggcuucucauuuaaguaugggaacggaguguggaucggccgcacaaaaaguauuagcucccgaaaggguuucgagaugauaugggauccaaacggguggaccggcacggacaauaacuuuucuaucaaacaagacauugucggaaucaaugaauggucgggcuacagcggguccuucgugcagcaucccgagcugacuggacuggauuguauuagaccuugcuucuggguugaacucaucaggggucggccaaaggagaacacaauauggaccucaggcaguucuaucagcuuuuguggggugaauagcgacacugucggauggucauggcccgauggcgcggaguuaccguucacaauugacaaauga

SEQ ID NO: 143039 - RNA, 1410 nt, Artificial Sequence
  derived and/or modified sequence opt3 from neuraminidase__InfluenzaA__AEN55466
augaaccccaaucagaagaucauuaccauaggcagcgugugcaucacaauugggauggccaaccugauccuccaaauuggaaauacuaucuccauauggaucucucacucaauucagcuugguaaccagaaucagaucgagacguguaaccaaagugucauuaccuacgaaaauaacacauggguuaaucagacuuaugugaacaucagcaauaccaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggacauuuuuccugacccagggggcucuacucaaugacaagcauucaaacggaacuaucaaagaucgcagucccuaucgaacacugaugagcuguccuauuggcgaggucccaucucccuacaacucccguuuugaaucaguggccuggagcgcaagugccugccacgacggcauaucuuggcuuaccaucgggauuuccggaccugauaauggugcuguagcaguucugaaguauaacggcaucauaacggacacuauuaagagcuggagaaauaacaucuugaggacccaagagucggagugugccugcgugaaugggucuuguuucacagucaugacugauggaccauccgacggccaggcuucauacaaaaucuuucggauugaaaaggguaaaaucgugaagaguguggagaugaacgcccccaauuaucauuacgaagagugcagcuguuacccugauuccucugagauuaccugcgucugccgcgacaacuggcacgggagcaauagaccauggguuucauucaaccagaaucucgaauaucagauaggauacaucuguaguggcauuuuuggcgauaacccgaggcccaaugacaaaacaggguccugcggaccugugagcucuaacggugcgaauggcguaaagggguucucauuuaaguauggaaacggcguguggaucggucggaccaaaaguaucagcucccgcaacggguucgagaugauuugggauccaaauggcuggacgggaacugacaacaauuuuucuauaaagcaagacaucgucggcauuaacgaauggucgggguacagcggauccuucgugcagcaucccgagcugacaggucuggauuguauccgaccuugcuucuggguugaacucauuagaggcaggccaaaagagaauaccaucuggacuucagggaguucuauaucguuuuguggagugaacuccgacacagucggcuggucauggcccgauggugcagaguuaccguucaccaucgacaaguga

SEQ ID NO: 143040 - RNA, 1410 nt, Artificial Sequence
  derived and/or modified sequence opt3 from neuraminidase__InfluenzaA__AEN55476
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucggucggacaaaaaguauuagcucccgcaagggguucgagaugauaugggauccaaacggcuggaccggaacggacaauaacuuuucuaucaaacaagacauugugggcaucaaugaauggucgggguacagcggauccuucguccagcaucccgagcugacuggucuggauuguauucgaccuugcuucuggguggaacucaucagaggcaggccaaaggagaacacaauauggaccucagggaguucuaucagcuuuuguggaguuaauuccgacacugugucauggagcuggcccgauggcgcagaguuaccguucacaauugacaaauga

SEQ ID NO: 143041 - RNA, 1410 nt, Artificial Sequence; identical to SEQ ID NO: 142273
  derived and/or modified sequence opt3 from neuraminidase__InfluenzaA__AEN55486

SEQ ID NO: 143042 - RNA, 1410 nt, Artificial Sequence; identical to SEQ ID NO: 142273
  derived and/or modified sequence opt3 from neuraminidase__InfluenzaA__AEN55506

SEQ ID NO: 143043 - RNA, 1410 nt, Artificial Sequence
  derived and/or modified sequence opt3 from neuraminidase__InfluenzaA__AEN55516
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaggggugauguuuuugugauucgggagccauucaucuccuguucaccguuagaaugccgcaccuuuuuccugacacagggggcucuacucaacgacaaacauaguaauggaaccaucaaggaucgaagccccuaucguacucugaugucuuguccuauuggcgaggucccaucccccuacaacucaagauuugaaagcguggccuggagugcaucugccugccacgacggcauaaacuggcuuacaaucgggauuuccggaccugauaauggugcuguagcaguucugaaauauaacggcaucauaaccgacacgauuaagagcuggaggaauaacaucuugcggacucaagagucggagugugccugcgugaaugggucuuguuucaccaucaugacagauggaccauccgacggccaggcuucauacaagauuuuucgcaucgaaaaagguaagauugucaaaaguguggagaugaacgcccccaauuaucauuacgaagagugcagcuguuacccugauuccucugagauaacuugcgugugcagagacaacuggcacgggagcaauaggccaugggucucauucaaccagaaucucgaauaucagaucggauacauuuguaguggcaucuuuggcgauaacccgcggcccaaugacaagaccggguccugcggaccuguuagcucuaacggugcgaauggcgugaaaggguucucauuuaaguauggaaacggcguauggaucggucgcacaaagaguauuagcucccgaaaaggguucgagaugauaugggauccaaacggcuggaccggaacggacaauaacuuuucuaucaagcaagacauugugggcaucaaugaauggucgggguacagcggauccuucguccagcaucccgagcugacuggucuggauuguauuagaccuugcuucuggguggaacucaucaggggccggccaaaagagaacacaauauggaccucagggaguucuaucagcuuuuguggaguuaauuccgacacugugggcuggucauggcccgauggugcagaguuaccguucacaauugacaaguga

SEQ ID NO: 143044 - RNA, 1410 nt, Artificial Sequence; identical to SEQ ID NO: 142273
  derived and/or modified sequence opt3 from neuraminidase__InfluenzaA__AEN55526

SEQ ID NO: 143045 - RNA, 1410 nt, Artificial Sequence; identical to SEQ ID NO: 142802
  derived and/or modified sequence opt3 from neuraminidase__InfluenzaA__AEN69429

SEQ ID NO: 143046 - RNA, 1410 nt, Artificial Sequence; identical to SEQ ID NO: 142799
  derived and/or modified sequence opt3 from neuraminidase__InfluenzaA__AEN69438

SEQ ID NO: 143047 - RNA, 1410 nt, Artificial Sequence; identical to SEQ ID NO: 141029
  derived and/or modified sequence opt3 from neuraminidase__InfluenzaA__AEN69484

SEQ ID NO: 143048 - RNA, 1410 nt, Artificial Sequence; identical to SEQ ID NO: 138701
  derived and/or modified sequence opt3 from neuraminidase__InfluenzaA__AEO01627

SEQ ID NO: 143049 - RNA, 1410 nt, Artificial Sequence; identical to SEQ ID NO: 138701
  derived and/or modified sequence opt3 from neuraminidase__InfluenzaA__AEO01638

SEQ ID NO: 143050 - RNA, 1410 nt, Artificial Sequence
  derived and/or modified sequence opt3 from neuraminidase__InfluenzaA__AEO01644
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccgggaaggcagacacuaaaauucucuuuaucgaggaaggaaagauagugcauacaucaaccuuaagcgguagugcccaacacguggaggaaugcucuugcuauccucgcuacccaggcgucagauguguuugcagggauaacuggaagggguccaaccggccgauuguggacaucaauaucaaagaccacagcauuguaucgucuuacguguguuccggacuggucggcgauacgccccgcaagaccgacucaaguagcuccggucauugccuugauccuaacaaugaggaagggggacacggcgugaaaggcugggcuuucgacgaugggaacgacguuuggaugggacgaacaaucucugaaaagagcagauuggguuaugagacuuuuaaagugauugagggcuggucaaauccaaagaguaaacugcagauaaacaggcaggucaucguggaucgggggaaucguuccggauacagcggcauuuucucuguagaggguaagucauguaucaaccgcugcuuuuauguugaacuaaucagagggaggaaggaggaaaccgaggugcucuggacaaguaauagcauugucguguucuguggcacuuccggaaccuacggcacagggucuuggcccgacggagccgauauaaaccugaugccuaucuga

SEQ ID NO: 143051 - RNA, 1410 nt, Artificial Sequence
  derived and/or modified sequence opt3 from neuraminidase__InfluenzaA__AEO01654
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagauauacugcggacgcaggagagcgaauguguuugcaucaauggcacuuguacaguggucaugaccgacggcucugcuuccgggaaggcagauacuaaaauucucuuuaucgaggagggaaagauagugcauacaucaaccuuaagcgguagugcccaacacguggaagagugcucuugcuauccucgcuacccaggcgucagauguguuugcagggacaacuggaagggguccaaccggccgauuguggacaucaauaucaaagaucacagcauuguaucgucuuacguguguuccggacuggucggcgacacgccccgcaagaacgauucaaguagcuccggucauugccuugacccuaauaacgaagagggagggcacggcgugaaaggcugggcuuucgaugacgggaaugauguuuggaugggacgaaccaucucugaaaagagcagauuggguuaugagacauuuaaagugauugagggcuggucaaacccaaagaguaaacugcagauaaauaggcaggucaucguggaccgggggaaccguuccggauacagcggcauuuucucuguagaagguaagucauguaucaaucgcugcuuuuauguugagcuaaucagagggaggaaggaagagacuaaagugcucuggaccaguaacagcauugucguguucuguggcacauccggaacuuacggcaccgggucuuggcccgauggagccgaaauaaaucugaugccuaucuga

SEQ ID NO: 143052 - RNA, 1413 nt, Artificial Sequence; identical to SEQ ID NO: 138648
  derived and/or modified sequence opt3 from neuraminidase__InfluenzaA__AEO01665

SEQ ID NO: 143053 - RNA, 1413 nt, Artificial Sequence
  derived and/or modified sequence opt3 from neuraminidase__InfluenzaA__AEO01676
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuucauuaugaagaguguagcugcuacccagacaccggcaucguuaugugugugugcagggauaacuggcacggcuccaaucggcccugggucucuuucaaccagaaucuggacuaccaaauuggguauaucugcagcggaguguuuggugauaacccucgcccagaggacggcgaagggucauguaauccggugacggucgauggagccaacggcguuaaagguuucaguuacaaguaugacaaugggguguggaucggcagaacuaaauccaacaggcugcggaagggauuugagaugauuugggaccccaauggcuggacaaacaccgauagcgacuucucuguaaaacaggauguggucgcuauaacugacuggucaggguacagugguagcuuugugcagcacccugaacucacaggauuagauugcauccgcccauguuucuggguugagcuggugcgaggccuucccagagaaaacaccacgauuuggaccuccgggucuucgaucuucuuuaggggagacaauagcgauacagccaacugguccuggccugacggcgcagagaugacuuucaccauugauaaguga

SEQ ID NO: 143054 - RNA, 1410 nt, Artificial Sequence; identical to SEQ ID NO: 138701
  derived and/or modified sequence opt3 from neuraminidase__InfluenzaA__AEO01693

SEQ ID NO: 143055 - RNA, 1413 nt, Artificial Sequence; identical to SEQ ID NO: 138648
  derived and/or modified sequence opt3 from neuraminidase__InfluenzaA__AEO01711

SEQ ID NO: 143056 - RNA, 1410 nt, Artificial Sequence; identical to SEQ ID NO: 142824
  derived and/or modified sequence opt3 from neuraminidase__InfluenzaA__AEO37533

SEQ ID NO: 143057 - RNA, 1410 nt, Artificial Sequence
  derived and/or modified sequence opt3 from neuraminidase__InfluenzaA__AEO37543
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagccuuguaaccaaagugucauuacuuacgaaaauaacacguggguuaaucagaccuaugugaacaucagcaauacaaacuucgcugcaggccaguccguagugucugucaaacuggccggaaauucgucauugugcccagugagcggaugggcgauauacaguaaggacaacuccauuagaaucggcucuaaaggugauguuuuugugauuagggagccguucaucagcuguucccccuuagaaugccggaccuuuuuccugacucagggggcucuacucaaugacaagcauucaaacggaacaaucaaagaucgcaguccuuaucgaacccugaugagcuguccaauuggcgagguccccucuccuuacaacucccguuuugaaucaguggccuggagcgcaagugccugccacgacggcauaaauuggcuuacuaucgggauuucuggaccagauaacggugcuguagcaguucugaaguauaauggcaucauaacagacaccauuaaguccuggagaaacaauaucuugaggacgcaagagagcgagugugccugcgugaacgggucguguuucacugucaugaccgauggacccucugacggccaggcuuccuacaaaaucuuucggauugaaaaggguaaaaucgugaagucaguggagaugaaugccccuaacuaucauuacgaagagugcaguuguuacccagauagcuccgagauuacaugcgucugccgcgacaauuggcacgggucuaacagaccguggguuagcuucaaucagaaccucgaauaucagauaggauacaucuguucaggcauuuuuggcgauaaucccaggccuaacgacaaaacugggaguugcggaccaguguccagcaauggugcgaacggcguaaagggguucucuuuuaaguauggaaacggcguguggaucggucggaccaaaucaaucaguagccgcaauggguucgagaugauuugggaucccaacggcuggacaggaaccgacaauaacuuuuccgucaagcaagacauaaucggcauuaaugaauggucuggguacucggggagcuucgugcagcauccugagcugacgggucuggauuguauccgaccaugcuucuggguugaacucauuagaggcaggcccaaagagaacacuaucuggacauccgggucaaguauaucuuuuuguggagugaauagcgacaccgucggcugguccuggccggauggugcagaguuaccuuucacuaucgacaaguga

SEQ ID NO: 143058 - RNA, 1410 nt, Artificial Sequence; identical to SEQ ID NO: 142273
  derived and/or modified sequence opt3 from neuraminidase__InfluenzaA__AEO72179

SEQ ID NO: 143059 - RNA, 1350 nt, Artificial Sequence
  derived and/or modified sequence opt3 from neuraminidase__InfluenzaA__AEO88957
augaaccccaaucagaagaucauuaccauaggcagcaucugcauggugauugggaucgucucccugaugcuccaaauuggaaacaugaucucuauauggguuucacacaguacacagacugguaaucagcaucaggccgagccuaucagaaacacgaauuuccuuaccgaaaacgcuguggcaagcguaacacuggccggcaauuccucuuuguguccaauuagggggugggcggugcacucgaaagacaacucaauccggauuggaagcaagggcgaugucuuugugauccgcgagccguucauaaguugcucccauuuagaaugucgaaccuuuuuccugacucaaggugcucuacucaaugacaaacacucuaacgggacaguuaaggaucguagcccccauagaacccugauguccugcccugugggagaggccccaucacccuacaauaguagguuugaaagcgucgcauggucugccuccgcuugucacgacggcacuucauggcuuacaauuggcaucagcgggccugauaacggagcaguggccguacugaaauauaaugguauuaucaccgacacgaucaagaguuggcggaacaauauuuugcgcacucaggagucugagugcgcuuguguuaacggcuccugcuucaccgugaugacagaugggccaagcaacggacaggccucguacaagauauuuaaaauggaaaagggcaaagucgugaagucuguggagcucaaugcgcccaacuaucacuacgaagaguguuccugcuauccugacgcaggagagaucauuugugucugcagagauaauuggcaugggucaaacaggccauggguuaguuucaaucagaaccuggaauaccaaaucggauauauaugcagcggcguguuuggcgacaauccgcggcccaacgaugggacuggauccugugguccuguaucuccaaauggcgccuacgggauuaaaggauucagcuuuaaguacggcaacgguguguggaucgggcgcaccaagucaacaaauagucgauccggcuucgagaugaucugggaccccaacggauggaccggcacggauagcaauuuuucugucaaacaggacauuguggcuaucacugacuggucaggguauagugguagcuucguucagcacccugaacugacaggucucgauugcauuagaccauguuucuggguggaguuaauaaggggccggcccaaggaauccaccaucuggacuucugggucgagcauuuccuuuugcggagucaacucagacacagugaguuggucuuggccggauggcgccgagcugccuuucaccaucgacaaauga

SEQ ID NO: 143060 - RNA, 1350 nt, Artificial Sequence
  derived and/or modified sequence opt3 from neuraminidase__InfluenzaA__AEO88965
augaaccccaaucagaagaucauuaccauaggcagcaucugcauggugauugagaucgucucccugaugcuccaaauugggaacaugaucucuauauggguuucacacaguauccagacuaaaaaucagagacaggccgaaccuauuagcaacacaaaguuccuuacggagaaagcuguggcauccguaacccuggccggaaauucuucguuguguccaaucucagguugggcggugcauagcaaggacaacaguauuaggaucggcuccaaaggggaugucuuugugauacgggaaccguucauuucuugcagccacuuagagugucgcacauuuuuccugacucaaggagcucuacucaaugacaagcauuccaacggcaccguuaaggaucgaucaccccaccguacacugaugaguugcccugugggugaagccccaagccccuacaauucuagauuugaguccgucgcauggucagccagcgcuugucaugacgggaccaguuggcuuacuaucggaauuucuggcccugauaacggcgcaguggccguacugaaauauaaugggaucaucacagacaccauuaaguccuggaggaacaauauauugcggacgcaggagagcgaaugcgcuuguguuaacggaucgugcuucacugugaugaccgaugguccaucuaauggccaggccuccuacaaaaucuuuaagauggagaaagggaaggucgugaagucaguggaacucgacgcgcccaacuaucacuacgaggaguguaguugcuauccugaugcaggagaaauuacaugugucugccgcgacaacuggcacggcagcaauagaccauggguuuccuucaaccagaaucuggaguaccaaaucgguuauauaugcucugggguguuuggagauaacccgaggcccaaugacggcacuggcagcugugggccuguaucaccaaacggagccuacggugugaaaggcuucaguuuuaaguacgggaauggagucuggauuggccggaccaaauccacaaacagccgcucugguuucgaaaugaucugggaucccaauggguggaccggcacggacucaaguuuuagcgugaagcaggacaucguugcuauuacugauugguccggauauucuggcucguucgugcagcauccugagcugacagggcucaacugcauccgaccauguuucugggucgaauuagugagaggaaggcccaaagagagcaccauuuggacuuccgguucaaguauaucuuuuugcggcguaaauagcgacacaguugggugguccuggccggauggagccgagcugccuuucaccaucgacaaguga

SEQ ID NO: 143061 - RNA, 1350 nt, Artificial Sequence
  derived and/or modified sequence opt3 from neuraminidase__InfluenzaA__AEO88973
augaaccccaaucagaagaucauuaccauaggcagcaucugcauggugauugggaucgucucccugaugcuccaaauuggaaacaugaucucucuuuggguuucacacaguauacagacagguaaucagcaucagguggagccuaucagcaacacuaauuuccugacggaaaaagccguagcuuccgugaccuuggcaggcaacucuucguuauguccaauuagagggugggccguccacucaaaggacaauagcaucaggauuggaaguaaaggcgauguguuuguuauccgggagccguucauauccugcucucaucuggaaugucgcacauuuuuccuaacucaaggugcgcuccugaacgacaagcacagcaaugggaccgugaaagaucgaucaccccaucguacacuuauguccugcccugucggagaggcuccaagucccuacaacagcagauuugaaucuguggccugguccgcaucagccugucacgacggcaccagcuggcugacuauuggcaucagugggccugauaauggagcuguagcaguuuugaaguauaacgguaugauuacagacaccaucaagucuuggaggaauaacauccuccggacgcaggaguccgagugcgccugugugaauggcagcugcuucacugucaugaccgaugggccaucgaacggacaggcuucuuacaaaauuuuuaagauggaaaaaggccgcguggugaaguccgucgagcuggacgcccccaacuaucacuacgaagaguguucaugcuauccugaugcgggugagauaacauguguuugcagagacaauuggcaugggaguaacaggccaugggugagcuucaaucagaaccuggaauaccaaaucggauauauuugcuccggcguauuuggcgauaauccgcggcccaacgacgggacuggaucuugugguccugugagcccaaauggcgcauacggggucaaaggauucucauuuaaguacggcaacgguguguggaucgggcgcaccaagagucccaauucccgaagcggcuucgagaugauaugggauccuaacggauggauugaaacagacucuucauuuaguguuaaacaggacaucguggccaucaccgauuggagcggcuauuccgggucuuucguccagcacccagagcucacgggauuagacugcauuagacccuguuucuggguggaacugaucaggggucggccgaaggagucgacuauuuggacaagcggcuccucaauaaguuuuugcgggguaaauucugauaccguuagcugguccuggccugacggagcugagcuucccuucacuaucgauaaauga

SEQ ID NO: 143062 - RNA, 1350 nt, Artificial Sequence
  derived and/or modified sequence opt3 from neuraminidase__InfluenzaA__AEO88982
augaaccccaaucagaagaucauuaccauaggcagcaucugcauggugauugggaucgucucccugaugcuccaaauuggaaacaugaucucuauauggguuucacacaguauccagacagguaaucagcaucaggccgagccuauuagaaacacuaauuuccuuacggaaaacgcuguggcaagcguaacccuggccggcaauuccucuuuguguccagugagggggugggcgguccacucgaaagacaacucaauccggauuggaagcaagggcgauguguuuguuauccgcgagccguucauaaguugcucccauuuagaaugucgaacauuuuuccugacucaaggugcucuacucaaugacaaacacucuaacgggaccgugaaggaucguagcccccauagaacacugauguccugcccugucggagaggccccaucacccuacaauaguagguuugaaagcguggcauggucugccuccgcuugucacgacggcaccucauggcuuacuauuggcaucagcgggccugauaacggagcaguagccguucugaaauauaaugguauuaucacagacaccaucaagaguuggcggaacaauauuuugcgcacgcaggagucugagugcgcuugugugaacggcuccugcuucacugucaugaccgaugggccaagcaacggacaggccucguacaagauauuuaaaauggaaaagggcaaaguggugaagucugucgagcucaaugcgcccaacuaucacuacgaagaguguuccugcuauccugacgcaggagagaucacauguguuugcagagauaauuggcaugggucaaacaggccaugggugaguuucaaucagaaccuggaauaccaaauuggauauaucugcagcggcauauuuggcgacaauccgcggccccacgaugggacuggauccugugguccuguaucuccaaacggcgccuacgggauuaaaggauucagcuuuaaguacggcaaugguguguggaucgggcgcaccaagucaacaaacagucgauccggcuucgagaugaucugggaccccaauggauggaccggcacggauagcaacuuuucugucaaacaggacauuguggcuaucacugacuggucaggguauagugguagcuucguucagcauccugaacugacaggucucgauugcauuagaccauguuucuggguggaguuaauaaggggccggcccaaggaauccaccaucuggacuucugggucgagcauuuccuuuugcggagucaauucagacacagugaguuggucuuggccggaugacgccgagcugccuuucaccaucgauaaauga

SEQ ID NO: 143063 - RNA, 1350 nt, Artificial Sequence
  derived and/or modified sequence opt3 from neuraminidase__InfluenzaA__AEO88990
augaaccccaaucagaagaucauuaccauaggcagcaucugcauggugauugggaucgucucccugaugcuccaaauuggaaacaugaucucuauauggguuucacacaguauccagacagguaaucagcaucaggccgagccuauuagaaacacuaauuuccuuacggaaaacgcuguggcaagcguaacccuggccggcaauuccucuuuguguccagugagggggugggcgguccacucgaaagacaacucaauccggauuggaagcaagggcgauguguuuguuauccgcgagccguucauaaguugcucccauuuagaaugucgaacauuuuuccugacucaaggugcucuacucaaugacaaacacucuaacgggaccgugaaggaucguagcccccauagaacacugauguccugcccugucggagaggccccaucacccuacaauaguagguuugaaagcguggcauggucugccuccgcuugucacgacggcaccucauggcuuacuauuggcaucagcgggccugauaacggagcaguagccguucugaaauauaaugguauuaucacagacaccaucaagaguuggcggaacaauauuuugcgcacgcaggagucugagugcgcuugugugaacggcuccugcuucacugucaugaccgaugggccaagcaacggacaggccucguacaagauauuuaaaauggaaaagggcaaaguggugaagucugucgagcucaaugcgcccaacuaucacuacgaagaguguuccugcuauccugacgcaggagagaucacauguguuugcagagauaauuggcaugggucaaacaggccaugggugaguuucaaucagaaccuggaauaccaaauuggauauaucugcagcggcguauuuggcgacaauccgcggcccaacgaugggacuggauccugugguccugugucuccaaauggcgccuacgggauaaaaggauucagcuuuaaguacggcaacggugucuggauugggcgcaccaagucaacaaauagucgauccggcuucgagaugaucugggaccccaacggauggaccggcacggauagcaauuuuucugugaaacaggacaucguugcuauuacugacuggucaggguauagugguagcuucgugcagcacccugaacugacaggucucgauugcaucagaccauguuucugggucgaguuaauuaggggccggcccaaggaauccaccauauggacuucugggucgagcaucuccuuuugcggagugaacucagacacaguaaguuggucuuggccggaugacgccgagcugccuuucaccauugauaaauga

SEQ ID NO: 143064 - RNA, 1350 nt, Artificial Sequence
  derived and/or modified sequence opt3 from neuraminidase__InfluenzaA__AEO88998
augaaccccaaucagaagaucauuaccauaggcagcaucugcauggugauugggaucgucucccugaugcuccaaauuggaaacaugaucucuauauggguuucacacaguauccagacagguaaucagcaucaggccgagccuauuagaaacacuaauuuccuuacggaaaacgcuguggcaagcguaacccuggccggcaauuccucuuuguguccaaucagggggugggcggugcacucgaaagacaacucaauucggaucggaagcaagggcgaugucuuugugauacgcgagccguucauuaguugcucccauuuagaaugucgaacauuuuuccugacucaaggugcucuacucaaugacaaacacucuaacgggaccguuaaggaucguagcccccauagaacacugauguccugcccugugggagaggccccaucacccuacaauaguagguuugaaagcgucgcauggucugccuccgcuugucacgacggcaccucauggcuuacuaucggcauuagcgggccugauaacggagcaguggccguacugaaauauaaugguaucaucacagacaccauuaagaguuggcggaacaauauauugcgcacgcaggagucugagugcgcuuguguuaacggcuccugcuucacugugaugaccgaugggccaagcaacgaacaggccucguacaagaucuuuaaaauggagaagggaaaagucgugaagucuguggaacucaaugcgcccaacuaucacuacgaggaguguuccugcuauccugacgcaggcgaaauuaucugugucugcagagauaauuggcaugguucaaacaggccauggguuaguuucaaucagaaccuggaguaccaaauaggguauauuugcagcggaguguuuggcgacaauccgcggcccaacgauggcacaggguccuguggaccuguaucuccaaauggugccuacggcaucaaaggguucagcuuuaaguacggaaacggcguguggaucggucgcacuaagucaaccaauagucgauccggguucgaaaugauuugggaccccaacggcuggacaggaaccgauagcaauuuuucugucaaacaggacaucguggcuauuacggacuggucaggcuauagugggagcuucguucagcacccugagcugacuggacucgauugcauaagaccauguuucuggguggaauuaaucaggggucggcccaaggaguccacaauuuggaccucuggcucgagcaucuccuuuugcggggucaacucagacacugugaguuggucuuggccggauggagccgagcugccuuucacaaucgacaaauga

SEQ ID NO: 143065 - RNA, 1350 nt, Artificial Sequence
  derived and/or modified sequence opt3 from neuraminidase__InfluenzaA__AEO89006
augaaccccaaucagaagaucauuaccauaggcagcaucugcauggugauugggaucgucucccugaugcuccaaauuggaaacaugaucucuauauggguuucacacaguauccagacagguaaucagcaucaggccgagccuauuagaaacacuaauuuccuuacggaaaacgcuguggcaagcguaacccuggccggcaauuccucuuuguguccagugagggggugggcgguccacucgaaagacaacucaauccggauuggaagcaagggcgauguguuuguuauccgcgagccguucauaaguugcucccauuuagaaugucgaacauuuuuccugacucaaggugcucuacucaaugacaaacacucuaacgggaccgugaaggaucguagcccccauagaacacugauguccugcccugucggagaggccccaucacccuacaauaguagguuugaaagcguggcauggucugccuccgcuugucacgacggcaccucauggcuuacuauuggcaucagcgggccugauaacggagcaguagccguucugaaauauaaugguauuaucacagacaccaucaagaguuggcggaacaauauuuugcgcacgcaggagucugagugcgcuugugugaacggcuccugcuucacugucaugaccgaugggccaagcaacggacaggccucguacaagauauuuaaaauggaaaagggcaaaguggugaagucugucgagcucaaugcgcccaacuaucacuacgaagaguguuccugcuauccugacgcaggagagaucacauguguuugcagagauaauuggcaugggucaaacaggccaugggugaguuucaaucagaaccuggaauaccaaauuggauauaucugcagcggcguauuuggcgacaauccgcggcccaacgaugggacuggauccugugguccugugucuccaaauggcgccuacgggauaaaaggauucagcuuuaaguacggcaacggugucuggauugggcgcaccaagucaacaaauagucgauccggcuucgagaugaucugggaccccaacggauggaccggcacggauagcgacuuuucugugaaacaggacaucauugcuaucacugauuggucaggguauagugguagcuucguucagcacccugaacugacaggucucgacugcauuagaccauguuucuggguggaguuaauaaggggccggcccaaggaauccaccaucuggacuucugggucgagcauuuccuuuugcggagucaauucagauacagugaguuggucuuggccggacggcgccgagcugccuuucaccaucgauaaauga

SEQ ID NO: 143066 - RNA, 1350 nt, Artificial Sequence
  derived and/or modified sequence opt3 from neuraminidase__InfluenzaA__AEO89023
augaaccccaaucagaagaucauuaccauaggcagcaucugcauggugauugggaucgucucccugaugcuccaaauuggaaacaugguuucucuuugggugucacacaguauccagacagguaaucagcaucagguagagccuauaagcaacacuaauuuccugacggaaaaagccguggcuuccgucaccuuggcaggcaacucuucguuauguccaaucagagggugggccgugcacucaaaggacaauagcauuaggaucggaaguaaaggcgauguuuuugugauucgggagccguucaucuccugcucucaucuggaaugucgcacauuuuuccuaacucaaggugcgcuccugaacgacaagcacagcaaugggaccgucaaagaucgaagcccccaucguacacuuaugucaugcccugugggagaggcuccaagucccuacaacagcagauuugaaucuguagccugguccgcaucagccugucacgacggcaccagcuggcugacuauaggcauuagugggccugauaauggagcuguugcaguguugaaguauaacgguaugaucacagacaccauuaagucuuggaggaauaacauccuccggacgcaggaguccgagugcgccugugucaauggcagcugcuucacugugaugaccgaugggccaucgaacggacaggcuucuuacaaaaucuuuaagauggaaaaaggcaagguggucaaauccguugagcuggacgcccccaacuaucacuacgaagaguguucaugcuauccugaugcgggugagauuacaugugugugccgcgacaauuggcaugggaguaacagaccauggguauccuucaaucagaaccuggaauaccaaauaggauauaucugcuccggcguguuuggcgauaauccgaggcccaacgacgggacuggaucuugugguccugucagcccaaauggcgcauacggggugaagggauucucauuuaaguacggcaacgguguuuggauugggcggaccaaaagucccuccagccgcucuggcuucgagaugaucugggauccuaauggauggacagaaaccgacucaaguuuuagcgugaagcaggacauagucgccauuacggauugguccggcuauucugggucguucgugcagcacccagagcucacuggauuagacugcauccgacccuguuucuggguagaacugaucagagguaggccgaaagagagcacaauuuggaccuccggcucaaguaucucuuuuugcgggguuaacagcgauacuguguccuggucauggccugacggagcugagcuucccuucacaauugauaaguga

SEQ ID NO: 143067 - RNA, 1350 nt, Artificial Sequence
  derived and/or modified sequence opt3 from neuraminidase__InfluenzaA__AEO89032
augaaccccaaucagaagaucauuaccauaggcagcaucugcauggugauugggaucgucucccugaugcuccaaauuggaaacaugaucucuauauggguuucacacaguauccagacagguaaucagcaucaggccgagccuauuagaaacacuaauuuccuuacggaaaacgcuguggcaagcguaacccuggccggcaauuccucuuuguguccagugagggggugggcgguccacucgaaagacaacucaauccggauuggaagcaagggcgauguguuuguuauccgcgagccguucauaaguugcucccauuuagaaugucgaacauuuuuccugacucaaggugcucuacucaaugacaaacacucuaacgggaccgugaaggaucguagcccccauagaacacugauguccugcccugucggagaggccccaucacccuacaauaguagguuugaaagcguggcauggucugccuccgcuugucacgacggcaccucauggcuuacuauuggcaucagcgggccugauaacggagcaguagccguucugaaauauaaugguauuaucacagacaccaucaagaguuggcggaacaauauuuugcgcacgcaggagucugagugcgcuugugugaacggcuccugcuucacugucaugaccgaugggccaagcaacggacaggccucguacaagauauuuaaaauggaaaagggcaaaguggugaagucugucgagcucaaugcgcccaacuaucacuacgaagaguguuccugcuauccugacgcaggagagaucacauguguuugcagagauaauuggcaugggucaaacaggccaugggugaguuucaaucagaaccuggaauaccaaauuggauauaucugcagcggcguauuuggcgacaauccgcggcccaacgaugggacuggauccugugguccugugucuccaaauggcgccuacgggauaaaaggauucagcuuuaaguacggcaacggugucuggauugggcgcaccaagucaacaaauagucgauccggcuucgagaugaucugggaccccaacggauggaccggcacggauagcaauuuuucugugaaacaggacaucguugcuauuacugacuggucaggguauagugguagcuucgugcagcacccugaacugacaggucucgauugcaucagaccauguuucugggucgaguuaauuaggggccggcccaaggaauccaccauauggacuucugggucgagcaucuccuuuugcggagugaacucagacacaguaaguuggucuuggccggauggcgccgagcugccuuucaccauugacaaauga

SEQ ID NO: 143068 - RNA, 1350 nt, Artificial Sequence
  derived and/or modified sequence opt3 from neuraminidase__InfluenzaA__AEO89041
augaaccccaaucagaagaucauuaccauaggcagcaucugcauggugauugggcuggucucccucaugcuucaaaucggaaacaugauuucuaucuggguuucacacaguauacagacagguaaucagcaucaggccgagccuaucagaaacacuaauuuccugacggaaaacgcuguggcaagcguaaccuuggccggcaauuccucuuuauguccagugagggggugggcgguccacucgaaagacaacucaauucggaucggaagcaagggcgauguguuuguuauucgcgagccguucaucaguugcucccaucuggaaugucgaacauuuuuccuaacucaaggugcucuccugaaugacaaacacucuaacgggaccgugaaggaucguagcccccauagaacacuuauguccugcccugucggagaggccccaucacccuacaauaguagguuugaaagcguggcauggucugccuccgcuugucacgacggcaccucauggcugacuauaggcauuagcgggccugauaacggagcaguagccguuuugaaauauaaugguaucauuacagacaccaucaagaguuggcggaacaauauccuccgcacgcaggagucugagugcgcuugugugaacggcuccugcuucacugucaugaccgaugggccaagcaacggacaggccucguacaagauuuuuaaaauggaaaagggcaaaguggugaagucugucgagcugaaugcgcccaacuaucacuacgaagaguguuccugcuauccugacgcaggagagauaacauguguuugcagagauaauuggcaugggucaaacaggccaugggugaguuucaaucagaaccuggaauaccaaaucggauauauuugcagcggcguauuuggcgacaauccgcggcccaacgaugggacuggauccugugguccugugucuccaaauggcgccuacgggaucaaaggauucagcuuuaaguacggcaacggugucuggauagggcgcaccaagucaacaaauagucgauccggcuucgagaugauuugggaccccaacggauggaccggcacggauagcaauuuuucugugaaacaggacaucguugcuaucacugacuggucaggguauagugguagcuucgugcagcacccugaacucacagguuuagauugcauuagaccauguuucuggaucgagcugauuaggggccggcccaaggaauccaccauauggacuucugggucgagcaucuccuuuugcggagucaacucagacacagugaguuggucuuggccggauggcgccgagcuuccuuucaccauugacaaauga

SEQ ID NO: 143069 - RNA, 1350 nt, Artificial Sequence
  derived and/or modified sequence opt3 from neuraminidase__InfluenzaA__AEO89050
augaaccccaaucagaagaucauuaccauaggcagcaucugcauggugauugggaucgucucccugaugcuccaaauuggaaacaugaucucuauauggguuucacacaguauccagacagguaaucagcaucaggccgagccuauuagaaacacuaauuuccuuacggaaaacgcuguggcaagcguaacccuggccggcaauuccucuuuguguccaaucagggggugggcggugcacucgaaagacaacucaauucggaucggaagcaagggcgaugucuuugugauacgcgagccguucauuaguugcucccauuuagaaugucgaacauuuuuccugacucaaggugcucuacucaaugacaaacacucuaacgggaccguuaaggaucguagcccccauagaacacugauguccugcccuaugggagaggccccaucacccuacaauaguagguuugaaagcguggcauggucugccuccgcuugucacgacggcaccucauggcuuacuaucggcauuagcgggccugauaacggagcagucgccgugcugaaauauaaugguaucaucacagacaccauuaagaguuggcggaacaauauauugcgcacgcaggagucugagugcgcuuguguaaacggcuccugcuucacuguuaugaccgaugggccaagcaacggacaggccucguacaagaucuuuaaaauggaaaagggcaaaguggucaagucuguggagcucaaugcgcccaacuaucacuacgaagaguguuccugcuauccugacgccggugagauuaucugugugugcagagauaauuggcaugggucaaacaggccaugggucaguuucaaucagaaccuggaauaccaaauaggauauauuugcagcggcguuuuuggcgacaauccgcggcccaacgaugggacaggauccugugguccugugucuccaaauggcgcauacgggaucaaaggauucagcuuuaaguacggcaacgguguauggaucgggcgcacuaagucaaccaauagucgauccggcuucgagaugauuugggaccccaacggauggacaggcaccgauagcgacuuuucugugaaacaggacaucgucgcuauuacggauuggucaggguauaguggaucauucgugcagcacccugaacugacuggucucgacugcauaagaccauguuucuggguugaguuaaucaggggccggcccaaggaauccacaauuuggaccucugggucgagcaucuccuuuugcggagugaauagcgauacugucaguuggucuuggccggacggcgccgagcugccuuucacaaucgauaaauga

SEQ ID NO: 143070 - RNA, 1350 nt, Artificial Sequence
  derived and/or modified sequence opt3 from neuraminidase__InfluenzaA__AEO89058
augaaccccaaucagaagaucauuaccauaggcagcaucugcauggugauugggaucgucucccugaugcuccaaauuggaaacaugaucucuauauggguuucacacaguauccagacagguaaucagagacaggccgagccuauuagcaacacuaaauuccuuacggaaaaggcuguggcauccguaacccuggccggcaauucuucguuguguccaaucucagggugggcgguguacagcaaagacaacaguauuaggaucggaucccggggcgaugucuuugugauacgcgagccguucauuucuugcagccauuuagaaugucgaacauuuuuccugacucaaggugcucuacucaaugacaagcacuccaacgggaccguuaaagaucguucaccccauagaacacugaugaguugcccugugggagaggccccaagccccuauaauucuagguuugaauccgucgcauggucagccagcgcuugucacgacggcaccaguuggcuuacuaucggcauuucugggccugauaacggagcaguggccguacugaaguacaaugguaucaucacagacaccauuaaguccuggcggaacaauauauugcgcacgcaggagagcgagugcgcuuguguuaacggcucgugcuucacugugaugaccgaugggccaucuaauggacaggccuccuauaaaaucuuuaagauggaaaaaggcaaggucgugaaaucaguggagcucgacgcgcccaacuaccauuaugaagaguguaguugcuacccugaugccggugagauuacaugugucugcagagacaacuggcacgggagcaauaggccauggguuuccuucaaccagaaucuggauuaucaaaucggauacauaugcucuggcguguuuggcgacaacccgcggcccaaugaugggacuggaagcugugguccuguaucaccaaacggcgcauacggggugaagggauucaguuuuaaguauggcaauggugucuggauugggcgcaccaaauccacaaacagccgaucuggcuucgaaaugaucugggaccccaauggauggaccggcacggacucaaguuuuagcgugaagcaggauaucguugcuauuacugacugguccggguacucuggaucguucgugcagcacccugagcugacaggucucgauugcaucagaccauguuucugggucgaauuaauuaggggccggcccaaagagagcaccauauggacuuccgggucaaguaucucuuuuugcggagugaacagcgacacaguauccuggucauggccggauggcgccgaacugccuuucaccauugacaaguga

SEQ ID NO: 143071 - RNA, 1350 nt, Artificial Sequence
  derived and/or modified sequence opt3 from neuraminidase__InfluenzaA__AEO89075
augaaccccaaucagaagaucauuaccauaggcagcaucugcauggugauugggaucgucucccugaugcuccaaauuggaaacaugaucucuauauggguuucacacaguauccagagagguaaucuuaaccagguggagccuauuagcaauacaaacuuccugacugaaaaagccguagcuuccgugacguuggcaggcaauucuucguuauguccaaucagggggugggccauucauucaaaggacaacagcauccggauaggaaguaaaggcgaugucuuugugauucgcgagccguucaucuccugcucucaccuggaaugucgaaccuuuuuccuaacacagggugcgcuccugaaugacaagcauagcaacgggacuguuaaagaucguucaccccacagaacccuuauguccugcccugugggagaggucccaagucccuacaauagcagguuugaaucuguggcuugguccgccucagcaugucaugacggcacaagcuggcugaccauuggcaucagugggccugauaacggagccguagcuguugugaaguauaaugguaucauuacugacacaauaaagucuuggcggaacaauaucuugcgcacccaagaguccgagugcgcaugugucaacggcagcugcuucacggugaugacugaugggccaucgaacggacaggccucuuacaaaauuuuuaagauggaaaaaggcaaggugaucaaauccgucgagcucgacgcucccaauuaucacuacgaagaguguucaugcuauccugaugccggugagauaaccuguguuugcagagacaacuggcacgggaguaauaggccaugggugagcuucaaccagaaucuggaauaccagauuggauauaucugcuccggcguauuuggcgauaacccgcggcccaaugacgggacaggaucuugugguccugugagcccaaacggcgcguacggggucaagggauucucauuuaaguacggcaaugguguguggaucgggcgcacuaaaagucccaacucccgaagcggcuucgagaugauuugggauccuaauggauggucugaaaccgacucaaguuuuagcguuaagcaagacaucguggcaauuacagauugguccggcuauucugggucguucguccagcauccagagcugaccggacucgacugcauaagacccuguuucuggguggaauuaaucaggggucggccgaaagagagcacgauuuggacuuccggcucaaguaucucuuuuugcgggguaaacagcgauacaguuuccuggucauggccugacggagccgagcugcccuucaccaucgauaaguga

SEQ ID NO: 143072 - RNA, 1350 nt, Artificial Sequence
  derived and/or modified sequence opt3 from neuraminidase__InfluenzaA__AEO89084
augaaccccaaucagaagaucauuaccauaggcagcaucugcauggugauugggaucgucucccugaugcuccaaauuggaaacaugaucucuauauggaucucauacaguauucagacagguaaucagcaccaggccgagccuacuagaaacgcuacguuccuuaccgaaaaugcaguugccagcgugacacuggcgggcaacuccucuuuguguccaguaagggggugggcugugcauucgaaagacaauucaauccggauuggaagcaagggcgaugucuuugugauccgcgagccguucauaaguugcucccacuuagaaugucgaaccuuuuuccugacucaaggugcccuacucaacgacaaacauucuaaugggacaguuaaggaucguagcccccacagaacccugauguccugcccugugggagaggcaccaucacccuauaacaguagguuugaaagcgucgccuggucugcuuccgcaugucaugacggcacuucauggcuuacaauuggcaucagcgggccugauaauggagccguggcuguacugaaauacaacgguauuaucaccgacacgaucaagaguuggcggaauaacauuuugcgcacucaggagucugagugcgccuguguuaauggcuccugcuucaccgugaugacagaugggccaagcgacggacaggcgucguauaagauauuuaaaauggaaaagggcaaagucgugaagucuguggagcucaucgcacccaacuaccacuaugaagaguguuccugcuacccugaugccggugagauuacuugugucugcagagacaacuggcacgggucaaauaggccauggguuaguuucaaccagaaucuggaauaucaaaucggauacauaugcagcggcguguuuggcgauaacccgcggcccaaugacgggaccggauccugugguccuguaucuccaaacggcgcuuacgggauuaaaggauucagcuuuaaguauggcaaugguguguggaucgggcgcacaaagucaaccaacagucgauccggcuucgagaugaucugggaucccaauggauggacggaaacugacagcaacuuuucugucaaacaggacauuguggccaucacagauuggucaggcuacagugggagcuucguucagcauccugagcugaccggacucgacugcauuagaccauguuucuggguggaauuaauaaggggucggcccaaggaguccacuaucuggacaucuggcucgagcauuuccuuuugcggggucaauucagauaccgugaguuggucuuggccggacggagcagagcugccuuucacgaucgauaaauga

SEQ ID NO: 143073 - RNA, 1350 nt, Artificial Sequence
  derived and/or modified sequence opt3 from neuraminidase__InfluenzaA__AEO89093
augaaccccaaucagaagaucauuaccauaggcagcaucugcauggugauugggaucgucucccugaugcuccaaauuggaaacaugaucucucuuuggguuucacacaguauacagacagguaaucagcaucagguggagccuaucagcaacacuaauuuccugguagaaaaagccguggcuuccgucacguuggcaggcaacucuucguuauguccaauuagagggugggccgugcacucaaaggacaauagcaucaggauuggaaguaaaggcgauguuuuugugauccgggagccguucauauccugcucucaucuggaaugucgcaccuuuuuccuaacacaaggugcgcuccugaacgacaagcacagcaaugggacugucaaagaucgaagcccccaucguacccuuaugucaugcccugugggagaggcuccaagucccuacaacagcagauuugaaucuguagccugguccgcaucagccugucacgacggcacaagcuggcugaccauuggcaucagugggccugauaauggagcuguugcaguguugaaguauaacgguaugauuacugacacaaucaagucuuggaggaauaacauccuccggacccaggaguccgagugcgccugugucaauggcagcugcuucacggugaugacugaugggccaucgaacggacaggcuucuuacaaaauuuuuaagauggaaaaaggccgcguggucaaguccguugagcuggacgcccccaacuaucacuacgaagaguguucaugcuauccugaugcgggugagauaaccugugugugcagagacaauuggcaugggaguaacaggccauggguauccuucaaucagaaccuggaauaccaaaucggauauauuugcuccggcguguuuggcgauaauccgcggcccaacgacgggacaggaucuugugguccugucagcucaaauggcgcauacggggugaaaggauucaguuuuaaguacggcaacgguguuuggaucgggcgcacuaaguccccaaauagccgaucuggcuucgagaugauaugggaucccaacggauggaccgaaacagacucaaguuuuagcgugaaacaggacauugucgccaucaccgauugguccggcuauucugggucguucgugcagcacccugagcucacgggauuagacugcaucagaccauguuucuggguagaacugauuaggggucggcccaaggagagcacuaucuggacauccggcucaaguauuucuuuuugcgggguuaauagcgauaccguguccuggucauggccggacggagcugagcuuccuuucacuauagauaaauga

SEQ ID NO: 143074 - RNA, 1350 nt, Artificial Sequence
  derived and/or modified sequence opt3 from neuraminidase__InfluenzaA__AEO89102
augaaccccaaucagaagaucauuaccauaggcagcaucugcauggugauugggaucgucucccugaugcuccaaauuggaaacaugaucucuauauggaucucacacaguauucagacagguaaucagaaccagguugagccuaucagcaauacuaacuuccuuacggaaaaagccguggcuuccguaauucuggcaggcaauucuucguuguguccaaucagagggugggccauacauucaaaggacaacagcauuaggaucggaaguaaaggcgauguguuugucauucgggagccguucaucuccugcucucacuuagaaugucgcaccuuuuuccugacacaaggugcgcuacucaaugacaagcauagcaacgggacugugaaagaucgaucaccccaccguacccugauguccugcccuguuggagaggcuccaagucccuacaauagcagauuugaaucuguggccugguccgcaucagccugucaugacggcacaagcuggcuuaccaucggcauuagugggccugauucuggagcugucgcagugcugaaguauaacgguauaaucacugacacaauuaaguccuggaggaauaacaucuugcggacccaggagagcgagugcgccuguguaaauggcucgugcuucacgguuaugacugaugggccaucuaacggacaggcuuccuacaaaauauuuaagauggaaaaaggcaaggugauuaaaucagucgagcucgacgcccccaacuaucacuacgaagaguguaguugcuauccugaugcgggugagaucaccugugugugccgcgacaauuggcacgggagcaacagaccauggguguccuucaaucagaaccuggaauaccaaaucggauauauuugcucuggcgucuuuggcgauaauccgaggcccaacgacgggacaggaagcugugguccuguuucacauaauggcgcauacggggugaagggauucaguuuuaaguacggcaacgguguauggaucgggcggacuaaauccccaaauagccgcucuggcuucgagaugauuugggaucccaacggauggucagaaaccgacaguagcuuuuccgugaagcaggacauagucgccaucacagauuggucuggcuauucggggagcuucgugcagcacccugagcugaccggacucgacugcauucgaccauguuucuggguugaauuaaucagagguaggcccaaagaguccacgguguggacuucaggcaguucuaucagcuuuugcggggucaauuccgauacagugucauggagcuggccggacggagcugagcugccuuucaccauugauaaguga

SEQ ID NO: 143075 - RNA, 1350 nt, Artificial Sequence
  derived and/or modified sequence opt3 from neuraminidase__InfluenzaA__AEO89111
augaaccccaaucagaagaucauuaccauaggcagcaucugcauggugauugggaucgucucccugaugcuccaaauuggaaacaucauaucuaucuggguuucacacaguauucagacagguaaucagcaucaggacgagccuaucagaaacgccaaugugcuuacugaaaacgcuguagcaagcgugacgcuggccggcaauuccucuuuguguccagucagggggugggcggugcacucgaaagauaacucaauucggaucggaagcaagggcgacguuuucgugauacgcgagccguuuauuaguugcucccauuuagaaugucgaaccuucuuucugacacaaggugcucuacucaaugauaaacacucuaacgggacugucaaggaccguagcccccauagaacccugauguccugcccugugggagaggccccaucacccuacaauaguagguucgaaagcguagcauggucugccuccgcuugucacgauggcacaucauggcuuaccaucggcauuagcgggccugacaacggagcaguugccgugcugaaauauaaugguaucaucacugauacaauuaagaguuggcggaacaauauauugcgcacccaggagucugagugcgcuugugucaacggcuccugcuuuacggugaugacugacgggccaagcaacggacaggccucguacaagaucuucaaaauggaaaagggcaaaguggucaagucuguugagcucaaugcgcccaacuaucacuacgaagaguguuccugcuauccugaugccggugagauuaccugugugugcagagacaauuggcaugggucaaacaggccauggguaaguuuuaaucagaaccuggaauaccaaaucggauauauaugcagcggcguguucggcgauaauccgcggcccaacgacgggacaggauccugugauccugucucuccaaauggugcauacggcauuaaaggguuuagcuucaaguacggaaacggcguguggaucggucgcacuaagucaaccaauagucgauccggguuugagaugaucugggaccccaacggcuggacagaaaccgacagcaauuucucuguuaaacaggauauuguggcuaucacggacuggucaggauauaguggcagcuuuguccagcacccugagcugacugggcucgauugcauuagaccauguuucuggguggaauuaauaaggggacggcccaaggaguccacaaucuggaccucugguucgagcauuuccuucugcggcguaaacucagacacuguuaguuggucuuggccggauggggccgagcugccuuuuacaaucgacaaauga

SEQ ID NO: 143076 - RNA, 1350 nt, Artificial Sequence
  derived and/or modified sequence opt3 from neuraminidase__InfluenzaA__AEO89120
augaaccccaaucagaagaucauuaccauaggcagcaucugcauggugauugggaucgucucccugaugcuccaaauuggaaacaugaucucuauauggguuucacacaguauccagacagguaaucagcaucaggccgagccuauuagaaacgcuagcuuccuuacugaaaaugcaguggccuccguaacgcuggcgggcaacucuucguuguguccagugagggggugggcuguccacucaaaagacaauagcauccggauuggaaguaagggcgauguguuuguuauccgcgagccguucauauccugcucucauuuagaaugucgaaccuuuuuccugacacaaggugcccuacucaacgacaaacacagcaaugggacugugaaggaucguucaccccauagaacccugauguccugcccugucggagaggcaccaagucccuacaacagcagguuugaaucuguggccugguccgcuucagcaugucacgacggcauuagcuggcuuacaaucggcauuagugggccugauaauggagccguagcuguucugaaauauaacgguaucaucaccgacacuauuaagucuuggcggaauaacauauugcgcacacaggaguccgagugcgccugugugaauggcagcugcuucaccgucaugacggaugggccaucgaacggacaggcgucuuacaagaucuuuaaaauggaaaagggcaaaguggugaaguccgucgagcucaacgcacccaauuaucacuacgaagaguguucaugcuauccugacgccggugagauuacuuguguuugcagagauaacuggcaugggaguaauaggccaugggugagcuucaaccagaaucuggaauaccaaaucggauauauaugcuccggcguauuuggcgacaacccgcggcccaaugaugggaccggaucuugugguccugugagcccaaacggcgcuuacgggauuaaaggauucucauuuaaguacggcaauggugucuggaucgggcgcacaaagaguacuaacucccgaagcggcuucgagaugaucugggaccccaauggaugggccgaaaccgauucuaacuuuucagugaaacaggacauuguugcaaucacagacuggaguggcuauagcggguccuucgugcagcacccugagcugaccggacucgauugcauuagaccauguuucugggucgaauuaauaaggggucggcccaaggagggcacgaucuggacuucugggucgagcauuuccuuuugcggaguaaauucagacacagugaguuggucuuggccggauggcgcugagcugccuuucaccaucgacaaauga

SEQ ID NO: 143077 - RNA, 1350 nt, Artificial Sequence
  derived and/or modified sequence opt3 from neuraminidase__InfluenzaA__AEO89129
augaaccccaaucagaagaucauuaccauaggcagcaucugcauggugauugggaucgucucccugaugcuccaaauuggaaacaucauaucuaucuggguuucacacaguacacagacugguaaucagcaucaggacgagccuauuagaaacgccaauuuccuuacggaaaacgcuguggcaagcguaacccuggccggcaauuccucuuuguguccagugagggggugggcgguccacucgaaagauaacucaauccgggugggaagcaagggcgacguuuuugugauucgcgagccguucaucaguugcucccauuuagaaugucgaacauuuuuccugacucaaggugcucuacucaaugauaaacacucuaacgggaccgucaaggaccguagcccccauagaacacugauguccugcccugugggagaggccccaucacccuacaauaguagguuugaaagcguagcauggucugccuccgcuugucacgauggcaccucauggcuuacuauaggcauuagcgggccugacaacggagcaguugccgugcugaaauauaaugguaucauuacagauaccaucaagaguuggcggaacaauaucuugcgcacgcaggagucugagugcgcuugugucaacggcuccugcuucacugugaugaccgacgggccaagcaacggacaggccucguacaagauuuuuaaaauggaaaagggcaaaguggucaagucuguugagcucaaugcgcccaacuaucacuacgaagaguguuccugcuauccugaugccggugagauaacaugugugugcagagacaauuggcaugggucaaacaggccauggguaaguuucaaucagaaccuggaauaccaaaucggauauauuugcagcggcguguuuggcgauaauccgcggcccaacgacgggacuggauccugugauccugucucuccaaauggugcauacggcaucaaaggguucagcuuuaaguacggaaacggcguguggauaggucgcaccaagucaacaaauagucgauccggguucgagaugauuugggaccccaacggcuggaccgaaacggacagcaauuuuucuguuaaacaggauaucguggcuaucacugacuggucaggauauaguggcagcuucguccagcacccugagcugacagggcucgauugcauuagaccauguuucuggguggaauuaaucaggggacggcccaaggaguccaccauuuggacuucugguucgagcauauccuuuugcggcguaaacucagacacaguuaguuggucuuggccggauggggccgagcugccuuucaccaucgacaaauga

SEQ ID NO: 143078 - RNA, 1350 nt, Artificial Sequence
  derived and/or modified sequence opt3 from neuraminidase__InfluenzaA__AEO89138
augaaccccaaucagaagaucauuaccauaggcagcaucugcauggugacagggauugucucccugaugcuccaaaucggaaacauuaucucuauguggguuucacacaguauacagacuagaaaucagcaucaggccgagccuaucaggaacacgaauuuccuuaccgaaaacgcuguggcaagcguaacacugacugguaauuccucuuuguguccaauucggggcugggccgugcacucgaaagacaacucaauccgcauugggagcaagggagaugucuuugugauccgagagccguucauaaguugcucccauuuagaaugucguaccuuuuuccugacacaaggcgcgcuacucaaugacaaacacucuaacgguaccguuaaggauagaagcccccauaggacucugauguccugcccugugggggaggcuccaucacccuacaauagucgguuugaaagcgucgccuggucugcauccgccugucacgacggaacaucauggcuuaccauuggcaucagcggcccugauaacggggcuguggcaguacugaaauauaauggaauuaucacggacacuaucaagaguuggcgcaacaauauuuugagaacccaggagucugagugcgccuguguuaacgguuccugcuucacagugaugacugauggcccaagcaacgggcaggcuucguacaagauauuuaaaauggaaaagggaaaagucgugaagucuguggagcucaaugcccccaacuaucacuacgaagaguguuccugcuauccugacgcgggcgagaucauuugugucugcagggauaauuggcaugguucaaaccggccauggguuaguuucaaucagaaccuggaauaccaaaucggguauauaugcagcggaguguuuggcgacaauccgcgccccaacgauggcaccggguccuguggaccuguaucuccaaauggugcauacggcauuaaaggguucagcuuuaaguacggaaacggcguguggaucggucgaacaaagucaaccaauaguagauccggguucgagaugaucugggaccccaacggcuggacgggaacugauaaugacuuuagcgucaaacaggacauuguggccaucacagauuggucuggcuauucagggaguuucguucagcacccugaacugaccggacucgacugcauuaggccauguuucuggguggaguuaauacggggucgucccaaggaaagcacugucuggacauccgggucuucgaucagcuuuugcggcgugaacuccgauaccguaucauggaguuggccggacggagcugagcugccuuucacgauugauaaauga

SEQ ID NO: 143079 - RNA, 1350 nt, Artificial Sequence
  derived and/or modified sequence opt3 from neuraminidase__InfluenzaA__AEO89156
augaaccccaaucagaagaucauuaccauaggcagcaucugcauggugacagggauugucucccugaugcuccaaaucggaaacauuacuucuauguggguuucacacaguauccagacgagaaaucagcaucaggccgagccuauaaggaacaccaauuuccuuacagaaaacgcuguggcaagcguaacucuggccgguaauuccucuuuguguccaauccggggcugggcggugcacucgaaagacaacucaauucgcaucgggagcaagggagaugucuuugugauucgagagccguucaucaguugcucccauuuagaaugucguaccuuuuuccugacacaaggcgcucuacucaaugacaaacacucuaacgguaccguuaaggauagaagcccccauaggacucugauguccugcccugugggggaggccccaucacccuacaauagucgguuugaaagcgucgcauggucugccuccgcuugucacgacggaacaucauggcuuaccauaggcauuagcggcccugauaacggggcaguggccguacugaaauauaauggaaucauuacggacacuaucaagaguuggcgcaacaauaucuugagaacccaggagucugagugcgcuuguguuaacgguuccugcuucacagugaugacugauggcccaagcaacgggcaggccucguacaagauuuuuaaaauggaaaagggaaaagucgugaagucuguggagcucaaugcgcccaacuaucacuacgaagaguguuccugcuauccugacgcaggcgagauaaucugugucugcagggauaauuggcaugguucaaaccggccauggguuaguuucaaucagaaccuggaauaccaaauuggguauaucugcagcggaguguuuggcgacaauccgcgccccaacgauggcaccggguccuguggaccuguaucuccaaauggugccuacggcauaaaaggguucagcuuuaaguacggaaacggcguguggauuggucgaacaaagucaaccaauaguagauccggguucgagaugaucugggaccccaacggcuggacgggaacugauagcgacuuuucugucaaacaggacaucguggcuauuacagauuggucaggcuauagugggagcuucguucagcacccugaacugaccggacucgacugcaucaggccauguuucuggguggaguuaauucggggucgucccaaggaauccacuauauggacaucuggcucgagcaucuccuuuugcggggucaauucagauaccgugaguuggucuuggccggacggagccgagcugccuuucacgauugauaaauga

SEQ ID NO: 143080 - RNA, 1350 nt, Artificial Sequence
  derived and/or modified sequence opt3 from neuraminidase__InfluenzaA__AEO89174
augaaccccaaucagaagaucauuaccauaggcagcaucugcauggugacagggauugucucccugaugcuccaaaucggaaacauuaucucuauguggguuucacacaguauacagacuagaaaucagcaucaggccgagccuaucaggaacacgaauuuccuuaccgaaaacgcuguggcaagcguaacacuggccgguaauuccucuuuguguccaauucggggcugggcggugcacucgaaagacaacucaauccgcauugggagcaagggagaugucuuugugauccgagagccguucauaaguugcucccauuuagaaugucguaccuuuuuccugacucaaggcgcucuacucaaugacaaacacucuaacgguacaguuaaggauagaagcccccauaggacccugauguccugcccugugggggaggccccaucacccuacaauagucgguuugaaagcgucgcauggucugccuccgcuugucacgacggaacuucauggcuuacaauuggcaucagcggcccugauaacggggcaguggccguacugaaauauaauggaauuaucaccgacacgaucaagaguuggcgcaacaauauuuugagaacucaggagucugagugcgcuuguguuaacgguuccugcuucaccgugaugacagauggcccaagcaacgggcaggccucguacaagauauuuaaaauggaaaagggaaaagucgugaagucuguggagcucaaugcgcccaacuaucacuacgaagaguguuccugcuauccugacgcaggcgagaucauuugugucugcagggauaauuggcaugguucaaaccggccauggguuaguuucaaucagaaccuggaauaccaaaucggguauauaugcagcggaguguuuggcgacaauccgcgccccaacgauggcacuggguccuguggaccuguaucuccaaauggugccuacggcauuaaaggguucagcuuuaaguacggaaacggcguguggaucggucgaaccaagucaacaaauaguagauccggguucgagaugaucugggaccccaacggcuggaccggaacggauagcgacuuuucugucaaacaggacauuguggcuaucacugauuggucaggcuauagugggagcuucguucagcacccugaacugacaggacucgacugcauuaggccauguuucuggguggaguuaauacggggucgucccaaggaauccaccaucuggacuucuggcucgagcauuuccuuuugcggggucaauucagauacagugaguuggucuuggccggacggagccgagcugccuuucaccaucgauaaauga

SEQ ID NO: 143081 - RNA, 1350 nt, Artificial Sequence
  derived and/or modified sequence opt3 from neuraminidase__InfluenzaA__AEO89183
augaaccccaaucagaagaucgugaccauuggcagcauaugcauggucaucgggauuguuucccugaugcuccaaaucggaaacaugauuucuaucugggugucacacaguauacagacagguaaucagcaucagacugagccuaucagaaacacgaauuuccuuaccgaaaacacaguagccagcgugacucuggcuggcaauuccucuuuguguccaauuagggggugggcaguccacucgaaagacaacucaauccggauuggaagcaagggcgauguguuuguuauccgcgagccguucauaaguugcucccauuuagaaugucgaaccuuuuuccugacacaaggugcccuacucaaugacaaacacucuaacgggaccgugaaggaucguagcccccauagaacucugauguccugcccuauuggagaggcgccaucacccuacaauaguagguuugaaagcgucgcuuggucugccuccgcaugucacgacggcacaucauggcuuaccaucggcauuagcgggccugauaacggagccguggcuguacugaaauauaaugguaucaucacggacacuauuaagaguuggcggaacaauauauugcgcacccaggagucugagugcgcauguguuaacggcuccugcuucacagugaugacugaugggccaagcaacggacaggccucguacaagaucuuuaaaauggaaaagggcaaagucgugaagucuguggagcucaaugcucccaacuaucacuacgaagaguguuccugcuauccugacgccggugagauuaucugugucugcagagauaauuggcaugggucaaacaggccauggguuaguuucaaucagaaccuggaauaccaaauaggauauauuugcagcggcguguuuggcgacaauccgcggcccaacgaugggaaaggauccugugguccuguaucuccaaauggcgcguacggggugaagggauucagcuuuaaguacggcaacggugucuggaucgggcgcaccaaaucaacacacagucgauccggcuucgagaugaucugggaccccaauggauggaccggcacggauagcgaauuuucuaugaagcaggacauuguggcaaucacugacuggucaggguauagugguagcuucguucagcauccugagcugacaggacucgauugcauuagaccauguuucuggguggaauuaauaaggggccggcccaaagaguccaccaucuggacuucugggucgagcauuuccuuuugcggagucaacucagacacagugaguuggucuuggccggauggcgccgagcugccuuucaccaucgacaaguga

SEQ ID NO: 143082 - RNA, 1350 nt, Artificial Sequence
  derived and/or modified sequence opt3 from neuraminidase__InfluenzaA__AEO89205
augaaccccacccagaagaucauuacaauaggcagcaucugcauggugauugggaucgucucccugaugcuccaaauuggaaauaugaucucuauauggguuucacacaguauccagacugguaaccagcaucaggccgagccuauuagaaaugcuagcuuccuuacggaaaacgcaguggccuccguaacccuggcgggcaauucuucguuguguccagugagggggugggcuguccacucaaaagacaacagcauccggauuggaaguaagggcgauguguuuguuauccgcgagccguucauauccugcucucauuuagaaugucgaacauuuuuccugacucaaggugcccuacucaaugacaaacacagcaacgggaccgugaaggaucguucaccccauagaacacugauguccugcccugucggagaggcaccaagucccuacaauagcagguuugaaucuguggccugguccgcuucagcaugucacgacggcauuagcuggcuuaccaucggcauuagugggccugauaacggagccguagcuguucugaaauauaaugguaucaucacugacacaauuaagucuuggcggaacaauauauugcgcacccaggaguccgagugcgccugugugaacggcagcugcuucacggucaugacugaugggccaucgaauggacaggcgucuuacaagaucuuuaaaauggaaaagggcaaaguggugaaguccgucgagcucaacgcacccaacuaucacuacgaagaguguucaugcuauccugacgccggugagauuaccuguguuugcagagauaauuggcaugggaguaacaggccaugggugagcuucaaucagaaccuggaauaccaaaucggauauauaugcuccggcguauuuggcgacaauccgcggcccaacgaugggacaggaucuugugguccugugagcccaaauggcgcuuacgggauuaaaggauucucauuuaaguacggcaacggugucuggaucgggcgcacuaagaguaccaauucccgaagcggcuucgagaugaucugggaccccaacggaugggccgaaacagauucuaauuuuucagugaaacaggacauuguugcaaucaccgacuggaguggcuauagcggguccuucgugcagcacccugagcugacgggacucgauugcauuagaccauguuucugggucgaauuaauaaggggucggcccaaggagggcacuaucuggacaucugggucgagcauuuccuuuugcggagugaacucagacaccguaaguuggucuuggccggauggcgcugagcugccuuucacuaucgacaaauga

SEQ ID NO: 143083 - RNA, 1350 nt, Artificial Sequence
  derived and/or modified sequence opt3 from neuraminidase__InfluenzaA__AEO89215
augaaccccaaucagaagaucauuaccauaggcagcaucugcauggccauugggaucgugucccugaugcuccaaauuggaaacaugaucucuauaugggucucacacaguauccagacagguaaucagcaucaggcugagccuauuagaaacgcauccuuccuuacugaaaaugccguugcguccgugacgcuggcuggcaacucuucguuguguccaguaagggggugggccgugcacucaaaagacaauagcauccggauuggaaguaagggcgaugucuuugugauccgcgagccguucauauccugcucucauuuagaaugucgaaccuuuuuccugacacaaggugcacuacucaacgacaaacacagcaaugggacuguuaaggaucguagcccccauagaacccugaugucaugcccugugggagaggccccaagucccuacaacagcagguuugaaucugucgcuugguccgcaucagccugucacgacggcauuagcuggcuuacaaucggcauuagugggccugauaauggagcuguggccguacugaaauauaacgguaucaucaccgacacuauuaagucuuggcggaauaacauauugcgcacacaggaguccgagugcgcguguguuaauggcagcugcuucaccgugaugacggaugggccaucgaacggacaggcaucuuacaagaucuuuaaaauggaaaagggcaaagucgugaaguccguggagcucaacgcccccaauuaucacuacgaagaguguucaugcuauccugacgcuggugagauuacuugugucugcagagauaacuggcaugggaguaauaggccauggguuagcuucaaccagaaucuggaauaccaaaucggauauauaugcuccggcguguuuggcgacaacccgcggcccaaugaugggaccggaucuugugguccuguaagcccaaacggcgccuacgggauuaaaggauucucauuuaaguacggcaaugguguguggaucgggcgcacaaagaguacuaacucccgaagcggcuucgagaugaucugggaccccaauggaugggcagaaaccgauucuaacuuuucagucaaacaggacauuguggcuaucacagacuggaguggcuauagcggguccuucguucagcacccugagcugaccggacucgauugcauuagaccauguuucuggguggaauuaauaaggggucggcccaaggagggcacgaucuggacuucugggucgagcauuuccuuuugcggagucaauucagacacagugaguuggucuuggccggauggcgccgagcugccuuucaccaucgacaaauga

SEQ ID NO: 143084 - RNA, 1350 nt, Artificial Sequence
  derived and/or modified sequence opt3 from neuraminidase__InfluenzaA__AEO89226
augaaccccacccagaagaucauuacaauaggcagcaucugcauggccauugggaucgugucccugaugcuccaaauuggaaauaugaucucuauaugggucucacacaguauccagacugguaaccagcaucaggcugagccuauuagaaaugcauccuuccuuacggaaaacgccguugcguccgugacccuggcuggcaauucuucguuguguccaguaagggggugggccgugcacucaaaagacaacagcauccggauuggaaguaagggcgaugucuuugugauccgcgagccguucauauccugcucucauuuagaaugucgaacauuuuuccugacucaaggugcacuacucaaugacaaacacagcaacgggaccguuaaggaucguagcccccauagaacacugaugucaugcccugugggagaggccccaagucccuacaauagcagguuugaaucugucgcuugguccgcaucagccugucacgacggcauuagcuggcuuaccaucggcauuagugggccugauaacggagcuguggccguacugaaauauaaugguaucaucacugacacaauuaagucuuggcggaacaauauauugcgcacccaggaguccgagugcgcguguguuaacggcagcugcuucacggugaugacugaugggccaucgaauggacaggcaucuuacaagaucuuuaaaauggaaaagggcaaagucgugaaguccguggagcucaacgcccccaacuaucacuacgaagaguguucaugcuauccugacgcuggugagauuaccugugucugcagagauaauuggcaugggaguaacaggccauggguuagcuucaaucagaaccuggaauaccaaaucggauauauaugcuccggcguguuuggcgacaauccgcggcccaacgaugggacaggaucuugugguccuguaagcccaaauggcgccuacgggauuaaaggauucucauuuaaguacggcaacgguguguggaucgggcgcacuaagaguaccaauucccgaagcggcuucgagaugaucugggaccccaacggaugggcagaaacagauucuaauuuuucagucaaacaggacauuguggcuaucaccgacuggaguggcuauagcggguccuucguucagcacccugagcugacgggacucgauugcauuagaccauguuucuggguggaauuaauaaggggucggcccaaggagggcacuaucuggacaucugggucgagcauuuccuuuugcggagucaacucagacaccgugaguuggucuuggccggauggcgccgagcugccuuucacuaucgacaaauga

SEQ ID NO: 143085 - RNA, 1350 nt, Artificial Sequence
  derived and/or modified sequence opt3 from neuraminidase__InfluenzaA__AEO89237
augaaccccaaucagaagaucauuaccauaggcagcaucugcauggugauugggaucgucucccugaugcuccaaauuggaaacaucauaucuauguggguuucacacaguauccagacaagaaaucagcaucaggccgagccuauuaggaacacuaauuuccuuacggaaaacgcuguggcaagcguaacccuggccgguaauuccucuuuguguccaauccggggcugggcggugcacucgaaagacaacucaauucgcaucgggagcaagggagaugucuuugugauacgagagccguucauuaguugcucccauuuagaaugucguacauuuuuccugacucaaggcgcucuacucaaugacaaacacucuaacgguaccguuaaggauagaagcccccauaggacacugauguccugcccugugggggaggccccaucacccuacaauagucgguuugaaagcgucgcauggucugccuccgcuugucacgacggaaccucauggcuuacuaucggcauuagcggcccugauaacggggcaguggccguacugaaauauaauggaaucaucacagacaccauuaagaguuggcgcaacaauauauugagaacgcaggagucugagugcgcuuguguuaacgguuccugcuucacugugaugaccgauggcccaagcaacgggcaggccucguacaagaucuuuaaaauggaaaagggaaaagucgugaagucuguggagcucaaugcgcccaacuaucacuacgaagaguguuccugcuauccugacgcaggcgagauuaucugugucugcagggauaauuggcaugguucaaaccggccauggguuaguuucaaucagaaccuggaauaccaaauaggguauauuugcagcggaguguuuggcgacaauccgcgccccaacgauggcacaggguccuguggaccuguaucuccaaauggugccuacggcaucaaaggguucagcuuuaaguacggaaacggcguguggaucggucgaacuaagucaaccaauaguagauccggguucgagaugauuugggaccccaacggcuggacaggaaccgauagcgacuuuucugucaaacaggacaucguggcuauuacggauuggucaggcuauagugggagcuucguucagcacccugaacugacuggacucgacugcauaaggccauguuucuggguggaguuaauccggggucgucccaaggaauccacaauuuggaccucuggcucgagcaucuccuuuugcggggucaauucagauacugugaguuggucuuggccggacggagccgagcugccuuucacaaucgauaaauga

SEQ ID NO: 143086 - RNA, 1350 nt, Artificial Sequence
  derived and/or modified sequence opt3 from neuraminidase__InfluenzaA__AEO89248
augaaccccaaucagaagaucauuaccauaggcagcaucugcauggugauugggaucgucucccugaugcuccaaauuggaaacaucauaucuaucuggguuucacacaguuuccagacaagagugcagcaucaggccgagccuauuaggaauacuaacuuucuuacggaaaaugcuguagcaagcgugacccuggccgguaacuccucuuuguguccaauccggggcugggcgguccacucgaaagacaauucaauucgcaucgggagcaagggagauguguucguuauacgagagccguuuauuaguugcucccauuuagaaugucguacauucuuucugacucaaggcgcucuacucaacgacaaacacucuaaugguaccgugaaggauagaagcccccauaggacacugauguccugcccugucggggaggccccaucacccuacaacagucgguucgaaagcguggcauggucugccuccgcuugucacgacggaaccucauggcuuacuaucggcauuagcggcccugauaauggggcaguagccguucugaaauauaacggaaucaucacagacaccauuaagaguuggcgcaauaacauauugagaacgcaggagucugagugcgcuugugugaaugguuccugcuuuacugucaugaccgauggcccaagcaacgggcaggccucguacaagaucuucaaaaugaagaaaggaaagguggugaaaucugucgaacucaacgcgcccaauuaucacuacgaggaauguuccugcuauccugacgcaggcgagauuaucuguguuugcagggauaacuggcaugguucaaaucggccaugggugaguuuuaaccagaaucuggaguaccaaauaggguauauuugcagcggaguauucggcgacaacccgcgccccaaugauggcacaggguccuguggaccugugucuccaaacggugccuacggcaucaagggguuuagcuucaaguacggaaauggcgucuggaucggucgaacuaaaucaaccaacaguagauccggguuugaaaugauuugggaccccaauggcuggacaggaaccgauagcgacuucucuaugaagcaggacaucguggcuauuacggauuggucaggcuauagugggagcuucguucagcacccugagcugacuggacucgacugcauaaggccauguuuuuggguggaauuaauccggggucgucccaaagaguccacaauuuggaccucuggcucgagcaucuccuucugcggggucaacucagauacugugaguuggucuuggccggacggagccgaacugccuuuuacaaucgauaaguga

SEQ ID NO: 143087 - RNA, 1350 nt, Artificial Sequence
  derived and/or modified sequence opt3 from neuraminidase__InfluenzaA__AEO89270
augaaccccaaucagaagaucauuaccauaggcagcaucugcauggugacagggauugucucccugaugcuccaaaucggaaacauuacuucuauguggguuucacacaguauccagacgagaaaucagcaucaggccgagccuauaaggaacaccaauuuccuuacagaaaacgcuguggcaagcguaacucuggccgguaauuccucuuuguguccaauccggggcugggcggugcacucgaaagacaacucaauucgcaucgggagcaagggagaugucuuugugauucgagagccguucaucaguugcucccauuuagaaugucguaccuuuuuccugacacaaggcgcucuacucaaugacaaacacucuaacgguaccguuaaggauagaagcccccauaggacucugauguccugcccugugggggaggccccaucacccuacaauagucgguuugaaagcgucgcauggucugccuccgcuugucacgacggaacaucauggcuuaccauaggcauuagcggcccugauaacggggcaguggccguacugaaauauaauggaaucauuacggacacuaucaagaguuggcgcaacaauaucuugagaacccaggagucugagugcgcuuguguuaacgguuccugcuucacagugaugacugauggcccaagcaacgggcaggccucguacaagauuuuuaaaauggaaaagggaaaagucgugaagucuguggagcucaaugcgcccaacuaucacuacgaagaguguuccugcuauccugacgcaggcgagauaaucugugucugcagggauaauuggcaugguucaaaccggccauggguuaguuucaaucagaaccuggaauaccaaauuggguauaucugcagcggaguguuuggcgacaauccgcgccccaacgauggcaccggguccuguggaccuguaucuccaaauggugccuacggcauaaaaggguucagcuuuaaguacggaaacggcguguggauuggucgaacaaagucaaccaauaguagauccggguucgagaugaucugggaccccaacggcuggacgggaacugauagcgacuuuucugucaaacaggacaucguggcuauuacagauuggucaggcuauagugggagcuucguucagcacccugaacugaccggacucgacugcaucaggccauguuucuggguggaguuaauucggggucgucccaaggaauccacuauauggacaucuggcucgagcaucuccuuuugcggggucaauucagauaccgugggauggaguuggccggacggcgccgagcugccuuucacgauugauaaauga

SEQ ID NO: 143088 - RNA, 1350 nt, Artificial Sequence
  derived and/or modified sequence opt3 from neuraminidase__InfluenzaA__AEO89281
augaaccccaaucagaagaucauuaccauaggcagcaucugcaugguggucgggauuguuucccugaugcuccaaaucggaaacauugugucuaucuggguaucacacaguauacagacaggucaucagcagcaagccgagccuaucaaaaauacuaacuuccuuacgaagaaugcuguggcaagcgucacccuggccggcaacuccucuuuguguccaauuagagggugggcggugcacucgaaagacaauucaaucaggauuggaagcaagggcgauguuuuugugauccgggaaccguucauaaguugcucccauuuagagugucgcacauuuuuccugacucagggugcucuacucaacgacaaacacucuaaugggaccgucaaggaucgaagcccccaucguacacugauguccugcccugugggagaagccccaucacccuacaacaguagauuugagagcguagcauggucugccuccgcuugucacgacggcaccucauggcuuacuauuggcaucagcgggccugauaauggagcaguugccgugcugaaguauaacgguauuaucacagacaccaucaaaaguuggaggaauaacacguugcggacucaggaaucugagugcgcuugugucaauggcuccugcuucaccgugaugacagaugggccaagcaacggacaggccucguacaagauuuuuaaaauggagaagggcaaaguggucaagucugcggaacucaacgcacccaauuaucacuacgaggaauguuccugcuauccugacgccggugagauaaucuguguuugccgcgauaacuggcaugggucaaauagaccaugggugaguuucaaccaaaaucuggaguaccagauuggauauaucugcagcggcguauuuggcgacaacccgaggcccaaugaugggacuggauccugugguccugugucuccaaacggcgcuuacgggauaaagggauucagcuuuaaauacggcaauggugucuggauugggcggaccaagucaacaaacagucgcuccggcuucgaaaugaucugggaccccaauggauggaccggcacggauagcaacuuuucuaugaaacaggacaucguggccauuacugaguggucaggguauagugguagcuucguucagcacccugaacugacaggacucgacugcauccgaccauguuucuggguggaguuaauuagaggcaggcccaaggaauccaccauauggacuucugggucgagcaucuccuuuugcggagucaauucagauacagugaguuggucuuggccggacggcgcagagcugccuuucaccauugauaaauga

SEQ ID NO: 143089 - RNA, 1350 nt, Artificial Sequence
  derived and/or modified sequence opt3 from neuraminidase__InfluenzaA__AEO89291
augaaccccaaucagaagaucauuaccauaggcagcaucugcaugguggucgggauuguuucccugaugcuccaaaucggaaacauugugucuaucuggguaucacacaguauacagacaggucaucagcagcaagccgagccuaucaaaaauacuaacuuccuuacggaaaaugcuguggcaagcgucacccuggccggcaacuccucuuuguguccaauuagagggugggcggugcacucgaaggacaauucaaucaggauuggaagcaaaggcgauguuuuugugauccgggagccguucauaaguugcucccauuuagaaugucgcacauuuuuccugacucagggugcucuacucaacgacaagcacucuaaugggaccgucaaagaucgaagcccccaucguacacugauguccugcccugugggagaggccccaucacccuacaacaguagauuugaaagcguagcauggucugccuccgcuugucacgacggcaccucauggcuuacuauuggcaucagcgggccugauaauggagcaguugccgugcugaaguauaacgguauuaucacagacaccaucaagaguuggaggaauaacauuuugcggacgcaggagucugagugcgcuugugucaauggcuccugcuucacugugaugaccgaugggccaagcaacggacaggccucguacaaaauauuuaagauggaaaaaggcaagguggucaaaucugcggagcucaacgcacccaauuaucacuacgaagaguguuccugcuauccugacgccggugagaucauuuguguuugccgcgauaacuggcaugggucaaauagaccaugggugaguuucaaccaaaaucuggaauaccagaucggauauauaugcagcggcguauuuggcgacaacccgaggcccaaugaugggacaggauccugugguccugugucuccaaacggcgcuuacgggauuaagggauucagcuuuaaguacggcaauggugucuggaucgggcggacuaaaucaaccaacagucgcuccggcuucgagaugaucugggaccccaauggauggacaggcaccgauagcaacuuuucuaugaagcaggacauuguggccaucacggaauggucaggguauagugguagcuucguucagcacccugagcugacuggacucgacugcauucgaccauguuucuggguggaauuaauaagaggcaggcccaaagaguccacaaucuggaccucugggucgagcauuuccuuuugcggagucaauucagauacugugaguuggucuuggccggacggcgcagagcugccuuucacaaucgauaaguga

SEQ ID NO: 143090 - RNA, 1350 nt, Artificial Sequence
  derived and/or modified sequence opt3 from neuraminidase__InfluenzaA__AEO89302
augaaccccaaucagaagaucauuaccauaggcagcaucugcauggugauugggaucgucucccugaugcuccaaauuggaaacaucauaucuaucuggguuucacacaguauucagacagguaaucagcaucaggacgagccuaucagaaacgccaauuuccuuacugaaaacgcuguggcaagcguaacgcuggccggcaauuccucuuuguguccagugagggggugggcgguccacucgaaagauaacucaauucggaucggaagcaagggcgacguguuuguuauacgcgagccguucauuaguugcucccauuuagaaugucgaaccuuuuuccugacacaaggugcucuacucaaugauaaacacucuaacgggacugugaaggaccguagcccccauagaacccugauguccugcccugucggagaggccccaucacccuacaauaguagguuugaaagcguggcauggucugccuccgcuugucacgauggcacaucauggcuuaccaucggcauuagcgggccugacaacggagcaguagccguucugaaauauaaugguaucaucacugauacaauuaagaguuggcggaacaauauauugcgcacccaggagucugagugcgcuugugugaacggcuccugcuucacggucaugacugacgggccaagcaacggacaggccucguacaagaucuuuaaaauggaaaagggcaaaguggugagaucugucgagcucaaugcgcccaacuaucacuacgaagaguguuccugcuauccugaugccggugagauuaccuguguuugcagggacaauuggcaugggucaaaccggccaugggugaguuucaaucagaaccuggaauaccaaaucggauauauaugcagcggcguauuuggcgauaauccgcgccccaacgacgggacaggauccugugauccugugucuccaaauggugcauacggcauuaagggguucagcuuuaaauacggaaacggcgucuggaucggucgaacuaagucaaccaauaguagauccggguucgagaugaucugggaccccaacggcuggacagaaaccgacagcgauuuuucugugaagcaggacauuguugcuaucacggauuggucaggauauaguggcagcuucgugcagcacccugagcugacugggcucgacugcauuaggccauguuucugggucgaauuaauacggggacgucccaaagaguccacaaucuggaccucugguucgagcauuuccuuuugcggcgugucaagugauacuguaucuuggagcuggccggacggggccgagcugccuuucacaaucgauaaguga

SEQ ID NO: 143091 - RNA, 1410 nt, Artificial Sequence; identical to SEQ ID NO: 138073
  derived and/or modified sequence opt3 from neuraminidase__InfluenzaA__AEO99218

SEQ ID NO: 143092 - RNA, 1410 nt, Artificial Sequence
  derived and/or modified sequence opt3 from neuraminidase__InfluenzaA__AEQ49739
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugaggugacuugcgucugccgcgacaacuggcacgggagcaauagaccauggguuucauucaaccagaaucucgaauaucagauaggauacaucuguaguggcauuuuuggcgauaacccgaggcccaaugacaaaaccggguccugcggaccugugagcucuaacggugcgaauggcguaaagggguucucauuuaaguauggaaacggcguguggaucggucggacaaaaaguaucagcucccgcaagggguucgagaugauuugggauccaaacggcuggaccggaacggacaauaacuuuucuauaaaacaagacaucgucggcauuaaugaauggucgggguacagcggauccuucgugcagcaucccgagcugacugguauggauuguauccgaccuugcuucuggguugaacugauuagaggcaggccaaaggagaacacaaucuggaccucagggaguucuauaucauuuuguggagucaauuccgacacugugggcuggucauggcccgauggugcagagcucccguucacaaucgacaaauga

SEQ ID NO: 143093 - RNA, 1410 nt, Artificial Sequence; identical to SEQ ID NO: 142273
  derived and/or modified sequence opt3 from neuraminidase__InfluenzaA__AEQ49740

SEQ ID NO: 143094 - RNA, 1410 nt, Artificial Sequence
  derived and/or modified sequence opt3 from neuraminidase__InfluenzaA__AEQ49741
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucggucggacaaaaaguauuagcucccgcaagggguucgagaugauaugggauccaaacggcuggaccggaacggacaauaacuuuucuaucaaacaagacauugugggcaucaaugaauggucgggguacagcggauccuucguccagcaucccgagcugacugguauggauuguauucgaccuugcuucuggguggaacugaucagaggcaggccaaaggagaacacaauauggaccucagggaguucuaucagcuuuuguggaguuaauuccgacacugugggcuggucauggcccgauggugcagagcucccguucacaauugacaaauga

SEQ ID NO: 143095 - RNA, 1410 nt, Artificial Sequence
  derived and/or modified sequence opt3 from neuraminidase__InfluenzaA__AEQ49742
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauacauuccaaggacaauucuauuagaaucggcagcaaaggugauguuuuugugauuagggagccauucaucuccuguucaccguuagaaugccggaccuuuuuccugacacagggggcucuacucaacgacaagcacaguaauggaaccaucaaagaucgcagccccuaccgaacucugaugucuuguccuauuggcgaggucccaucccccuauaacucacguuuugaaagcguggccuggagugcaucugccugccaugacggcauaaacuggcuuacaaucgggauuuccggaccugauaauggugcuguagcaguucugaaguacaacggcaucauaaccgacacgauuaagagcuggagaaauaacaucuugaggacucaagagucggagugugccugcgugaaugggucuuguuucaccaucaugacagauggaccauccgacggccaggcuucauauaaaauuuuucggaucgaaaaggguaaaauugucaagaguguggagaugaacgcccccaauuaccacuaugaagagugcagcuguuacccugauuccucugagauaacuugcgugugccgcgacaacuggcaugggagcaauagaccaugggucucauucaaccagaaucucgaauaccagaucggauauauuuguaguggcaucuuuggcgauaacccgaggcccaaugacaaaaccggguccugcggaccuguuagcucuaacggugcgaauggcgugaagggguucucauuuaaguacggaaacggcguauggaucggucggacaaaaaguauuagcucccgcaagggguucgagaugauaugggauccaaacggcuggaccggaacggacaauaacuuuucuaucaaacaagacauugugggcaucaaugaauggucgggguauagcggauccuucguccagcaccccgagcugacugguauggauuguauucgaccuugcuucuggguggaacugaucagaggcaggccaaaggagaacacaauauggaccucagggaguucuaucagcuuuuguggaguuaauuccgacacugugggcuggucauggcccgauggugcagagcucccguucacaauugacaaauga

SEQ ID NO: 143096 - RNA, 1410 nt, Artificial Sequence
  derived and/or modified sequence opt3 from neuraminidase__InfluenzaA__AEQ49743
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucggucggacaaaaaguauuagcucccgcaagggguucgagaugauaugggauccaaacggcuggaccggaacggacaauaacuuuucuaucaaacaagacauugugggcacuaaugaauggucgggguacagcggauccuucguccagcaucccgagcugacaggucuggauuguauccgaccuugcuucuggguggaacucauuagaggcaggccaaaggagaacaccaucuggacuucagggaguucuauaucauuuuguggaguuaauuccgacacagugggcuggucauggcccgauggugcagaguuaccguucaccaucgacaacuga

SEQ ID NO: 143097 - RNA, 1410 nt, Artificial Sequence
  derived and/or modified sequence opt3 from neuraminidase__InfluenzaA__AEQ49744
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacucauccuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuagucaacgacaagcauaguaauggaaccaucaaagaucgcagccccuaucgaacucucaugucuuguccuauuggcgaggugccaucccccuacaacucacguuuugaaagcguagccuggagugcaucugccugccacgacggcauaaacuggcugacaaucgggauuuccggaccugauaauggugcuguugcagugcuuaaguauaacggcaucauaaccgacacgauuaagagcuggagaaauaacaucuucaggacucaagagucggagugugccugcgucaaugggucuuguuuuaccaucaugacagauggaccauccgacggccaggcuucauacaaaauuuuccggaucgaaaaggguaaaauugugaagaguguggagaugaacgcccccaauuaucauuacgaagagugcagcuguuacccugauuccucugagauaacuugcgucugccgcgacaacuggcacgggagcaauagaccauggguuucauuuaaccaggaucuggaauaucagaucggauacauuuguaguggcaucuucggcgacaauccgaggcccaacgauaaaaccggguccugcggaccugugagcucuaauggugcgaacggcguaaagggguuuucauucaaguauggaaauggcguguggaucggucggacaaaaaguauuagcucccgcaagggguuugagaugauaugggacccaaacggcuggaccggaacggacaacaauuucucuaucaaacaaaacauugucggcaucaaugaauggucgggguacagcggauccuucgugcagcaucccgaguugacuggucucgauuguauucgaccuugcuuuuggguugaacugaucagaggcaggccaaaggagaacacaauauggaccucagggaguucuaucagcuucuguggagugaauagcgacacugucggcuggucauggcccgauggugcagagcugccguuuacaauugacaaauga

SEQ ID NO: 143098 - RNA, 1410 nt, Artificial Sequence; identical to SEQ ID NO: 143094
  derived and/or modified sequence opt3 from neuraminidase__InfluenzaA__AEQ49745

SEQ ID NO: 143099 - RNA, 1410 nt, Artificial Sequence; identical to SEQ ID NO: 143094
  derived and/or modified sequence opt3 from neuraminidase__InfluenzaA__AEQ49746

SEQ ID NO: 143100 - RNA, 1410 nt, Artificial Sequence; identical to SEQ ID NO: 143094
  derived and/or modified sequence opt3 from neuraminidase__InfluenzaA__AEQ49747

SEQ ID NO: 143101 - RNA, 1410 nt, Artificial Sequence; identical to SEQ ID NO: 142273
  derived and/or modified sequence opt3 from neuraminidase__InfluenzaA__AEQ49748

SEQ ID NO: 143102 - RNA, 1410 nt, Artificial Sequence; identical to SEQ ID NO: 143094
  derived and/or modified sequence opt3 from neuraminidase__InfluenzaA__AEQ49749

SEQ ID NO: 143103 - RNA, 1410 nt, Artificial Sequence
  derived and/or modified sequence opt3 from neuraminidase__InfluenzaA__AEQ49750
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaaucauaguaacggaaccaucaaggaucgcagccccuaucgaacucugaugucuuguccuauuggcgaggucccaucccccuacaacucacguuuugaaagcguggccuggagugcaucugccugccacgacggcauaaauuggcuuacaaucgggauuuccggaccugauaacggugcuguagcaguucugaaauauaauggcaucauaaccgacacgauuaagagcuggagaaacaauaucuugaggacucaagagucggagugugccugcgugaacgggucuuguuucaccaucaugacagauggaccauccgacggccaggcuucauacaagauuuuucggaucgaaaaagguaagauugucaaaaguguggagaugaaugcccccaacuaucauuacgaagagugcagcuguuacccugauuccucugagauaacuugcgugugccgcgacaauuggcacgggagcaacagaccaugggucucauucaaucagaaccucgaauaucagaucggauacauuuguaguggcaucuuuggcgauaauccgaggcccaacgacaagaccggguccugcggaccuguuagcucuaauggugcgaacggcgugaaaggguucucauuuaaguauggaaacggcguauggaucggucggacaaagaauauuaguagccgcaaaggguucgagaugauaugggauccaaacggcuggaccggaacggacaauaacuuuuccaucaagcaagacauugugggcaucaaugaauggucuggguacucgggaucauucguccagcaucccgagcugacuggucuggauuguauucgaccuugcuucuggguggaacucaucagaggcaggccaaaagagaacacaauauggaccuccgggucaaguaucucuuuuuguggaguuaauagcgacacugugggcugguccuggcccgauggugcagaguuaccguucacaauugacaaguga

SEQ ID NO: 143104 - RNA, 1410 nt, Artificial Sequence
  derived and/or modified sequence opt3 from neuraminidase__InfluenzaA__AEQ49751
augaaccccaaucagaagaucauuaccauaggcagcgugugcaugacaaucgggauggccaaccugauucuccaaaucggaaauauuaucuccauauggaucucucacucauuccagcuugguaaccagagucagauugagacuuguaaucaaagcgucaucacguacgaaaacaauaccuggguuaaccagacauaugugaauauuuccaacacuaauuuugcugcaggccagucuguagugucggucaaacuggccgggaacagcagcuugugcccugugaguggaugggcgaucuacuccaaggacaauucuauaagaauuggcagcaaaggugauguuuucgugaucagggagccauuuauuuccuguucaccguuagaaugccggaccuucuuucugacacagggggcucuacucaacgacaaucauaguaacggaaccaucaaggaucgcagccccuaucgaacucugaugucuuguccuaucggcgaggucccaucccccuacaacucacguuucgaaagcguggccuggagugcaucugccugccacgacggcauuaauuggcuuacaauagggaucuccggaccugauaacggugcuguagcaguucugaaauauaauggcauuaucaccgacacgauaaagagcuggagaaacaauauuuugaggacucaagagucggagugugccugcgugaacgggucuuguuuuaccaucaugacagauggaccauccgacggccaggcuucauacaagaucuuccggauugaaaaagguaagaucgucaaaaguguggagaugaaugcccccaacuaucauuacgaagagugcagcuguuacccugauuccucugagauuacuugcgugugccgcgacaauuggcacgggagcaacagaccaugggucucauuuaaucagaaccucgaauaucagauaggauacaucuguaguggcauuuucggcgauaauccgaggcccaacgacaagaccggguccugcggaccuguuagcucuaauggugcgaacggcgugaaaggguuuucauucaaguauggaaacggcguauggaucggucggacaaagaguaucagcucccgcaaaggguuugagaugauuugggauccaaauggcuggaccggaacggacaacaauuucucuauaaagcaagacaucgugggcauuaacgaauggucgggguacagcggauccuucguccagcaucccgagcugacugguauggauuguauccgaccuugcuuuuggguggaacugauuagaggcaggccaaaagagaauacaaucuggaccucagggaguucuauaucauucuguggaguuaacuccgacacugugggcuggucauggcccgauggugcagagcucccguuuacaaucgacaaguga

SEQ ID NO: 143105 - RNA, 1410 nt, Artificial Sequence
  derived and/or modified sequence opt3 from neuraminidase__InfluenzaA__AEQ49752
augaaccccaaucagaagaucauuaccauaggcagcgugugcaugacaaucgggauggccaaccugauucuccaaaucggaaauauuaucuccauauggaucucucacucaauucagcuugguaaccagagucagaucggcacuuguaaucaaagcgucauuacguacgagaacaauaccuggguuaaccagacauaugugaauaucuccaacacuaauuucgcugcagggcagucuguagugucggucaaacuggccggaaacagcucauugugcccugugaguggcugggcgauauacuccaaggacaauucuauuagaaucgguagcaaaggggauguuuuugugauuagggaaccauucaucuccuguucaccguuagagugccggaccuuuuuccugacacagggagcucuacucaacgacaagcauaguaauggcaccaucaaagaucgcagccccuaucgaacucugaugucuuguccuauuggcgaagucccaucccccuacaacucacguuuugagagcguggccuggagugcaucugccugccacgacgggauaaacuggcuuacaaucggaauuuccgguccugauaauggcgcuguagcaguucugaaguauaacgggaucauaaccgacacgauuaagagcuggagaaauaacaucuugaggacucaagaaucggagugugccugcgugaauggaucuuguuucaccaucaugacagauggcccauccgacggucaggcuucauacaaaauuuuucggaucgagaaggggaaaauugucaagaguguggaaaugaacgcccccaauuauuacuacgaggaaugcagcuguuauccugauuccucugagauaacuugcgugugccgcgacaacuggcauggaagcaauagaccaugggucucauucaaccagaaucucgaguaccagaucggcuauauuuguaguggcaucuuuggggauaacccgaggcccaaugacaaaaccggauccugcgguccuguuagcucuaacggcgcgaauggggugaagggauucucauuuaaguacggcaacgguguauggaucgggcggacaaaaaguauuagcucccgcaagggcuucgaaaugauaugggauccaaacggauggaccggcacggacaauaacuuuucuaucaaacaagacauuguggggaucaaugaguggucgggauauagcgguuccuucguccagcaccccgaacugacuggcauggauuguauucgaccuugcuucuggguggagcugaucagagggaggccaaaggaaaacacaauauggaccucaggaaguucuaucagcuuuuguggcguuaauuccgacacuguggguuggucauggcccgauggggcagagcucccguucacaauugacaaauga

SEQ ID NO: 143106 - RNA, 1410 nt, Artificial Sequence
  derived and/or modified sequence opt3 from neuraminidase__InfluenzaA__AEQ49753
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucggucggacaaaaaguauuagcucccgcaagggguucgagaugauaugggauccaaacggcuggaccggaacggacaauaacuuuucuaucaaacaagacauugugggcaucaaugaauggucgggguacagcggauccuucguccagcaucccgagcugacugguauggauuguauucgaccuugcuucuggguggaacugaucagaggcaggccaaaggagaacacaauauggaccucagggaguucuaucagcuuuuguggaguuaauuccgacacuguggauuggucauggcccgacggcgcagagcucccguucacaauugauaaauga

SEQ ID NO: 143107 - RNA, 1410 nt, Artificial Sequence
  derived and/or modified sequence opt3 from neuraminidase__InfluenzaA__AEQ49754
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucggucggacaaaaaguauuagcucccgcaagggguucgagaugauaugggauccaaacggcuggaccggaacggacaauaacuuuucuaucaaacaagacauugugggcaucaaugaauggucgggguacagcggauccuucguccagcaucccgagcugacuggucuggauuguauucgaccuugcuucuggguggaacucaucagaggcaggccaaaggagaacacaauauggaccucagggaguucuaucagcuuuuguggaguuaauuccaacacugugggcuggucauggcccgacggugcagaguuaccguucacaauugauaaauga

SEQ ID NO: 143108 - RNA, 1410 nt, Artificial Sequence; identical to SEQ ID NO: 143094
  derived and/or modified sequence opt3 from neuraminidase__InfluenzaA__AEQ49755

SEQ ID NO: 143109 - RNA, 1410 nt, Artificial Sequence
  derived and/or modified sequence opt3 from neuraminidase__InfluenzaA__AEQ49756
augaaccccaaucagaagaucauuaccauaggcagcgugugcaugacaaucgggauggccaaccugauucuccaaaucggaaauauuaucuccauauggaucucucacucaauucagcuugguaaccagagucaggucgagacuuguaaucaaagcguuaucacguacgaaaacaauaccugggugaaccagacauauguaaauauuuccaacacuaauuucgcugcaggccagucuguggucucggugaaacuggccgggaacagcagcuugugcccuguuaguggaugggcgaucuacuccaaggacaauucuauaagaauuggcagcaaaggugauguguuugucaucagggagccauucauuuccuguucaccguuagaaugccggaccuuuuuccugacacagggggcucuacucaacgacaagcauaguaauggaaccaucaaagaucgcagccccuaucgaacucugaugucuuguccuaucggcgaggugccaucccccuacaacucacguuuugaaagcguagccuggagugcaucugccugccacgacggcauuaacuggcuuacaauagggaucuccggaccugauaauggugcuguugcagugcugaaguauaacggcauuaucaccgacacgauaaagagcuggagaaauaacauuuugaggacucaagagucggagugugccugcgucaaugggucuuguuucaccaucaugacagauggaccauccgacggccaggcuucauacaaaaucuuucggauugaaaaggguaaaaucgugaagaguguggagaugaacgcccccaauuaucauuacgaagagugcagcuguuacccugauuccucugagauuacuugcgucugccgcgacaacuggcacgggagcaauagaccauggguuucauucaaccagaaucucgaauaucagauaggauacaucuguaguggcauuuuuggcgauaacccgaggcccaaugacaaaaccggguccugcggaccugugagcucuaacggugcgaauggcguaaagggguucucauuuaaguauggaaacggcguguggaucggucggacaaaaaguaucagcucccgcaagggguucgagaugauuugggauccaaacggcuggaccggaacggacaauaacuuuucuauaaaacaagacaucgucggcauuaaugaauggucgggguacagcggauccuucgugcagcaucccgagcugacuggucuggauuguauccgaccuugcuucuggguugaacucauuagaggcaggccaaaggagaacacaaucuggaccucagggaguucuauaucauuuuguggagucaauuccgacacugugggcuggucauggcccgauggugcagaguuaccguucacaaucgacaaauga

SEQ ID NO: 143110 - RNA, 1410 nt, Artificial Sequence; identical to SEQ ID NO: 143094
  derived and/or modified sequence opt3 from neuraminidase__InfluenzaA__AEQ49757

SEQ ID NO: 143111 - RNA, 1410 nt, Artificial Sequence
  derived and/or modified sequence opt3 from neuraminidase__InfluenzaA__AEQ49758
augaaccccaaucagaagaucauuaccauaggcagcgugugcaugacaaucgggauggccaaccugauucuccaaaucggaaauauuaucuccauauggaucucucacucaauucagcuugguaaccauagucagaucgagacuuguaaucagagcgucauuacguacgaaaacaauaccuggguuaaccaaacauaugugaauaucuccaacacuaauuucgcugcaggccagucuguagugucggucaaacuggccgggaacucaucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcacaguaauggaaccaucaaagaucgcagccccuaucgaacucugaugucuuguccuauuggcgaggucccaucccccuacaacucacguuuugaaagcguggccuggagugcaucugccugccaugacggcauaaacuggcuuacaaucgggauuuccggaccugauaauggugcuguagcaguucugaaguauaacggcaucauaaccgacacgauuaagagcuggagaaauaacaucuugaggacucaggagucggagugugccugcgugaaugggucuuguuucaccaucaugacagauggaccauccgacggccaagcuagcuacaaaauuuuucggaucgaaaaggguaaaauugucaagaguguggagaugaacgcccccaauuauuacuacgaagagugcagcuguuauccugauuccucugagauaacuugcgugugccgcgacaacuggcacgggagcaauagaccaugggucucauucaaccagaaucucgaauaccagaucggauauauuuguaguggcaucuuuggcgauaacccgaggcccaaugacaaaaccggguccugcggaccuguuagcucuaacggugcgaauggcgugaagggguucucauuuaaguacggaaacggcguauggaucggucggacaaaaaguauuagcucccgcaagggguucgagaugauaugggauccaaacggcugggcaggaaccgacaauaacuuuucuaucaaacaggacauugugggcaucaaugaauggucgggguauagcggauccuucguccaacaucccgagcugacgggucuggauuguauucgaccuugcuucuggguggaacucaucagaggcaggccaaaggagaacacuauauggacaucagggaguucuaucagcuuuuguggaguuaauuccgacaccgugggcuggucauggcccgauggugccgaguuaccguucacuauugacaaauga

SEQ ID NO: 143112 - RNA, 1410 nt, Artificial Sequence; identical to SEQ ID NO: 143094
  derived and/or modified sequence opt3 from neuraminidase__InfluenzaA__AEQ49759

SEQ ID NO: 143113 - RNA, 1410 nt, Artificial Sequence; identical to SEQ ID NO: 143094
  derived and/or modified sequence opt3 from neuraminidase__InfluenzaA__AEQ49760

SEQ ID NO: 143114 - RNA, 1410 nt, Artificial Sequence
  derived and/or modified sequence opt3 from neuraminidase__InfluenzaA__AEQ49761
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggcugaaccagacauauguuaauaucuccaacacuaauuucgcugcaggccagucugugguaucggugaaauuggccgggaacagcagcuuaugcccugucaguggaugggcgauauacuccaaggacaauucuauuagaaucggcagcaaaggugauguguuuguuauuagggagccauucaucuccuguucaccgagugaaugccggaccuuuuuccugacacagggggcucuacucaacgacaagcauagcaauggaaccaucaaagaucgcucucccuaucgaacucugauguccuguccuauuggcgaggugccaucacccuacaacagccguuuugaaagugucgccuggucugcauccgccugccacgacggcauaaacuggcuuacaaucgggauuagcggaccugauaauggugcuguggcaguacugaaguauaacggcaucauaaccgacacgauuaagucguggagaaauaacaucuugaggacucaagagucugagugugccugcguuaauggguccuguuucaccaucaugacagauggaccaucagacggccaggcuaguuacaaaauuuuucggaucgaaaaggguaaaauugugaagucagucgagaugaacgcccccaauuaucauuacgaagagugcuccuguuacccugauucuagcgagauaacuugcgugugccgcgacaacuggcacgggucaaauagaccaugggugaguuucaaccagaaucucgaauaucagaucggauacauuuguuccggcaucuuuggcgauaacccgaggcccaaugacaaaaccgggagcugcggaccugucucuucaaacggugcgaauggcguuaagggguucaguuuuaaguauggaaacggcguguggaucggucggacaaaaagcauuuccucucgcaagggguucgagaugauaugggauccaaacggcuggaccggaacggacaauaacuuuucgaucaaacaagacauuguaggcaucaaugaauggagcggguacuccggaucauucgugcagcaucccgagcugacuggucuggauuguauucgaccuugcuucugggucgaacucaucagaggcaggaguaaggagaacacaauauggaccucugggagcuccaucucauuuuguggagugaauagcgacacuguuggcuggucuuggccagauggugcagaguuacccuucacaauugacaaauga

SEQ ID NO: 143115 - RNA, 1410 nt, Artificial Sequence
  derived and/or modified sequence opt3 from neuraminidase__InfluenzaA__AEQ49762
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggaucaaccagacauauguuaauauauccaacacuaauuucgcugcaggccagucugugguaucggugaaacuggccgggaacucauccuugugcccugucaguggaugggcgauuuacuccaaggacaauucuaucagaauuggcagcaaaggugauguguuuguuaucagggagccauucaucuccuguucaccguuagaaugccggaccuuuuuccugacacagggggcucuacucaacgacaagcauaguaauggaaccauuaaagaucgcagccccuaucgaacucugaugucuuguccuauaggcgaggugccaucccccuacaacucacguuuugaaagcgucgccuggagugcaucugccugccacgacggcaucaacuggcuuacaauugggaucuccggaccugauaauggugcuguggcaguacugaaguauaacggcauaauuaccgacacgaucaagagcuggagaaauaacaucuugaggacucaagagucggagugugccugcguuaaugggucuuguuucauuaucaugaccgauggaccauccgacggccaggcuucauacaaaauuuuucggauagaaaaggguaaaaucgugaagagugucgagaugaacgcccccaauuaucauuacgaagagugcagcuguuacccugauuccucugagauuacaugcgugugccgcgacaacuggcacgggagcaauagaccaugggugucauucaaccagaaucucgaauaucagaucggauacaucuguaguggcauuuuuggcgauaacccgaggcccaaugacaaaacuggguccugcggaccugucagcucuaacggugcgaauggcguuaagggguucucauuuaaguauggaaacggcguguggauaggucggaccaaaaguaucagcucccgcaagggguucgagaugauuugggauccaaacggcuggacaggaaccgacaauaacuuuucuaucaaacaagacauuguaggcaucaaugaauggucgggguacagcggauccuucgugcagcaucccgagcugacgggucuggauuguauacgaccuugcuucugggucgaacucaucagaggcaggccaaaggagaacacuauuuggacaucagggaguucuaucagcuuuuguggagugaauagcgacaccguuggcuggucauggcccgauggugcagaguuaccguucacuauugacaaauga

SEQ ID NO: 143116 - RNA, 1410 nt, Artificial Sequence; identical to SEQ ID NO: 143094
  derived and/or modified sequence opt3 from neuraminidase__InfluenzaA__AEQ49763

SEQ ID NO: 143117 - RNA, 1410 nt, Artificial Sequence; identical to SEQ ID NO: 143094
  derived and/or modified sequence opt3 from neuraminidase__InfluenzaA__AEQ49764

SEQ ID NO: 143118 - RNA, 1410 nt, Artificial Sequence; identical to SEQ ID NO: 143094
  derived and/or modified sequence opt3 from neuraminidase__InfluenzaA__AEQ49765

SEQ ID NO: 143119 - RNA, 1410 nt, Artificial Sequence
  derived and/or modified sequence opt3 from neuraminidase__InfluenzaA__AEQ49766
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacugaccgggaacagcucauugugcccugugaguggaugggccauauacuccaaggacaauucuauuagaaucggcagcaaaggugauguuuuugugauuagggagccauucaucuccuguucaccguuagaaugccggacauuuuuccugacccagggggcgcuacucaacgacaagcauaguaauggaacuaucaaagaucgcagccccuaucgaacacugaugucuuguccuauuggcgaggucccaucccccuacaacucacguuuugaaagcguggcuuggagugccucugcaugccacgacggcauaaacuggcuuaccaucgggauuuccggaccugauaauggugccguagcuguucugaaguauaacggcaucauaacggacacuauuaagagcuggagaaauaacaucuugaggacccaagagucggagugugcaugcgugaaugggucuuguuucacaaucaugacugauggaccauccgacggccaggccucauacaaaauuuuucggaucgaaaaggguaaaauugucaagaguguggagaugaacgcucccaauuaucauuacgaagagugcagcuguuacccugauuccucugagauaaccugcgugugccgcgacaacuggcacgggagcaauagaccaugggucucauucaaccagaaucucgaauaucagaucggauacauuuguaguggcaucuuuggcgauaacccgaggcccaaugacaaaacaggguccugcggaccuguuagcucuaacggugccaauggcgugaagggguucucauuuaaguauggaaacggcguauggaucggucggaccaaaaguauuagcucccgcaagggguucgagaugauaugggauccaaacggcuggacgggaacugacaauaacuuuucuaucaaacaagacauugugggcaucaaugaauggucgggguacagcggauccuucguccagcaucccgagcugacaggucuggauuguauucgaccuugcuucuggguggaacucaucagaggcaggccaaaggagaacaccauauggacuucagggaguucuaucagcuuuuguggaguuaauuccgacacagugggcuggucauggcccgauggugcggaguuaccguucaccauugacaaauga

SEQ ID NO: 143120 - RNA, 1410 nt, Artificial Sequence
  derived and/or modified sequence opt3 from neuraminidase__InfluenzaA__AEQ49767
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuuaagaucgaaaaagguaagauugucaaaaguguggagaugaacgcccccaauuaucauuacgaagagugcagcuguuacccugauuccucugagauaacuugcgugugccgggacaacuggcacgggagcaaucgcccaugggucucauucaaccagaaucucgaauaucagaucggauacauuuguaguggcaucuuuggcgauaacccgagacccaaugacaagaccggguccugcggaccuguuagcucuaacggugcgaauggcgugaagggguucucauauaaauacggaaacggcguauggaucgguaggacaaagaguauuagcucccggaaaggguuugagaugauaugggauccaaacggcuggaccggaacggacaauaacuucucuaucaagcaagacauugugggcaucaaugaauggucgggguauagcggauccuuuguccagcaucccgagcugacugguaugggcuguauucgcccuugcuucuggguggaacugauccgagggagaccaaaagagaacacaauauggaccucaggaaguucuaucagcuucuguggcguuaauuccgauacuguggguuggucauggcccgacggggcagagcucccguuuacaauugauaaguga

SEQ ID NO: 143121 - RNA, 1410 nt, Artificial Sequence; identical to SEQ ID NO: 142273
  derived and/or modified sequence opt3 from neuraminidase__InfluenzaA__AEQ49768

SEQ ID NO: 143122 - RNA, 1410 nt, Artificial Sequence; identical to SEQ ID NO: 143094
  derived and/or modified sequence opt3 from neuraminidase__InfluenzaA__AEQ49769

SEQ ID NO: 143123 - RNA, 1410 nt, Artificial Sequence
  derived and/or modified sequence opt3 from neuraminidase__InfluenzaA__AEQ49770
augaaccccaaucagaagaucauuaccauaggcagcgugugcaugacaaucgggauggccaaccugauucuccaaaucggaaauauuaucuccgucuggauaucucacucaauccagcuugguaaccagaaucagacugagacguguaaccaaaguguuauuaccuacgaaaauaacacaugggugaaucagacuuauguaaacaucagcaauaccaacuucgcugcaggccaguccguggucucugugaaacuggccggaaauucgucauugugcccuguuagcggaugggcgauuuacaguaaggacaacuccaucagaauaggcucuaaaggugauguguuugucauuagggagccauucaucagcuguuccccguuagaaugccggacauuuuuccugacccagggggcucuacucaaugacaagcauucaaacggaacuauuaaagaucgcagucccuaucgaacacugaugagcuguccuaucggcgaggugccaucucccuacaacucccguuuugaaucaguagccuggagcgcaagugccugccacgacggcaucaauuggcuuaccauugggauaucuggaccugauaacggugcuguugcagugcugaaguauaauggcaucauuacggacacuaucaaguccuggagaaacaauauauugaggacccaagagagcgagugugccugcgucaacgggucguguuucacagugaugacugauggaccaucugacggccaggcuuccuacaaaauuuuucggaucgaaaaggguaaaaucgugaagucagucgagaugaaugcccccaacuaucauuacgaagagugcaguuguuacccugauagcuccgagauuaccugcguuugccgcgacaauuggcacgggucuaacagaccaugggugagcuucaaucagaaccucgaauauaggaucggauacauuuguucaggcauauuuggcgauaauccgcggcccaacgacaaaacagggaguugcggaccuguauccagcaauggugcgaacggcgugaagggguucucuuuuaaguauggaaacggcgucuggaucggucgcaccaaaucaauuaguagccgaaauggguucgagaugaucugggauccaaacggcuggacgggaacugacaauaacuuuuccaucaagcaggacauuauaggcaucaaugaauggucuggguacucggggagcuucgugcaacaucccgagcugacaggucuggauuguauuagaccuugcuucuggguugaacucaucaggggccggccaaaagagaacaccauuuggacuuccgggucaaguaucucuuuuuguggagugaauagcgacacagucggcugguccuggcccgauggugcagaguuaccguucaccguggacaaguga

SEQ ID NO: 143124 - RNA, 1410 nt, Artificial Sequence; identical to SEQ ID NO: 143107
  derived and/or modified sequence opt3 from neuraminidase__InfluenzaA__AEQ49771

SEQ ID NO: 143125 - RNA, 1410 nt, Artificial Sequence; identical to SEQ ID NO: 142273
  derived and/or modified sequence opt3 from neuraminidase__InfluenzaA__AEQ49772

SEQ ID NO: 143126 - RNA, 1410 nt, Artificial Sequence
  derived and/or modified sequence opt3 from neuraminidase__InfluenzaA__AEQ49773
augaaccccaaucagaagaucauuaccauaggcagcaucugcaugacaauugggauggccaaccugauccuccaaauuggaaauaucauauccaucuggauuucucacucaauccagcuugguaaccagagucagauugagacuuguaaucaaagcgugaucacguacgaaaacaauaccugggucaaccagacauauguuaauauauccaacacuaauuucgcugcaggccagucugugguaucggugaaacuggccgggaacucauccuugugcccugucaguggaugggcgauuuacuccaaggacaauucuaucagaauuggcagcaaaggugauguguuuguuaucagggagccauucaucuccuguucaccguuagaaugccggaccuuuuuccugacacagggggcucuacucaacgacaagcauaguaauggaaccauuaaagaucgcagccccuaucgaacucugaugucuuguccuauaggcgaggugccaucccccuacaacucacguuuugaaagcgucgccuggagugcaucugccugccacgacggcaucaacuggcuuacaauugggaucuccggaccugauaauggugcuguggcaguacugaaguauaacggcauaauuaccgacacgaucaagagcuggagaaauaacaucuugaggacucaagagucggagugugccugcguuaaugggucuuguuucaccauuaugacagauggaccauccgacggccaggcuucauacaaaaucuuucggauugaaaaggguaaaauagugaagagugucgagaugaacgcccccaauuaucauuacgaagagugcagcuguuacccugauuccucugagaucacuugcgugugccgcgacaacuggcacgggagcaauagaccaugggugucauucaaccagaaucucgaauaucagauuggauacaucuguaguggcaucuuuggcgauaacccgaggcccaaugacaaaaccggguccugcggaccugucagcucuaacggugcgaauggcguuaagggguucucauuuaaguauggaaacggcguguggauuggucggacaaaaaguauaagcucccgcaagggguucgagaugaucugggauccaaacggcuggaccggaacggacaauaacuuuucuauuaaacaagacaucguaggcauuaaugaauggucgggguacagcggauccuucgugcagcaucccgagcugacuggucuggauuguauccgaccuugcuucugggucgaacucauaagaggcaggccaaaggagaacacaaucuggaccucagggaguucuauuagcuuuuguggagugaauagcaacacuguuggcuggucauggcccgacggugcagaguuaccguucacaaucgauaaauga

SEQ ID NO: 143127 - RNA, 1410 nt, Artificial Sequence
  derived and/or modified sequence opt3 from neuraminidase__InfluenzaA__AEQ49774
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaauauaacaccuggguuaaucagacauacaucaacauauccaauacuaacuucgcugcaggccagucugugguaucggugaaacuggucgggaauagcucauugugcccugugaguggaugggccauuuauuccaaggacaacucuaucagaauuggcagcaaaggugauguuuuugugaucagggagccauucaucuccuguucaccguuagaaugccggaccuuuuuccugacacagggggcgcuacucaaugacaagcauaguaacggaaccauuaaagaucgcagccccuaccgaacucugaugucuuguccuauaggcgaggucccaucccccuauaauucacguuuugaaagcguggcuuggagugccucugcaugccacgacggcaucaacuggcuuacaauugggaucuccggaccugauaacggugccguagcuguucugaaguacaauggcauaauuaccgacacgaucaagagcuggagaaacaauaucuugaggacucaagagucggagugugcaugcgugaacgggucuuguuucaccauuaugacagauggaccauccgacggccaggccucauauaaaaucuuucggauugaaaaggguaaaauagucaagaguguggagaugaaugcucccaacuaccauuacgaagagugcagcuguuauccugauuccucugagaucacuugcgugugccgcgacaauuggcacgggagcaacagaccaugggucucauucaaucagaaccucgaauaccagauuggauauaucuguaguggcaucuuuggcgauaauccgaggcccaacgacaaaaccggguccugcggaccuguuagcucuaauggugccaacggcgugaagggguucucauuuaaguacggaaauggcguauggauuggucggacaaaaaguauaagcucccgcaagggguaugagaugaucugggauccaaacggcuggaccggaacggacaacaauuucucuauuaaacaagacaucgugggcauuaacgaauggucgggguacagcggauccuuuguccagcaucccgagcugacugguauggauuguauccgaccuugcuucuggguggaacugauaagaggcaggccaaaggagaauacaaucuggaccucagggaguucuauuagcuucuguggaguuaacuccgacacugugggcuggucauggcccgauggugcggagcucccguuuacaaucgacaaauga

SEQ ID NO: 143128 - RNA, 1410 nt, Artificial Sequence; identical to SEQ ID NO: 142273
  derived and/or modified sequence opt3 from neuraminidase__InfluenzaA__AEQ49775

SEQ ID NO: 143129 - RNA, 1410 nt, Artificial Sequence
  derived and/or modified sequence opt3 from neuraminidase__InfluenzaA__AEQ49776
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacaguagcuugugcccugugaguggaugggcgauauacuccaaggacaauucuauuagaaucggcagcaaaggugauguuuuugugauuagggagccauucaucuccuguucaccgagugaaugccggaccuuuuucuuaacacagggggcucugcuaaacgacaagcauagcaauggaaccaucaaagaucgcucucccuaucgaacucucauguccuguccuauuggcgaggucccaucacccuacaacagccguuuugaaaguguggccuggucugcauccgccugccacgacggcauaaacuggcugacaaucgggauuagcggaccugauaauggugcuguagcaguucuuaaguauaacggcaucauaaccgacacgauuaagucguggagaaauaacauccugaggacucaagagucugagugugccugcgugaauggguccuguuucaccaucaugacagauggaccaucagacggccaggcuaguuacaaaauuuuucggaucgaaaaggguaaaauugucaagagcguggagaugaacgcccccaauuaucauuacgaagagugcuccuguuacccugauucuagcgagauaacuugcgugugccgcgacaacuggcacgggucaaauagaccaugggucaguuucaaccagaauuuggaauaucagaucggauacauuuguuccggcaucuuuggcgauaacccgaggcccaaugacaaaaccgggagcugcggaccuguuucuucaaacggugcgaauggcgugaagggguucaguuuuaaguauggaaacggcguauggaucggucggacaaaaagcauuuccucucgcaagggguucgagaugauaugggauccaaacggcuggaccggaacggacaauaacuuuucgaucaaacaagacauugugggcaucaaugaauggagcggguacuccggaucauucguccagcaucccgagcucacuggucuggauuguauucgaccuugcuucuggguggaacugaucagaggcaggccaacagagaacaccauauggacuucagggucuagcaucuccuuuuguggaguuaauucagacacagugggcuggagcuggcccgauggugcagagcucccguucaccauugacaaguga

SEQ ID NO: 143130 - RNA, 1410 nt, Artificial Sequence; identical to SEQ ID NO: 143094
  derived and/or modified sequence opt3 from neuraminidase__InfluenzaA__AEQ49777

SEQ ID NO: 143131 - RNA, 1410 nt, Artificial Sequence
  derived and/or modified sequence opt3 from neuraminidase__InfluenzaA__AEQ49778
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggaucaaccagacauauguuaauauauccaacacuaauuucgcugcagugcagucuguagugucggucaaacuggccggcaacucaaccuugugcccugugagcgggugggcgauuuacaguaaggacaauuccaucagaauuggaucuaaaggcgauguuuuugugaucagggagccauucaucagcuguuccccguuagaaugccggacauuuuuccugacccagggugcucuacucaacgacaagcauucaaaugggacuauuaaagaucgcagucccuaucgaacacugaugagcuguccuauaggagaggucccaucucccuacaacucccguuuugaaucaguggccuggagcgcaagugccugccacgacggcaucaacuggcuuaccauuggcaucucugggccugauaauggagcuguagcaguucugaaguauaacgguauaauuacggacacuaucaaguccuggagaaauaacaucuugaggacccaagagagcgagugugccugcgugaauggcucguguuucacaauuaugacugaugggccaucugacggacaggcuuccuacaaaaucuuucggauugaaaagggcaaaauagucaagucaguggagaugaacgcccccaauuaucauuacgaagagugcaguuguuacccugauagcuccgagauuaccugcgugugccgcgacaacuggcacgguucuaauagaccaugggucagcuucaaccagaaucucgaauaucagaucggguacaucuguucaggaaucuuuggcgauaacccgaggcccaaugacaaaacaggcaguugcgggccuguuuccagcaacggagcgaauggugugaagggcuucucuuuuaaguaugggaacggaguauggauuggccggaccaaaucaauaaguagccgcaaggguuucgagaugaucugggauccaaacggguggacgggcacugacaauaacuuuuccauuaaacaagacaucgugggaauuaaugaauggucuggcuacucggggagcuucguccagcaucccgagcugacaggacuggauuguauccgaccuugcuucuggguggaacucauaagagguaggccaaaggagaacaccaucuggacuuccggcucaaguauuucuuuuugugggguuaauagcgacacagugggaugguccuggcccgauggcgcagaguuaccguucaccaucgacaaauga

SEQ ID NO: 143132 - RNA, 1410 nt, Artificial Sequence
  derived and/or modified sequence opt3 from neuraminidase__InfluenzaA__AEQ49779
augaaccccaaucagaagaucauuaccauaggcagcgugugcaugacaaucgggauggccaaccugauucuccaaaucggaaauauuaucuccauauggaucucucacucaauucagcuugguaaccagaaucagacugagacguguaaccaaagugucaucaccuacgaaaauaacacauggguuaaucagacuuaugugaacauuagcaauaccaacuucgcugcaggccaguccguagugucugucaaacuggccggaaauucgucauugugcccugugagcggaugggcgaucuacaguaaggacaacuccauaagaauuggcucuaaaggugauguuuuugugaucagggagccauucauuagcuguuccccguuagaaugccggacauuuuuccugacccagggggcucuacucaaugacaagcauucaaacggaacuaucaaagaucgcagucccuaucgaacacugaugagcuguccuaucggcgaggucccaucucccuacaacucccguuuugaaucaguggccuggagcgcaagugccugccacgacggcauuaauuggcuuaccauagggaucucuggaccugauaacggugcuguagcaguucugaaguauaauggcauuaucacggacacuauaaaguccuggagaaacaauauuuugaggacccaagagagcgagugugccugcgugaacgggucguguuucacagucaugacugauggaccaucugacggccaggcuuccuacaaaaucuuucggaucgaaaaggguaaaauugugaagucaguggagaugaaugcccccaacuaucauuacgaagagugcaguuguuacccugauagcuccgagauuaccugcgucugccgcgacaauuggcacgggucuaacagaccauggguuagcuucaaucagaaccucgaauauaggaucggauacauauguucaggcaucuuuggcgauaauccgcggcccaacgacaaaacagggaguugcggaccuguguccagcaauggugcgaacggcguaaagggguucucuuuuaaguauggaaacggcguguggauuggucgcaccaaaucaaucaguagccgaaauggguucgagaugaucugggauccaaacggcuggacgggaacugacaauaacuuuuccauuaagcaggacauaaucggcauuaaugaauggucuggguacucggggagcuucguccaacaucccgagcugacaggucuggauuguaucagaccuugcuucuggguggaacucauuaggggccggccaaaagagaacaccaucuggacuuccgggucaaguauaucuuuuuguggaguuaauagcgacacagugggcugguccuggcccgauggugcagaguuaccguucaccgucgacaaguga

SEQ ID NO: 143133 - RNA, 1410 nt, Artificial Sequence; identical to SEQ ID NO: 142273
  derived and/or modified sequence opt3 from neuraminidase__InfluenzaA__AEQ49780

SEQ ID NO: 143134 - RNA, 1410 nt, Artificial Sequence; identical to SEQ ID NO: 142273
  derived and/or modified sequence opt3 from neuraminidase__InfluenzaA__AEQ49781

SEQ ID NO: 143135 - RNA, 1410 nt, Artificial Sequence; identical to SEQ ID NO: 143094
  derived and/or modified sequence opt3 from neuraminidase__InfluenzaA__AEQ49782

SEQ ID NO: 143136 - RNA, 1410 nt, Artificial Sequence
  derived and/or modified sequence opt3 from neuraminidase__InfluenzaA__AEQ49783
augaaccccaaucagaagaucauuaccauaggcagcgccugcaugacaaucgggauggcuaaccugauucuccaaaucggaaauauuaucuccauauggaucucucacucaauucagcuugguaaccagagucagaucgagacuuguaaucaaagcgugauuacguacgaaaacaauaccugggucaaccagacauauguuaauaucuccaacacuaauuucgcagccggccagucugugguaucggugaaacuggcggggaacucauccuugugcccugucaguggaugggcuauauacuccaaggacaauucuauuagaaucggcagcaaaggugauguguuuguuauuagggagccauucaucuccuguucaccguuagaaugccggaccuuuuuccugacacagggggcccuacucaacgacaagcauaguaauggaaccaucaaagaucgcagccccuaucgaacucugaugucuuguccuauuggcgaggugccaucccccuacaacucacguuuugaaagcgucgcauggagugccucugcuugccacgacggcauaaacuggcuuacaaucgggauuuccggaccugauaauggugcaguggccguacugaaguauaacggcaucauaaccgacacgauuaagagcuggagaaauaacaucuugaggacucaagagucggagugugcuugcguuaaugggucuuguuucaccaucaugacagauggaccauccgacggccaggccucauacaaaauuuuucggaucgaaaaggguaaaauugugaagagugucgagaugaacgcgcccaauuaucauuacgaagagugcagcuguuacccugauuccucugagauaacuugcgugugccgcgacaacuggcacgggagcaauagaccaugggugucauucaaccagaaucucgaauaucagaucggauacauuuguaguggcaucuuuggcgauaacccgaggcccaaugacaaaaccggguccugcggaccugucagcucuaacggugcaaauggcguuaagggguucucauuuaaguauggaaacggcguguggaucggucggacaaaaaguauuagcucccgcaagggguucgagaugauaugggauccaaacggcuggaccggaacggacaauaacuuuucuaucaaacaagacauuguaggcaucaaugaauggucgggguacagcggauccuucgugcagcaucccgagcugacuggucuggauuguauucgaccuugcuucugggucgaacucaucagaggcaggccaaaggagaacacaauauggaccucagggaguucuaucagcuuuuguggagugaauagcgacacuguuggcuggucauggcccgauggugccgaguuaccguucacaauugacaaauga

SEQ ID NO: 143137 - RNA, 1410 nt, Artificial Sequence
  derived and/or modified sequence opt3 from neuraminidase__InfluenzaA__AEQ49785
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaacggcacuuguacagucgugaugaccgauggcucugcuuccgggaaggcagacacuaaaauccucuuuauugaggaaggaaagaucgugcauacaucaaccuuaagcgguagugcccaacacgucgaggaaugcucuugcuauccucgcuacccaggcguuagaugugugugcagggauaauuggaagggguccaaccggccgauaguagacauuaauaugaaagaucacagcaucgugucgucuuacgucuguuccggacuggugggcgacacgccccgcaagaacgacucaaguagcuccucucauugcuucgauccuaaugacgaggaaggugggcacggaguuaaaggcugggcuuuugaugacggcaacgauguguggauggggcgaaccaucagcgagaagucaagacuuggauaugagacauucaaagucauugaagguuggaguaauccaaaguccaaauugcagaucaacaggcaagugauuguagaccggggcgaucguagcggguacucuggaauauuuucaguugagggcaagaguuguaucaaucgcugcuucuauguggaacugauuagagguagcaaggaggaaacugagguccuauggaccuccaacucuaucguggucuucugugggacaucgggcacuuacggaaccggcagcuggcccgacggggccgauaucaaucucaugccuauuuga

SEQ ID NO: 143138 - RNA, 1410 nt, Artificial Sequence; identical to SEQ ID NO: 143137
  derived and/or modified sequence opt3 from neuraminidase__InfluenzaA__AEQ49786

SEQ ID NO: 143139 - RNA, 1410 nt, Artificial Sequence; identical to SEQ ID NO: 143137
  derived and/or modified sequence opt3 from neuraminidase__InfluenzaA__AEQ49788

SEQ ID NO: 143140 - RNA, 1410 nt, Artificial Sequence; identical to SEQ ID NO: 143137
  derived and/or modified sequence opt3 from neuraminidase__InfluenzaA__AEQ49789

SEQ ID NO: 143141 - RNA, 1410 nt, Artificial Sequence
  derived and/or modified sequence opt3 from neuraminidase__InfluenzaA__AEQ49790
augaaccccaaucagaagaucauuaccauaggcagcgugucccugacaaucucuacuauuugcuucuuuaugcagaucgccauucucaucacgaccgucacacuucacuucaaacaguacgaguuuuauucaccuccaaacaaucagguuaugcugugugaaccgacuauaaucgagagaaacauuaccgaaaucguguacuugacaaauaccacuauugagaaggaaaucugccccaaauuagcugaguauaggaacuggaguaagccucagugugacauaacaggguucgcaccauuuagcaaagauaauuccauucggcugucugccggaggugacaucuggguaacccgcgagcccuacgugucgugcgauccugacaaguguuaucaauucgcgcuaggccaggggacgacucucaacaauguccauucaaacaauaccgugcgaggacguacaccauacagaacucugcuuaugaacgaacugggcguucccuuucacuuggguaccaaacaggugugcauugcuuggagcaguuccucuugucaugaugggaaggccuggcuccacgucugcaucacaggagacgauaagaaugcaaccgccagcuucaucuauaacggcaggcugguggacuccguaguuucauggaguaaagagauucugcggacgcaggaaagcgagugugugugcauaaauggcacuuguacagucgugaugaccgaugggucugcuuccggaaaggcagacacuaaaauccucuuuauugaggaagguaagaucgugcauacaucaaccuuaagcggcagugcccaacacgucgaggaaugcucuugcuacccucgcuacccagggguuagaugugugugcagggauaacuggaagggauccaaccggccgauaguagacauuaauaucaaagaucacagcaucgugucgucuuaugucuguuccggccuggugggugacacgccccgcaagaacgacucaaguagcuccucucauugccuugauccuaauaacgaggaagggggacacggcguuaaaggcugggcuuucgacgaugggaaugacguguggaugggacgaaccauuaacgagacaagcagauuggguuacgagacuuuuaaggucaucgaaggcuggucaaauccaaaaaguaagcugcagauuaacaggcaagugauaguagaucgggggaaucguuccggauauagcggcaucuucucuguugaggguaaaucauguauuaaccgcugcuuuuacguggaacuaaucagagggaggaaggaggaaaccgagguccucuggacaaguaauagcaucguggucuucuguggcacuuccggaaccuauggcacagggucuuggcccgacggagccgaucugaaccuuaugccuauuuga

SEQ ID NO: 143142 - RNA, 1410 nt, Artificial Sequence
  derived and/or modified sequence opt3 from neuraminidase__InfluenzaA__AEQ49791
augaaccccaaucagaagaucauuaccauaggcagcgugucccugacaaucucuacuauuugcuucuuuaugcagaucgccauucucaucacgaccgucacacuucacuucaaacaguacgaguuuuauccuccaccgaacaaucagguuaugcugugugaacccacuauaaucgagagaaacauuaccgaaaucguguacuugacaaauaccacuauugagaaggaaaucugcccuaaauuagcugaguauaggaacuggucaaagccacagugugacauaacaggguucgcacccuuuaguaaagauaauagcauucggcuguccgccggaggugacaucuggguaacccgcgagccuuacgugucuugcgauccagacaaguguuaucaauucgcgcuaggccaggggacgacucucaacaauguccauucgaacaauaccgugcgaaaccguacacccuacagaacucugcuuaugaaugaacugggaguuccuuuucacuugggcaccaaacaggugugcauugcuuggucaagcaguuccugucaugaugguaaggccuggcuccacgucugcaucacaggggacgauaagaacgcaaccgccucuuucaucuauaauggaaggcugguggacagcguaguuuccuggucaaaagagauucugcggacgcaggaaagugagugugugugcauaaacggcacuuguacagucgugaugaccgauggcagcgcuucugggaaggcagacacuaaaauccucuuuauugaggaaggaaagaucgugcauacauccaccuuaucagguagcgcccaacacgucgaggaaugcaguugcuacccacgcuacccgggcguuagaugugugugcagggauaacuggaaggggucuaaucggcccauaguagacauuaacaucaaagaucacuccaucgugagcucguaugucuguucuggacuggugggcgacacgccucgcaagaaugacuccucaaguagcucccauugccuugauccaaacaaugaggaaggugggcacggaguuaaaggcugggcuuucgacgauggcaacgacguguggauggggcgaaccauuaaugagacaucuagauugggauacgagacuuuuaaggucaucgaagguuggagcaaccccaaaucaaagcugcagauuaauaggcaagugauaguagaucggggcaaccguaguggguauuccggaaucuucagcguugagggcaaaucuuguauuaaucgcugcuuuuacguggaacuaaucagagguaggaaggaggaaaccgagguccucuggacaucaaacaguaucguggucuucugugggacuagcggcaccuauggaacaggcuccuggccugacggggccgaucugaaucuuaugccaauuuga

SEQ ID NO: 143143 - RNA, 1410 nt, Artificial Sequence; identical to SEQ ID NO: 143137
  derived and/or modified sequence opt3 from neuraminidase__InfluenzaA__AEQ49792

SEQ ID NO: 143144 - RNA, 1410 nt, Artificial Sequence; identical to SEQ ID NO: 143137
  derived and/or modified sequence opt3 from neuraminidase__InfluenzaA__AEQ49793

SEQ ID NO: 143145 - RNA, 1410 nt, Artificial Sequence; identical to SEQ ID NO: 143137
  derived and/or modified sequence opt3 from neuraminidase__InfluenzaA__AEQ49794

SEQ ID NO: 143146 - RNA, 1410 nt, Artificial Sequence; identical to SEQ ID NO: 143137
  derived and/or modified sequence opt3 from neuraminidase__InfluenzaA__AEQ49795

SEQ ID NO: 143147 - RNA, 1410 nt, Artificial Sequence
  derived and/or modified sequence opt3 from neuraminidase__InfluenzaA__AEQ49796
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgaggacguacaccauauagaacucugcuuaugaaugaacugggcguucccuuucacuuggguaccaaacaggugugcauugcuuggagcaguuccucuugucaugaugggaaggccuggcuccacgucugcaucacaggagacgauaagaacgcaaccgccagcuucaucuacaauggcaggcugguggacuccguaguuucauggaguaaagagauucugcggacgcaggaaagcgagugugugugcauaaacggcacuuguacagucgugaugaccgaugggucugcuuccggaaaggcagacacuaaaauccucuuuauugaggaagguaagaucgugcauacaucaaccuuaagcggcagugcccaacacgucgaggaaugcucuugcuauccucgcuacccagggguuagaugugugugcagggauaacuggaagggauccaaucggccgauaguagacauuaacaucaaagaucacagcaucgugucgucuuacgucuguuccggccuggugggugacacgccccgcaagaaugacucaaguagcuccucucauugccuugauccuaacaaugaggaagggggacacggcguuaaaggcugggcuuucgacgaugggaacgacguguggaugggacgaaccauuaaugagacaagcagauuggguuaugagacuuuuaaggucaucgaaggcuggucaaacccaaaaaguaagcugcagauuaauaggcaagugauaguagauaaagggaaccgguccggauacagcggcaucuucucuguugaggguaagucauguauuaaucguugcuuuuauguggaacuaauccgcgggagaaaggaggaaaccgagguccucuggacaaguaacagcaucguggucuucuguggcacuuccggaaccuacggcacagggucuuggcccgacggagccgaucugaaucuuaugccuauuuga

SEQ ID NO: 143148 - RNA, 1410 nt, Artificial Sequence; identical to SEQ ID NO: 143137
  derived and/or modified sequence opt3 from neuraminidase__InfluenzaA__AEQ49797

SEQ ID NO: 143149 - RNA, 1410 nt, Artificial Sequence; identical to SEQ ID NO: 143137
  derived and/or modified sequence opt3 from neuraminidase__InfluenzaA__AEQ49798

SEQ ID NO: 143150 - RNA, 1410 nt, Artificial Sequence; identical to SEQ ID NO: 143137
  derived and/or modified sequence opt3 from neuraminidase__InfluenzaA__AEQ49799

SEQ ID NO: 143151 - RNA, 1410 nt, Artificial Sequence; identical to SEQ ID NO: 143137
  derived and/or modified sequence opt3 from neuraminidase__InfluenzaA__AEQ49800

SEQ ID NO: 143152 - RNA, 1410 nt, Artificial Sequence; identical to SEQ ID NO: 143137
  derived and/or modified sequence opt3 from neuraminidase__InfluenzaA__AEQ49801

SEQ ID NO: 143153 - RNA, 1410 nt, Artificial Sequence; identical to SEQ ID NO: 143137
  derived and/or modified sequence opt3 from neuraminidase__InfluenzaA__AEQ49802

SEQ ID NO: 143154 - RNA, 1410 nt, Artificial Sequence
  derived and/or modified sequence opt3 from neuraminidase__InfluenzaA__AEQ49803
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaacggcacuuguacagucgugaugaccgauggcucugcuuccgggaaggcagacacuaaaauccucuuuauugaggaaggaaagaucgugcauacaucaaccuuaagcgguagugcccaacacgucgaggaaugcucuugcuauccucgcuacccaggcguuagaugugugugcagggauaauuggaagggguccaaccggccgauaguagacauuaauaucaaagaucacagcaucgugucgucuuacgucuguuccggacuggugggcgacacgccccgcaagaacgacucaaccaguagcucccauugccuugauccuaauaacgaggaaggugggcacggaguuaaaggcugggcuuucgacgauggcaaugacguguggauggggcgaacaauuucugagacuagcagauugggauaugagaccuuuaaggucaucgaagguuggucaaacccaaaaaguaagcugcagauuaauaggcaagugauaguagauaaaggcaaccgguccggguacagcggaaucuucucuguugagggcaagucauguauuaaucguugcuuuuauguggaacuaauccgcgguagaaaggaggaaacagagguccucuggaccaguaacagcaucguggucuucugugggacuuccggcacauacggaaccggcucuuggcccgacggggccgaucugaaucuuaugacuauuuga

SEQ ID NO: 143155 - RNA, 1410 nt, Artificial Sequence
  derived and/or modified sequence opt3 from neuraminidase__InfluenzaA__AEQ49804
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagacauucugcggacgcaggagagcgaaugugugugcauaaacggcacuuguacagucgugaugaccgauggcucugcuuccgggaaggcagacacuaaaauccuguuuauugaggagggaaagaucgugcauacaucaacccucagcgguagugcccaacacgucgaagagugcucuugcuauccacgcuacccgggcguuagaugugugugcagggauaacuggaagggguccaaucggcccauaguagacauuaacaucaaagaccacagcaucgugucgucuuacgucuguuccggauuagugggcgauacgccucgcaagaaugacucaaguagcuccucucauugccuggauccaaacaaugaagagggugggcacggaguuaaaggcugggcuuucgacgauggcaacgacguguggauggggcgaaccauuaaugaaacaagcagacuuggauaugagacuuuuaaggucaucgaggguuggucaaaccccaaaaguaaguugcagauuaauaggcaagugauaguagaucggggcaaccguuccggguacagcggaaucuucucuguugaaggcaaaucauguauuaaucgcugcuuuuauguggagcugaucagagguaggaaggaagagaccgaaguccuauggacaaguaacagcaucguggucuucugugggacuuccggcaccuacggaacaggcucuuggccugacggggccgaucucaaucugaugccaauuuga

SEQ ID NO: 143156 - RNA, 1410 nt, Artificial Sequence
  derived and/or modified sequence opt3 from neuraminidase__InfluenzaA__AEQ49805
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgaaaucguacacccuauagaacucuccugaugaacgaacuuggaguuccuuuucaccugggcaccaaacaggugugcauugcuuggagcaguuccucuugucaugaugguaaggccugguugcacgucugcaucacaggggacgauaagaaugcaaccgccagcuucaucuacaacggaaggcucguggacuccguaguuucauggaguaaagauauucugcggacgcaggagagcgaaugugugugcauaaacggcacuuguacagucgugaugaccgacggcucugcuuccgggaaggcagauacuaaaauccuguuuauugaggagggaaagaucgugcauacaucaacccucagcgguagugcccaacacgucgaagagugcucuugcuauccacgcuacccgggcguuagaugugugugcagggacaauuggaagggguccaaccggcccauaguagauauuaauaucaaagaccacagcaucgugucgucuuacgucuguuccggauuagugggcgacacgccucgcaagaacgauucaaguagcuccucucauugccuggacccaaauaacgaagagggugggcacggaguuaaaggcugggcuuucgaugacggcaaugauguguggauggggcgaaccauuaacgaaacaagcagacuuggauaugagacuuuuaaggucaucgaggguuggucaaaucccaaaaguaaguugcagauuaacaggcaagugauaguagaccggggcaaucguuccggguacagcggaaucuucucuguugaaggcaaaucauguauuaaccgcugcuuuuauguggagcugaucagagguaggaaggaagagaccgaaguccuauggacaaguaauagcaucguggucuucugugggacuuccggcaccuacggaacaggcucuuggccugauggggccgaccucaaccugaugccaauuuga

SEQ ID NO: 143157 - RNA, 1410 nt, Artificial Sequence
  derived and/or modified sequence opt3 from neuraminidase__InfluenzaA__AEQ49806
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucauucaguagcucccauugccuugacccuaacaaugaggaaggugggcacggaguuaaaggcugggcuuuugaugacggcaacgauguguggauggggcgaaccauuaaugagacaucuagauugggauaugagacuuucaaggucaucgaagguuggagcaacccaaaaucaaagcugcagauuaauaggcaagugauaguagaccggggcaaccguaguggguacuccggaaucuuuagcguugagggcaaaucuuguauuaaucgcugcuucuauguggaacuaaucagagguaggaaggaggaaaccgagguccucuggacaucaaacaguaucguggucuucugugggacuagcggcaccuacggaacaggcuccuggcccgauggggccgaccugaaucuuaugccuauuuga

SEQ ID NO: 143158 - RNA, 1410 nt, Artificial Sequence; identical to SEQ ID NO: 141534
  derived and/or modified sequence opt3 from neuraminidase__InfluenzaA__AEQ49807

SEQ ID NO: 143159 - RNA, 1410 nt, Artificial Sequence
  derived and/or modified sequence opt3 from neuraminidase__InfluenzaA__AEQ49809
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaaacugguggauuccguaguuucauggaguaaggagauucugaggacgcaggaaagcgagugugugugcauaaacggcacuuguacagucgugaugaccgacggcucugcuuccgggaaagcagauacuaagauccucuuuauugaggaaggaaagaucgugcauacaucaaccuuaagcgguagugcccaacacgucgaggaaugcucuugcuauccucgguacccaggcguucgcugugugugcagagacaacuggaaaggguccaauaggccgauaguagauauuaacaucaaggaccacagcaucgugucgucuuacgucuguuccggacuggugggcgacacgccccggaaaaaugauucaaguagcuccucucauugccuugacccuaacaaugaggaaggugggcacggaguuaagggcugggcuuucgaugacggcaacgauguguggauggggcgcaccauuaaugagacaagccgauugggauaugagacuuuuaaagucaucgaagguuggucaaacccaaagaguaaacugcagauuaauagacaggugauaguagacaggggcaaccgguccggguacagcggaaucuucucuguugagggcaagucauguauuaaucguugcuuuuauguggaacuaauccgcgguagaaaggaggaaaccgagguccucuggacaaguaacagcaucguggucuucugugggacuuccggcaccuacggaacaggcucuuggcccgauggggccgaccugaaucuuaugccuauuuga

SEQ ID NO: 143160 - RNA, 1410 nt, Artificial Sequence; identical to SEQ ID NO: 143159
  derived and/or modified sequence opt3 from neuraminidase__InfluenzaA__AEQ49811

SEQ ID NO: 143161 - RNA, 1410 nt, Artificial Sequence; identical to SEQ ID NO: 141534
  derived and/or modified sequence opt3 from neuraminidase__InfluenzaA__AEQ49812

SEQ ID NO: 143162 - RNA, 1410 nt, Artificial Sequence; identical to SEQ ID NO: 141534
  derived and/or modified sequence opt3 from neuraminidase__InfluenzaA__AEQ49813

SEQ ID NO: 143163 - RNA, 1410 nt, Artificial Sequence; identical to SEQ ID NO: 141534
  derived and/or modified sequence opt3 from neuraminidase__InfluenzaA__AEQ49815

SEQ ID NO: 143164 - RNA, 1410 nt, Artificial Sequence
  derived and/or modified sequence opt3 from neuraminidase__InfluenzaA__AEQ49816
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaacggcacuuguacagucgugaugaccgauggcucugcuuccgggaaggcagacacuaaaauccucuuuguggaggaaggaaagauuguccauacaucaaccuuaagcgguagugcccaacacguugaggaaugcucuugcuauccucgcuacccaggcgugagauguguaugcagggauaauuggaagggguccaaccggccgaucguggacauaaauaugaaagaucacagcauugucucgucuuacguguguuccggacugguuggcgacacgccccgcaagaacgacucaaguagcuccucucauugcuucgauccuaaugacgaggaaggugggcacggagugaaaggcugggcuuuugaugacggcaacgaugucuggauggggcgaaccaucagcgagaagucaagacuuggauaugagacauucaaagugaucgaagguuggaguaauccaaaguccaaauugcagauuaacaggcagguaaucguugaccggggcaaucguagcggguacucuggaauauuuucaguggagggcaagaguuguauuaaccgcugcuucuaugucgaacugaucagagguaggaaggaggaaacugaggugcuauggaccagcaauuccauugucguguucugugggacaucuggcacuuacggaaccggcucguggcccgauggggccgacaucaaccucaugccuaucuga

SEQ ID NO: 143165 - RNA, 1410 nt, Artificial Sequence; identical to SEQ ID NO: 142899
  derived and/or modified sequence opt3 from neuraminidase__InfluenzaA__AEQ49820

SEQ ID NO: 143166 - RNA, 1410 nt, Artificial Sequence; identical to SEQ ID NO: 142899
  derived and/or modified sequence opt3 from neuraminidase__InfluenzaA__AEQ49821

SEQ ID NO: 143167 - RNA, 1410 nt, Artificial Sequence; identical to SEQ ID NO: 143137
  derived and/or modified sequence opt3 from neuraminidase__InfluenzaA__AEQ49822

SEQ ID NO: 143168 - RNA, 1410 nt, Artificial Sequence; identical to SEQ ID NO: 143137
  derived and/or modified sequence opt3 from neuraminidase__InfluenzaA__AEQ49823

SEQ ID NO: 143169 - RNA, 1410 nt, Artificial Sequence; identical to SEQ ID NO: 143137
  derived and/or modified sequence opt3 from neuraminidase__InfluenzaA__AEQ49824

SEQ ID NO: 143170 - RNA, 1410 nt, Artificial Sequence; identical to SEQ ID NO: 143137
  derived and/or modified sequence opt3 from neuraminidase__InfluenzaA__AEQ49825

SEQ ID NO: 143171 - RNA, 1410 nt, Artificial Sequence; identical to SEQ ID NO: 143137
  derived and/or modified sequence opt3 from neuraminidase__InfluenzaA__AEQ49826

SEQ ID NO: 143172 - RNA, 1410 nt, Artificial Sequence; identical to SEQ ID NO: 143137
  derived and/or modified sequence opt3 from neuraminidase__InfluenzaA__AEQ49827

SEQ ID NO: 143173 - RNA, 1410 nt, Artificial Sequence; identical to SEQ ID NO: 143137
  derived and/or modified sequence opt3 from neuraminidase__InfluenzaA__AEQ49828

SEQ ID NO: 143174 - RNA, 1410 nt, Artificial Sequence
  derived and/or modified sequence opt3 from neuraminidase__InfluenzaA__AEQ49829
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaacggcacuuguacagucgugaugaccgauggcucugcucucgggaaggcagacacuaaaaucuuauuuauugaggaaggaaagaucgugcauacauccacccugucagguagcgcccaacacgucgaggaaugcaguugcuauccucgcuacccaggcguuagaugugugugcagggauaauuggaaggggucuaaccggccgauaguagacauuaauaugaaagaucacuccaucgugagcucguacgucuguucuggacuugugggcgacacgccccgcaagaacgacuccucaaguagcucccauugcuucgauccuaaugacgaggaaggugggcacggaguuaaaggcugggcuuuugaugacggcaacgauguguggauggggcgaaccaucucugaaaagagcagauugggauaugagacauucaaagucauugaggguuggucaaauccaaagaguaaacugcagaucaacaggcaagugauuguagaccggggcgaucguuccggguacagcggaauauuuucuguugagggcaagucauguaucaaucgcugcuucuauguggaacuaauuagagguaguaaggaggaaacugagguccucuggaccagcaacuccaucguggucuucugugggacaucuggcacuuacggaaccggcucguggcccgacggggccgauaucaaucugaugccuauuuga

SEQ ID NO: 143175 - RNA, 1410 nt, Artificial Sequence; identical to SEQ ID NO: 143137
  derived and/or modified sequence opt3 from neuraminidase__InfluenzaA__AEQ49830

SEQ ID NO: 143176 - RNA, 1410 nt, Artificial Sequence; identical to SEQ ID NO: 143137
  derived and/or modified sequence opt3 from neuraminidase__InfluenzaA__AEQ49831

SEQ ID NO: 143177 - RNA, 1410 nt, Artificial Sequence
  derived and/or modified sequence opt3 from neuraminidase__InfluenzaA__AEQ49832
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaacggcacuuguacagucgugaugaccgauggcucugcuuccgggaaggcagacacuaaaauccucuuuauugaggaaggaaagaucgugcauacaucaaccuuaagcgguagugcccaacacgucgaggaaugcucuugcuauccucgcuacccaggcguuagaugugugugcagggauaauuggaagggguccaaccggccgauaguagacauuaauaugaaagaucacagcaucgugucgucuuacgucuguuccggacuggugggcgacacgccccgcaagaacgacucaaguagcuccucucauugcuucgauccuaaugacgaggaaggugggcacggaguuaaaggcugggcuuuugaugacggcaacgauguguggauggggcgaaccaucagcgagaagucaagacuuggauaugagacauucaaagucguggaagguuggaguaauccaaaguccaaauugcagauuaacaggcagguaaucguugaccggggcgaucguagcggguacucuggaauauuuucaguggagggcaagaguuguauuaaucgcugcuucuaugucgaacugaucagagguagcaaggaggaaacugaggugcuauggaccuccaacucuauugucguguucugugggacaucgggcacuuacggaaccggcagcuggcccgacggggccgauaucaaucucaugccuaucuga

SEQ ID NO: 143178 - RNA, 1410 nt, Artificial Sequence
  derived and/or modified sequence opt3 from neuraminidase__InfluenzaA__AEQ49833
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaaacugguggauuccguaguuucauggaguaaggagauucugaggacgcaggaaagcgagugugugugcauaaacggcacuuguacagucgugaugaccgacggcucugcuuccgggaaagcagauacuaagauccucuuuauugaggaaggaaagaucgugcauacaucaaccuuaagcgguagugcccaacacgucgaggaaugcucuugcuauccucgguacccaggcguucgcugugugugcagagacaacuggaaaggguccaauaggccgauaguagauauuaacaucaaggaccacagcaucgugucgucuuacgucuguuccggacuggugggcgacacgccccggaaaaaugauucaaguagcuccucucauugccuugacccuaacaaugaggaaggugggcacggaguuaagggcugggcuuucgaugacggcaacgauguguggauggggcgcaccauuaaugagacaagccgauugggauaugagacuuuuaaagucaucgaagguuggucaaacccaaagaguaaacugcagauuuccagacaggugauaguagacaggggcaaucggagcggguacucuggaaucuucucaguugagggcaagaguuguauuaaccguugcuuuuauguggaacuaauccgcgguagaaaggaggaaaccgagguccucuggacaagcaauuccaucguggucuucugugggacuucuggcaccuacggaacaggcucguggcccgauggggccgaccugaaccuuaugccuauuuga

SEQ ID NO: 143179 - RNA, 1410 nt, Artificial Sequence
  derived and/or modified sequence opt3 from neuraminidase__InfluenzaA__AEQ49835
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauggcuuggagcaguuccucuugucaugaugguaaggccuggcuccacgucugcauuacaggggacgauaagaaugcaaccgccagcuucaucuacaacggaaggcugguggacuccguaguuucauggaguaaagagauccugcggacgcaggaaagcgagugugugugcauuaacggcacuuguacagucgugaugaccgauggcucugcuuccgggaaggcagacacuaaaauacucuuuaucgaggaaggaaagauugugcauacaucaaccuuaagcgguagugcccaacacgucgaggaaugcucuugcuauccucgcuacccaggcguuagaugugugugcagggauaauuggaagggguccaaccggccgaucguagacauaaauaugaaagaucacagcauugugucgucuuacgucuguuccggacuggugggcgacacgccccgcaagaacgacucaaguagcuccucucauugcuucgauccuaaugacgaggaaggugggcacggaguuaaaggcugggcuuuugaugacggcaacgauguguggauggggcgaaccaucagcgagaagucaagacuuggauaugagacauucaaagucaucgaagguuggaguaauccaaaguccaaauugcagauuaacaggcaagugaucguagaccggggcaaucguagcggguacucuggaauauuuucaguugagggcaagaguuguauuaaccgcugcuucuauguggaacugaucagagguaggaaggaggaaacugagguccuauggaccagcaauuccauuguggucuucugugggacaucuggcacuuacggaaccggcucguggcccgauggggccgacaucaaccucaugccuaucuga

SEQ ID NO: 143180 - RNA, 1410 nt, Artificial Sequence; identical to SEQ ID NO: 143179
  derived and/or modified sequence opt3 from neuraminidase__InfluenzaA__AEQ49836

SEQ ID NO: 143181 - RNA, 1410 nt, Artificial Sequence; identical to SEQ ID NO: 143179
  derived and/or modified sequence opt3 from neuraminidase__InfluenzaA__AEQ49838

SEQ ID NO: 143182 - RNA, 1410 nt, Artificial Sequence; identical to SEQ ID NO: 143179
  derived and/or modified sequence opt3 from neuraminidase__InfluenzaA__AEQ49839

SEQ ID NO: 143183 - RNA, 1410 nt, Artificial Sequence
  derived and/or modified sequence opt3 from neuraminidase__InfluenzaA__AEQ49840
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauggcuuggagcaguuccucuugucaugaugguaaggccuggcuccacgucugcauuacaggggacgauaagaaugcaaccgccagcuucaucuacaacggaaggcugguggacuccguaguuucauggaguaaagagauccugcggacgcaggaaagcgagugugugugcauuaacggcacuuguacagucgugaugaccgauggcucugcuuccgggaaggcagacacuaaaauacucuuuaucgaggaaggaaagauugugcauacaucaaccuuaagcgguagugcccaacacgucgaggaaugcucuugcuauccucgcuacccaggcguuagaugugugugcagggauaauuggaagggguccaaccggccgaucguagacauaaauaugaaagaucacagcauugugucgucuuacgucuguuccggacuggugggcgacacgccccgcaagaacgacucaaguagcuccucucauugcuucgauccuaaugacgaggaaggugggcacggaguuaaaggcugggcuuuugaugacggcaacgauguguggauggggcgaaccaucagcgagaagucaagacuuggauaugagacauucaaagucaucgaagguuggaguaaucauaaguccaaauugcagauuaacaggcaagugaucguagaccggggcaaucguagcggguacucuggaauauuuucaguugagggcaagaguuguauuaaccgcugcuucuauguggaacugaucagagguaggaaggaggaaacugagguccuauggaccagcaauuccauuguggucuucugugggacaucuggcacuuacggaaccggcucguggccagauggggccgacaucaaccucaugcccaucuga

SEQ ID NO: 143184 - RNA, 1410 nt, Artificial Sequence; identical to SEQ ID NO: 143179
  derived and/or modified sequence opt3 from neuraminidase__InfluenzaA__AEQ49841

SEQ ID NO: 143185 - RNA, 1410 nt, Artificial Sequence; identical to SEQ ID NO: 143179
  derived and/or modified sequence opt3 from neuraminidase__InfluenzaA__AEQ49842

SEQ ID NO: 143186 - RNA, 1410 nt, Artificial Sequence; identical to SEQ ID NO: 143179
  derived and/or modified sequence opt3 from neuraminidase__InfluenzaA__AEQ49843

SEQ ID NO: 143187 - RNA, 1410 nt, Artificial Sequence; identical to SEQ ID NO: 143137
  derived and/or modified sequence opt3 from neuraminidase__InfluenzaA__AEQ49844

SEQ ID NO: 143188 - RNA, 1410 nt, Artificial Sequence
  derived and/or modified sequence opt3 from neuraminidase__InfluenzaA__AEQ49845
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagagggaaaucugccccaaguuagcugaguaccggaauuggaguaaaccucagugugacauaacaggguucgcaccauuuagcaaggauaacuccauucgccugucugccggaggugacaucuggguaacccgagagcccuaugugucgugcgauccuaauaaauguuaccaauucgcgcuaggccaggggacgacucucaacaauguccauucaaacaauaccgugcgugacagaacaccauauaggacucugcuuaugaacgaacugggaguucccuuucacuugggcaccaaacaggugugcauggcuuggagcaguuccucuugucaugaugguaaggccuggcuccacgucugcauuacaggggacgauaagaaugcaaccgccagcuucaucuacaacggacggcugguggacuccguaguuucauggaguaaggagauccugcgcacgcaggaaagcgagugugugugcauuaacggcacuuguacagucgugaugaccgauggcucugcuuccgggaaagcagacacuaagauacucuuuaucgaggaaggaaaaauugugcauacaucaaccuuaagcgguagugcccaacacgucgaggaaugcucuugcuauccuagauacccaggcguuaggugugugugccgggauaauuggaagggguccaaccgcccgaucguagacauaaauaugaaggaucacagcauugugucgucuuacgucuguuccggacuggugggcgacacgccccggaaaaacgacucaaguagcuccucucauugcuucgauccuaaugacgaggaaggugggcacggaguuaagggcugggcuuuugaugacggcaacgauguguggauggggagaaccaucagcgagaaaucaaggcuuggauaugagacauucaaggucaucgaagguuggaguaauccaaaauccaaguugcagauuaaccgacaggugaucguagaccguggcaaucgcagcggguacucuggaauauuuucaguugagggcaaaaguuguauuaacagaugcuucuauguggaacugaucaggggucggaaggaggaaacugagguccuauggaccagcaauuccauuguggucuucugugggacaucuggcacuuacggaaccggcucguggcccgauggggccgacaucaaccucaugccuaucuga

SEQ ID NO: 143189 - RNA, 1410 nt, Artificial Sequence
  derived and/or modified sequence opt3 from neuraminidase__InfluenzaA__AEQ49846
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauggcuuggagcaguuccucuugucaugaugguaaggccuggcuccacgucugcauuacaggggacgauaagaaugcaaccgccagcuucaucuacaacggaaggcugguggacuccguaguuucauggaguaaagagauccugcggacgcaggaaagcgagugugugugcauuaacggcacuuguacagucgugaugaccgauggcucugcuuccgggaaggcagacacuaaaauacucuuuaucgaggaaggaaagauugugcauacaucaaccuuaagcgguagugcccaacacgucgaggaaugcucuugcuauccucgcuacccaggcguuagaugugugugcagggauaauuggaagggguccaaccggccgaucguagacauaaaucugaaagaucacagcauugugucgucuuacgucuguuccggacuugugggcgacacgccccgcaagaacgacucaaguagcuccucucauugcuucgauccuaaugacgaggaaggugggcacggaguuaaaggcugggcuuuugaugacggcaacgauguguggauggggcgaaccaucagcgagaagucaagauugggauaugagacauucaaagucaucgaagguuggaguaauccaaaguccaaacugcagauuaacaggcaagugaucguagaccggggcaaucguagcggguacucuggaauauuuucaguugagggcaagaguuguauuaaccgcugcuucuauguggaacuaaucagagguaggaaggaggaaacugagguccucuggaccagcaauuccauuguggucuucugugggacaucuggcacuuacggaaccggcucguggcccgauggggccgacaucaaccugaugccuaucuga

SEQ ID NO: 143190 - RNA, 1410 nt, Artificial Sequence
  derived and/or modified sequence opt3 from neuraminidase__InfluenzaA__AEQ49850
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaacggcacuuguacagucgugaugaccgauggcucugcuuccgggaaggcagacacuaaaauccucuuuauugaggaaggaaagaucgugcauacaucaaccuuaagcgguagugcccaacacgucgaggaaugcucuugcuauccucgcuacccaggcguuagaugugugugcagggauaauuggaagggguccaaccggccgauaguagacauuaauaugaaagaucacagcaucgugucgucuuacgucuguuccggacuggugggcgacacgccccgcaagaacgacucaaguagcuccucucauugcuucgauccuaaugacgaggaaggugggcacggaguuaaaggcugggcuuuugaugacggcaacgauguguggauggggcgaaccaucagcgagaagucaagacuuggauaugagacauucaaagucauugaagguuggaguaauccaaaguccaaauugcagaucaacaggcaagugauuguagaccggggcgaucguagcggguacucuggaauauuuucaguugagggcaagaguuguaucaaucgcugcuucuauguggaacugauuagagguagcaaggaggaaacugagguccuauggaccuccaacucuaucguggucuucugugggacaucgggcacuuacggaaccggcagcuggcccgacggggccgauaucaaaauuaugccuauauga

SEQ ID NO: 143191 - RNA, 1410 nt, Artificial Sequence
  derived and/or modified sequence opt3 from neuraminidase__InfluenzaA__AEQ49851
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaauggagagaaauaucaccgaaauuguguauuugacaaacaccacuaucgagaaggaaauuugccccaaauuagcugaguacaggaauuggaguaagccucagugugacaucacaggguucgcaccauuuagcaaagauaacuccauacggcugucugccggaggugacauuuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcaucgcuuggagcaguuccucuugucaugacgguaaggccuggcuccacgucugcauuacaggggaugacaagaacgcaaccgccagcuucaucuacaauggaaaacugguggauuccguaguuucauggaguaaggagauccugaggacgcaggaaagcgagugugugugcauuaacggcacuuguacagucgugaugaccgacggcucugcuuccgggaaagcagauacuaagauacucuuuaucgaggaaggaaagauugugcauacaucaaccuuaagcgguagugcccaacacgucgaggaaugcucuugcuauccucgguacccaggcguucgcugugugugcagagacaacuggaaaggguccaauaggccgaucguagauauaaacauuaaggaccacagcaucgugucgucuuacgucuguuccggacuggugggcgacacgccccggaaaaaugauucaaguagcuccucucauugccuugacccuaacaaugaggaaggugggcacggaguuaagggcugggcuuucgaugacggcaacgauguguggauggggcgcaccaucaaugagacaagccgauugggauaugagacuuuuaaagucauugaagguuggucaaacccaaagaguaaacugcagaucaauagacaggugauuguagacaggggcaaccgguccggguacagcggaauauucucuguugagggcaagucauguaucaaucguugcuuuuauguggaacuaauucgcgguagaaaggaggaaaccgagguccucuggacaaguaacagcaucguggucuucugugggacuuccggcaccuacggaacaggcucuuggcccgauggggccgaccugaaucuuaugccuaucuga

SEQ ID NO: 143192 - RNA, 1410 nt, Artificial Sequence; identical to SEQ ID NO: 143159
  derived and/or modified sequence opt3 from neuraminidase__InfluenzaA__AEQ49852

SEQ ID NO: 143193 - RNA, 1410 nt, Artificial Sequence; identical to SEQ ID NO: 143137
  derived and/or modified sequence opt3 from neuraminidase__InfluenzaA__AEQ49969

SEQ ID NO: 143194 - RNA, 1410 nt, Artificial Sequence; identical to SEQ ID NO: 143159
  derived and/or modified sequence opt3 from neuraminidase__InfluenzaA__AEQ49970

SEQ ID NO: 143195 - RNA, 1410 nt, Artificial Sequence
  derived and/or modified sequence opt3 from neuraminidase__InfluenzaA__AEQ54954
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaaacugguggauuccguaguuucauggaguaaggagauucugaggacgcaggaaagcgagugugugugcauaaacggcacuuguacagucgugaugaccgacggcucugcuuccgggaaagcagauacuaagauccucuuuauugaggaaggaaagaucgugcauacaucaaccuuaagcgguagugcccaacacgucgaggaaugcucuugcuauccucgguacccaggcguucgcugugugugcagagacaacuggaaaggguccaauaggccgauaguagauauuaacaucaaggaccacagcaucgugucgucuuacgucuguuccggacuggugggcgacacgccccggaaaaaugauucaaguagcuccucucauugccuugacccuaacaaugaggaaggugggcacggaguuaagggcugggcuuucgaugacggcaacgauguguggauggggcgcaccauuagcgagacaucacgauugggauaugagacuuuuaaagucaucgaagguuggaguaauccaaaguccaaacugcagauuaacagacaggugauaguagacaggggcaaucggagcggguacucuggaaucuucucaguugagggcaagaguuguauuaaccguugcuuuuauguggaacuaauccgcgguagaaaggaggaaaccgagguccucuggacaagcaauuccaucguggucuucugugggacuucuggcaccuacggaacaggcucguggcccgauggggccgaccugaaccuuaugccuauuuga

SEQ ID NO: 143196 - RNA, 1410 nt, Artificial Sequence; identical to SEQ ID NO: 138615
  derived and/or modified sequence opt3 from neuraminidase__InfluenzaA__AER08645

SEQ ID NO: 143197 - RNA, 1410 nt, Artificial Sequence
  derived and/or modified sequence opt3 from neuraminidase__InfluenzaA__AER08649
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaaguuagugcauacaucaacccugagcgguagugcccaacacgucgaggaaugcucuugcuauccucgcuacccaggcguuagaugugugugcagggacaacuggaagggguccaaucggccgaucguagauauaaacauuaaagaccacagcaucgugucgucuuacgucuguuccggacuugugggcgacacgccccgcaagaaugauucaaguagcuccucucauugcuuggacccuaacaaugaggaaggugggcacggaguuaaaggcugggcuuucgaugacggcaacgauguguggauggggcgaaccaucagcgagaagucaagacugggauaugagacauuuaaagucauugaagguuggaguaauccaaaguccaaacuacagaucaacaggcaagugauuguagaccggggcaaucguagcggguacucuggaauauucucaguugagggcaagaguuguaucaaccgcugcuuuuauguggaacucauuagagguaggaaggaggaaacugagguccuguggaccagcaauuccaucguggucuucugugggacaucuggcacuuacggaaccggcucguggcccgauggggccgacaucaaccuuaugccuauuuga

SEQ ID NO: 143198 - RNA, 1410 nt, Artificial Sequence
  derived and/or modified sequence opt3 from neuraminidase__InfluenzaA__AER08657
augaaccccaaucagaagaucauuaccauaggcagcgugucccugacaaucucuacugucugcuucuuuaugcaaauugccauccucauuacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaaugugccccaaauuagcugaguacaggaauuggaguaagccucagugugacauuacaggguucgcaccauuuagcaaagauaacuccauccggcugucugccggaggugacauaugggugacccgcgagcccuaugucucgugcgauccugacaaguguuaccaauucgcgcuaggccaggggacgacucucaauaacgugcauucaaauaacaccguucgagaucguacaccauauagaacucugcuuaugaaugaacugggagugcccuuucacuugggcaccaagcaggucugcauugcuuggagcaguuccucuugucaugacgguaaagccuggcuccacgugugcaucacaggggaugacaagaacgcaaccgccagcuucauuuacaauggaaggcugguagauuccguugugucauggaguaaagagauccugcggacgcaggaaagcgagugugucugcaucaacggcacuuguacaguggugaugaccgacggcucugcuuccgggaaggcagauacuaaaauucucuuuauagaggaaggaaagaucguccauacaucaaccuuaagcgguagugcccaacacguugaggaaugcucuugcuauccucgcuacccaggcgugagauguguaugcagggacaacuggaagggguccaaucggccgauuguggauaucaacauaaaagaccacagcauugucucgucuuacguguguuccggacugguuggcgacacgccccgcaagaaugauucaaguagcuccucucauugccuugacccuaacaaugaggaaggugggcacggagugaaaggcugggcuuucgaugacggcaacgaugucuggauggggcgaaccaucagcgagaagucaagauugggauaugagacauuuaaagugaucgaagguuggaguaauccaaaguccaaacugcagauuaacaggcagguaaucguugaccggggcaaucguagcggguacucuggaauuuucucaguggagggcaagaguuguauaaaccgcugcuuuuaugucgaacuaaucagagguaggaaggaggaaacugaggugcucuggaccagcaauuccauugucguguucugugggacaucuggcacuuacggaaccggcucguggcccgauggggccgacaucaaccugaugccuaucuga

SEQ ID NO: 143199 - RNA, 1410 nt, Artificial Sequence; identical to SEQ ID NO: 138615
  derived and/or modified sequence opt3 from neuraminidase__InfluenzaA__AER08659

SEQ ID NO: 143200 - RNA, 1410 nt, Artificial Sequence
  derived and/or modified sequence opt3 from neuraminidase__InfluenzaA__AER08661
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugaucacgggguuaaaggaugggcuuucgacgauggcaacgacguguggaugggccgaaccauuaaugagacaagcagauugggguaugagacuuuuaaggucaucgaaggauggucaaacccaaaaaguaagcugcagauuaauaggcaagugauaguagaucgggguaaccguuccggcuacagcgggaucuucucuguugagggaaaaucauguauuaaucgcugcuuuuauguggaacuaaucagaggcaggaaggaggaaaccgagguccucuggacaaguaacagcaucguggucuucugugguacuuccgggaccuacggcacaggaucuuggcccgacggcgccgaucugaaucuuaugccuauuuga

SEQ ID NO: 143201 - RNA, 1410 nt, Artificial Sequence; identical to SEQ ID NO: 141534
  derived and/or modified sequence opt3 from neuraminidase__InfluenzaA__AER08663

SEQ ID NO: 143202 - RNA, 1410 nt, Artificial Sequence; identical to SEQ ID NO: 141534
  derived and/or modified sequence opt3 from neuraminidase__InfluenzaA__AER08665

SEQ ID NO: 143203 - RNA, 1410 nt, Artificial Sequence
  derived and/or modified sequence opt3 from neuraminidase__InfluenzaA__AER08669
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccacauuagcugaguacaggaauuggaguaaaccucagugugacauaaccggguucgcaccauuuagcaaggauaacuccauucggcugucugccggaggugacaucuggguaacgcgcgagcccuaugugucgugcgauccugacaaauguuaccaauucgcgcuaggccaggggacuacccucaauaacguccauucaaauaacacagugcgagaucguacuccauauagaacccugcuuaugaaugaacugggaguucccuuucacuugggcacaaaacaggugugcauugcuuggagcaguuccucuugucaugacgguaaggccuggcuccacgucugcaucaccggggaugacaagaacgcaacggccagcuucaucuacaauggaaggcugguggauuccguaguuucauggaguaaggagauucugcggacucaggaaagcgagugugugugcauaaacggcacauguaccgucgugaugacugacggcucugcuuccgggaaagcagauacaaagauccucuuuauugaggaaggaaaaaucgugcauaccucaacguuaagcgguagugcccaacacgucgaggaaugcucuugcuauccucgcuacccaggcguuagaugugugugcagggacaacuggaagggguccaaucggccgauaguagauauuaacaucaaggaccacagcaucgugucgucuuacgucuguuccggacuggugggcgacacccccaggaaaaaugauucaaguagcuccucucauugccuugacccuaacaaugaggaaggugggcacggaguuaagggcugggcuuucgaugacggcaacgauguguggauggggcgaacaauuagcgagacuucaagauugggauaugagaccuuuaaagucaucgaagguuggaguaauccaaaguccaaacugcagauuaaccgccaggugauaguagaccggggcaaucguagcggguacucuggaaucuucucaguugagggcaagaguuguauuaaccgcugcuuuuauguggaacuaaucagagguaggaaagaggaaacagagguccucuggacuagcaauuccaucguggucuucugugggaccucuggcacauacggaaccggcucguggcccgauggggccgaccugaaccuuaugccuauuuga

SEQ ID NO: 143204 - RNA, 1410 nt, Artificial Sequence
  derived and/or modified sequence opt3 from neuraminidase__InfluenzaA__AER08671
augaaccccaaucagaagaucauuaccauaggcagcgugucccugacaaucucuacuauuugcuucuuuaugcaaaucgccauucucaucacgaccgucacacuucacuucaaacaguacggguuuaacucaccuccaaauaaccagguuaugcugugugagccgacuauaaucgaaagaaauauuaccgagaucguguauuugacaaacaccacuauugaaaaggagaucugccccacauuagcugaauacaggaauuggaguaaaccucagugugacauaaccggauucgcaccauuuagcaaggauaacuccauucggcugucugccgguggcgacaucuggguaacgcgcgagcccuaugugucgugcgauccugacaaauguuaccaauucgcgcuagggcagggaacuacccucaauaacguccauucaaauaacacagugcgagaucguacuccauauagaacccugcuuaugaaugagcugggcguucccuuucacuuggguacaaaacaggugugcauugcuuggagcaguuccucuugucaugacgggaaggccuggcuccacgucugcaucaccggagaugacaagaacgcaacggccagcuucaucuacaauggcaggcugguggauuccguaguuucauggaguaaggaaauucugcggacucaggagagcgaaugugugugcauaaacggcacauguaccgucgugaugacugacgggucugcuuccggaaaagcagauacaaagauccucuuuauugaggaggguaaaaucgugcauaccucaacguuaagcggcagugcccaacacgucgaagagugcucuugcuauccucgcuacccagggguuagaugugugugcagggacaacuggaagggauccaaucggccgauaguagauauuaacaucaaggaccacagcaucgugucgucuuacgucuguuccggccuggugggugacacccccaggaaaaaugauucaaguagcuccucucauugccuugacccuaacaaugaagaagggggacacggcguuaagggcugggcuuucgaugacgggaacgauguguggaugggacgaacaauuaaugagacuagcagauuggguuaugagaccuuuaaagucaucgagggcuggucaaacccaaagaguaaacugcagauuaaucgccaggugauaguagaccgggggaaccguuccggauacagcggcaucuucucuguugaagguaagucauguauuaaucgcugcuuuuauguggagcuaaucagagggaggaaagaagagacagaaguccucuggaccaguaacagcaucguggucuucuguggcacuuccggaacauacggcaccgggucuuggcccgauggagccgaccugaaucuuaugccuauuuga

SEQ ID NO: 143205 - RNA, 1410 nt, Artificial Sequence; identical to SEQ ID NO: 141534
  derived and/or modified sequence opt3 from neuraminidase__InfluenzaA__AER08673

SEQ ID NO: 143206 - RNA, 1410 nt, Artificial Sequence; identical to SEQ ID NO: 141534
  derived and/or modified sequence opt3 from neuraminidase__InfluenzaA__AER08675

SEQ ID NO: 143207 - RNA, 1410 nt, Artificial Sequence; identical to SEQ ID NO: 141534
  derived and/or modified sequence opt3 from neuraminidase__InfluenzaA__AER08677

SEQ ID NO: 143208 - RNA, 1410 nt, Artificial Sequence; identical to SEQ ID NO: 141534
  derived and/or modified sequence opt3 from neuraminidase__InfluenzaA__AER08679

SEQ ID NO: 143209 - RNA, 1410 nt, Artificial Sequence
  derived and/or modified sequence opt3 from neuraminidase__InfluenzaA__AER08681
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacgaugaggaaggugggcacggaguuaaaggcugggcuuucgacgauggcaaugacguguggauggggcgaaccauuaacgagacaagcagauugggauaugagacuuuuaaggucaucgaagguuggucaaauccaaaaaguaagcugcagauuaacaggcaagugauaguagauaaaggcaaucgguccggguacagcggaaucuucucuguugagggcaagucauguauuaaccguugcuuuuauguggaacuaauccgcgguagaaaggaggaaaccgagguccucuggacaaguaauagcaucguggucuucugugggacuuccggcaccuacggaacaggcucuuggcccgacggggccgaucugaaccuuaugccuauuuga

SEQ ID NO: 143210 - RNA, 1410 nt, Artificial Sequence; identical to SEQ ID NO: 141534
  derived and/or modified sequence opt3 from neuraminidase__InfluenzaA__AER08683

SEQ ID NO: 143211 - RNA, 1410 nt, Artificial Sequence; identical to SEQ ID NO: 143159
  derived and/or modified sequence opt3 from neuraminidase__InfluenzaA__AER08685

SEQ ID NO: 143212 - RNA, 1410 nt, Artificial Sequence; identical to SEQ ID NO: 143159
  derived and/or modified sequence opt3 from neuraminidase__InfluenzaA__AER08687

SEQ ID NO: 143213 - RNA, 1410 nt, Artificial Sequence
  derived and/or modified sequence opt3 from neuraminidase__InfluenzaA__AER08689
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuacucugugugaaccgaccauaaucgagagaaauauuacagaaaucguguauuugaccaacacuacaauugagaaggaaaucugccccaaauuagcugaguacaggaauuggaguaagccucagugugacauaaccggguucgcaccauuuagcaaagauaacuccauucggcugucugccggaggugacaucuggguaacgcgcgagcccuaugugucgugcgauccugacaaguguuaccaauucgcgcuaggccaggggacuacccucaauaacguccauucaaauaacacagugcgagaucguacuccauauagaacccugcuuaugaaugaacugggaguucccuuucacuugggcacaaaacaggugugcauugcuuggagcaguuccucuugucaugacgguaaggccuggcuccacgucugcaucaccggggaugacaagaacgcaacggccagcuucaucuacaauggaaggcugguggauuccguaguuucauggaguaaagagauucugcggacucaggaaagcgagugugugugcauaaacggcacauguaccgucgugaugacugacggcucugcuuccgggaaggcagauacaaaaauccucuuuauugaggaaggaaagaucgugcauaccucaacguuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacccccaggaaggaugacucaaguagcuccucucauugccuugauccuaauaacgaggaaggugggcacggaguuaaaggcugggcuuucgacgauggcaaugacguguggauggggcgaacaauuaacgagacuagcagauugggauaugagaccuuuaaggucaucgaagguuggucaaauccaaaaaguaagcugcagauuaaccgccaggugauaguagaucggggcaaucguuccggguacagcggaaucuucucuguugagggcaaaucauguauuaaccgcugcuuuuauguggaacuaaucagagguaggaaggaggaaacagagguccucuggaccaguaauagcaucguggucuucugugggacuuccggcacauacggaaccggcucuuggcccgacggggccgaucugaaccuuaugccuauuuga

SEQ ID NO: 143214 - RNA, 1410 nt, Artificial Sequence; identical to SEQ ID NO: 143159
  derived and/or modified sequence opt3 from neuraminidase__InfluenzaA__AER08691

SEQ ID NO: 143215 - RNA, 1410 nt, Artificial Sequence
  derived and/or modified sequence opt3 from neuraminidase__InfluenzaA__AER08693
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaagaaucagguuaugcugugugaaccgacuauaaucgagagaaacauuaccgaaaucguguauuugacaaauaccacuauugagaaagaaaucugccccaaguuagcugaguacaggaacuggaguaaaccucagugugacauaacaggguucgcaccauuuagcaaggauaauuccauucggcugucugccggaggugacaucuggguaacccgcgagcccuaugugucgugcgauccugacaaguguuaccaauucgcgcuaggccaggggacgacucucaacaauguccauucaaacaauaccgugcgagaucguacaccauauagaacucugcuuaugaacgaacugggaguucccuuucacuugggcaccaaacaggugugcauugcuuggagcaguuccucuugucaugacgguaaggccuggcuccacgucugcaucacaggggaugacaaaaaugcaaccgccagcuucaucuacaacggaaagcugguggauuccguaguuucauggaguaaagagauucugaggacgcaggaaagcgagugugugugcauaaauggcacuuguacagucgugaugaccgacggcucugcuuccgggaaggcagauacuaagauccucuuuauugaggaaggaaaaaucgugcauacaucaaccuuaagcgguagugcccaacacgucgaggaaugcucuugcuauccucgguacccaggcguucgcugugugugcagagacaacuggaagggguccaacaggccgauaguagauauuaauaucaaagaccacagcaucgugucgucuuacgucuguuccggacuggugggcgacacgccccggaagaacgauucaaguagcuccucucauugccuugacccuaauaacgaggaaggugggcacggaguuaaaggcugggcuuucgaugacggcaaugauguguggauggggcgcaccauuaacgagacaagccgauugggauaugagacuuuuaaggucaucgaagguuggucaaauccaaaaaguaagcugcagauuaacagacaggugauaguagacaggggcaaucgguccggguacagcggaaucuucucuguugagggcaagucauguauuaaccguugcuuuuauguggaacuaauccgcgguagaaaagaggaaaccgagguccucuggacaaguaauagcaucguggucuucugugggacuuccggcaccuacggaacaggcucuuggcccgauggggccgaccugaaccuuaugccuauuuga

SEQ ID NO: 143216 - RNA, 1410 nt, Artificial Sequence
  derived and/or modified sequence opt3 from neuraminidase__InfluenzaA__AER08697
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaacaugccccaccuuagcugaguacaggaauuggaguaaaccucagugugacaucacgggguucgcaccauuuagcaaggauaacuccauacggcugucugccggaggugacauuuggguaacucgcgagcccuaugugucgugcgauccugacaaauguuaccaauucgcgcuaggccaggggaccacacucaauaacguccauucaaauaacacugugcgagaucguaccccauauagaacacugcuuaugaaugaacugggaguucccuuucacuugggcaccaaacaggugugcaucgcuuggagcaguuccucuugucaugacgguaaggccuggcuccacgucugcauuacgggggaugacaagaacgcaacugccagcuucaucuacaauggaaggcugguggauuccguaguuucauggaguaaggagauccugcggacacaggaaagcgagugugugugcauuaacggcaccuguacugucgugaugacagacggcucugcuuccgggaaagcagauaccaagauacucuuuaucgaggaaggaaaaauugugcauacgucaaccuuaagcgguagugcccaacacgucgaggaaugcucuugcuauccucgcuacccaggcguuagaugugugugcagggacaacuggaagggguccaaucggccgaucguagauauaaacauuaaggaccacagcaucgugucgucuuacgucuguuccggacuggugggcgacacaccccgcaaaaaugauucaaguagcuccucucauugccuugacccuaacaaugaggaaggugggcacggaguuaagggcugggcuuucgaugacggcaacgauguguggauggggcgaacuaucaaugucaccagcagauugggauaugagacauuuaaagugauugaggguuggucaaacccaaagaguaaacugcagaucaauaggcagguaauuguugaccggggcaaccguuccggguacagcggaauauucucuguggaaggcaagucauguaucaaucgcugcuuuuaugucgagcuaauuagagguaggaaagaagagacugaagugcucuggaccaguaacagcaucgucguguucugugggacauccggcaccuacggaacuggcucuuggcccgauggggccgaccugaaucuuaugccuaucuga

SEQ ID NO: 143217 - RNA, 1410 nt, Artificial Sequence; identical to SEQ ID NO: 143013
  derived and/or modified sequence opt3 from neuraminidase__InfluenzaA__AER92714

SEQ ID NO: 143218 - RNA, 1410 nt, Artificial Sequence; identical to SEQ ID NO: 138754
  derived and/or modified sequence opt3 from neuraminidase__InfluenzaA__AER92721

SEQ ID NO: 143219 - RNA, 1410 nt, Artificial Sequence; identical to SEQ ID NO: 138754
  derived and/or modified sequence opt3 from neuraminidase__InfluenzaA__AER92724

SEQ ID NO: 143220 - RNA, 1413 nt, Artificial Sequence
  derived and/or modified sequence opt3 from neuraminidase__InfluenzaA__AET84165
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucagcgcaccuaacuuuuauuacgaagaguguuccugcuacccagacaccggcaucguuaugugugugugcagggauaauuggcauggcucuaaccggcccugggucagcuucaaucagaaccuggacuaucaaauuggguacaucugcucaggaguguuuggugauaauccucgcccagaggacggcgaagggaguuguaacccggugacgaucgauggagccaauggcgucaaagguuucuccuauaaguacgggaacggcguuuggauuggaagaacuaaaagcaauaggcugcggaagggcuuugagaugauaugggaccccaacggguggacaaauaccgacucugauuucucagugaaacaggacguaguggcuaucacugauuggaguggauauagcgguuccuuuguccagcacccugaacucacaggcuuagacugcauucgcccauguuucuggguggagcugguucgagggcuucccagagaaaacaccacgaucuggaccucuggaucgagcauuuccuucugcggcgugaacucagauacagccaauuggaguuggccugacggugcagaguugccauuuacuaucgauaaguga

SEQ ID NO: 143221 - RNA, 1413 nt, Artificial Sequence; identical to SEQ ID NO: 140946
  derived and/or modified sequence opt3 from neuraminidase__InfluenzaA__AET84176

SEQ ID NO: 143222 - RNA, 1413 nt, Artificial Sequence
  derived and/or modified sequence opt3 from neuraminidase__InfluenzaA__AET84187
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggauggacuggcuuacgauuggaaucuccgguccagauaacggcgccguggcuguccugaaguauaaugggauaauuacuggaaccaucaaaagcuggaagaaacagaucuugagaacacaggagucggagugcguguguaugaacggcucuugcuuuacuauuaugaccgacggucccuccaauaaggccgcgucauacaaaaucuucaagauugaaaaggggaaaguaacaaagaguauagagcucaacgcaccuaauuuuuauuacgaagaguguagcugcuacccagauaccggaaucguuaugugugugugcagggacaacuggcauggcuccaaucggcccugggucucuuucaaccagaaucuggauuaucaaauuggcuacaucugcagcgggguguuuggagacaacccucgcccaaaagauggugagggcucauguaauccggugacgaucgacggggccaacggagucaagggcuucaguuauaaauacgguaaugggguuuggauuggcagaacuaaguccaacaggcugcggaaaggauuugaaaugauaugggaccccaauggcuggacaaacaccgauagcgacuucucugugaagcaggauguaguggcuaucacugacuggucaggguauaguggauccuuuguccagcacccugagcucacagguuuagauugcauucgcccauguuucuggguggaacugguucgaggccuucccagagagaacaccacgaucuggaccuccgggucuucgauuagcuucugcggagugaauagcgacacagccaacuggucauggccugauggcgcagaauugccauuuacuaucgacaaguga

SEQ ID NO: 143223 - RNA, 1413 nt, Artificial Sequence
  derived and/or modified sequence opt3 from neuraminidase__InfluenzaA__AET84198
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugugaacaucaauaacacuaauguuguggcaggggaagacaaaaccucgaugacacuugccggaaacucaagccuguguaguauuuccggcugggcgaucuacaccaaggauaauucuaucaggauugguagcaaaggggacguauucgugauacgggagccuuuuaucuccugcucacacuuggaaugucgcacuuucuuuuuaacacaaggagcucugcuaaacgauaagcauaguaauggcaccgucaaagaccgaagcccauaucgugcccucaugucuugcccgcugggcgaggcacccuccccuuacaacucaaaguucgaaagcguggccuggagugcuucugcaugucacgaugggaugggauggcuuacgauugguaucuccggcccagacaacggggccguugcugugcugaaguauaauggaauaauuacuggcaccaucaaaagcuggaagaaacagaucuugagaacacaggagucggagugcgucuguaugaacgguucuugcuuuacuauuaugaccgaugggcccuccaauaaggccgcgucauacaaaaucuucaagauugaaaagggaaaagugacaaagaguauagagcucaacgcaccuaauuuuuauuacgaagaguguagcugcuacccagacaccggcaucguaauguguguuugcagggauaacuggcauggcuccaaucggcccugggugucuuucaaccagaaucuggacuaucaaauuggguacaucugcagcggagucuuuggugauaacccucgcccaaaagacggcgaggggucauguaauccggugacgguggauggagccaacggcgucaaggguuucaguuauaaauacgggaauggcguuuggaucggaagaacuaaguccaacaggcugcggaaaggcuuugaaaugauuugggaccccaauggguggacaaacaccgacagcgauuucucugugaagcaggacguaguggcuauaacugauuggucaggauauagugguagcuuuguccagcacccugagcucacaggcuuagacugcauccgcccauguuucuggguggaacugguucgagggcuucccagagagaacaccacgauuuggaccuccggaucuucgaucagcuucugcggcgucaauuccgauacagccaacuggucauggccugacggugcagaauugccauuuacuauugauaaguga

SEQ ID NO: 143224 - RNA, 1413 nt, Artificial Sequence
  derived and/or modified sequence opt3 from neuraminidase__InfluenzaA__AET84209
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaaaguuguggcaggggaagacaagaccucgguaacacuugccggaaauucaagccuguguaguauuuccggcugggcgaucaacaccaaagauaauucuaucaggauugguagcaagggggacguguucgucauacgggagccuuuuaucuccugcucacacuuggaaugucgcacuuucuuuuuaacacaaggagcucugcuaaacgauaaacauaguaauggcaccgugaaggaccgaagcccauaccgugcccucaugucuugcccgcugggcgaggcacccuccccuuauaacucaaaguucgaaagcguugccuggagugcuucugcaugucacgaugggaugggauggcuuacgauugguaucuccggcccagacaacggggccguggcuguccugaaauacaauggaauaauuacuggcaccaucaagagcuggaaaaagcagaucuugagaacacaggagucggagugcguguguaugaacgguucuugcuuuacuauuaugaccgaugggcccuccaauaaagccgcgucauauaagaucuucaagauugaaaaaggaaagguaacaaaaaguauagagcucaacgcaccuaauuuuuacuaugaagaguguagcugcuacccagacaccggcaucguuaugugugugugcagggauaacuggcauggcuccaaucggcccugggucucuuucaaccagaaucuggacuaccaaauuggguauaucugcagcggaguguuuggugauaacccucgcccaaaggacggcgaggggucauguaauccggugacggucgauggagccaacggcguuaaagguuucaguuacaaguaugggaauggcguguggaucggaagaacuaaauccaacaggcugcggaagggcuuugaaaugauuugggaccccaauggguggacaaacaccgacagcgauuucucuguaaagcaggacguggucgcuauaacugauuggucaggauacagugguagcuuugugcagcacccugagcucacaggcuuagacugcauccgcccauguuucuggguugaacuggugcgagggcuucccagagagaacaccacgauuuggaccuccggaucuucgaucagcuucugcggcgucaauuccgauacagccaacuggucauggccugacggugcagaauugccauuuacuauugauaaauga

SEQ ID NO: 143225 - RNA, 1413 nt, Artificial Sequence
  derived and/or modified sequence opt3 from neuraminidase__InfluenzaA__AET84231
augaaccccaaucagaagaucauuaccauaggcagcaucuccauugccaucgggauuaucucucugaugcuccaaauaggaucaaucauuaguaucugggcuagccacuccauucauacagguucucagaacaauacuggcaucugcaaccagagaauaauuacguacgaaaauucgaccugggugaaccacacauaugucaauaucaacaauacuaacguuguggcaggggaggacaaaaccucaguaacacuugccggaaauagcagucuguguuccauuucuggcugggcgaucuacaccaaggauaacagcaucaggauugguuccaaaggggacguguucgucauacgggagccuuuuaucucaugcagucauuuggaaugucgcacuuucuuuuuaacacagggagcucugcuaaaugauaagcacagcaacggcaccgugaaagaccgaucuccauaucgugcccucauguccugcccgcugggcgaggcacccucaccuuacaauagcaaguucgaaaguguugccuggucugcuuccgcaugucaugaugggaugggauggcuuacgauugguaucagcggcccagacaacggggccguggcuguccugaaguauaacggaauaauuacuggcaccaucaaaucguggaagaaacaaaucuugagaacacaggagucugagugcguguguaugaaugguuccugcuuuacuauuaugaccgaugggcccucaaacaaggccaguagcuacaaaaucuucaagauugaaaagggaaaaguaacaaaguccauagagcucaaugcgccuaacuuuuauuacgaagaguguucuugcuacccagacaccggcaucguuaugugugugugcagggauaauuggcacggcagcaaccggcccugggucucauucaaucagaaccuggacuaucagauuggguacaucugcaguggaguguuuggugauaauccucgcccagaggacggcgaaggguccuguaacccggugacggucgauggagcaaauggcguuaaagguuucagcuauaaguacgggaacggcguguggaucggaagaacuaaaucuaauaggcugcggaagggcuuugagaugauuugggaccccaacggguggacaaauaccgacucagauuucaguguaaaacaagacguggucgccauaacugauuggagcggauauuccgguucuuuugugcagcacccugaacucacaggcuuagacugcauccgcccauguuucuggguugagcuggugcgagggcuucccagagaaaacaccacgauuuggaccucgggaagcuccaucucauucugcggcgucaacagugauacagcuaauuggucuuggccugacggugccgaguugccauuuacuauugauaaguga

SEQ ID NO: 143226 - RNA, 1413 nt, Artificial Sequence; identical to SEQ ID NO: 139477
  derived and/or modified sequence opt3 from neuraminidase__InfluenzaA__AET84242

SEQ ID NO: 143227 - RNA, 1413 nt, Artificial Sequence
  derived and/or modified sequence opt3 from neuraminidase__InfluenzaA__AET84253
augaaccccaaucagaagaucauuaccauaggcagcaucuccauugccaucgggauuaucucucugaugcuccaaauaggaucaaucauuaguaucugggcuagccacuccauucagacagguucucagaacaauacuggcaucugcaaccagagaauaauuacguacgaaaauucgaccugggugaaccauacauaugucaauaucaacaauacuaacguuguggcaggggaggacaaaaccucaguaacacuugccggaaauagcagucuguguuccauuucuggcugggcgaucuacaccaaggauaacagcaucaggauugguuccaaaggggacguguucgucauacgggagccuuuuaucucaugcagucacuuggaaugucgcacuuucuuuuuaacacaaggagcucugcuaaaugauaagcauagcaacggcaccgugaaagaccgaucuccauaucgugcccucauguccugcccgcugggcgaggcacccucaccuuacaauagcaaguucgaaaguguugccuggucugcuuccgcaugucacgaugggaugggauggcuuacgauugguaucagcggcccagacaacggggccguggcuguccugaaguauaacggaauaauuacugagaccaucaaaucguggaagaaacagaucuugagaacacaggagucugaaugcguguguaugaauggcuccugcuuuacuauuaugaccgauggucccucaaacaaggccgcgaguuacaaaaucuucaagauugagaaggggaaaguaacaaagagcauagaacucaaugcaccuaacuuuuauuacgaggaguguuccugcuacccagacaccggaaucguuaugugugugugcagggauaauuggcauggcucuaaccggcccugggucagcuucaaucagaaccuggacuaucaaauuggcuacaucugcucagggguguuuggagauaauccucgcccagaagacggugagggcaguuguaacccggugacggucgauggggccaauggaguuaaaggcuucuccuauaaguacgguaacgggguguggaucggcagaacuaaaagcaauaggcugcggaagggauuugaaaugauuugggaccccaacggcuggacaaauaccgacucugauuucucaguaaaacaggacguggucgcuauaacugauuggaguggguauagcggauccuuugugcagcacccugagcucacagguuuagacugcauccgcccauguuucuggguugaacuggugcgaggccuucccagagagaacaccacgauuuggaccucugggucgagcaucuccuucugcggagucaacucagauacagccaauuggaguuggccugacggcgcagaguugccauuuacuauugauaaguga

SEQ ID NO: 143228 - RNA, 1413 nt, Artificial Sequence
  derived and/or modified sequence opt3 from neuraminidase__InfluenzaA__AET84264
augaaccccaaucagaagaucauuaccauaggcagcaucuccauugccaucgggauuaucucucugauguuccaaauaggaucaaucauuaguaucugggcuagccacuccauucagacagguucucagaacaauacuggcaucugcaaccagagaauaauuacguacgaaaauucgaccugggugaaccauacauaugucaauaucaacaauacuaacguuguggcaggggaggacaaaaccucaguaacacucgccggaaauagcagucuuuguuccauuucuggcugggcgaucuacaccaaggauaacagcaucaggauugguuccaaaggggacguguuugucauacgggagccuuucaucucaugcagucaccuggaaugucgcacauuuuucuugacucaaggagcuuuacugaaugauaagcauagcaacggcaccgugaaagaccgaucuccauaucgugcccuaauguccugcccgcucggcgaggcacccucaccuuacaauagcaaguuugaaaguguugccuggucugcuuccgcaugucacgaugggaugggauggcugacgauugguaucagcggcccagacaacggggccguggcuguccuuaaguauaacggaauaauuacugagaccaucaaaucguggaagaaacagauccugagaacacaggagucugaaugcguguguaugaauggcuccugcuucacuauuaugaccgauggucccucaaacaaggccgcgaguuacaaaaucuuuaagauugagaaggggaaaguaacaaagagcauagaauugaaugcaccuaacuucuauuacgaggaguguuccugcuacccagacaccggaaucguuaugugugugugcagggauaauuggcauggcucuaaccggcccugggucagcuuuaaucagaaccucgacuaucaaauuggcuacaucugcucagggguguucggagauaauccucgcccagaagacggugagggcaguuguaacccggugacggucgauggggccaauggaguuaaaggcuuuuccuauaaguacgguaacgggguguggaucggcagaacuaaaagcaauaggcugcggaagggauucgaaaugauuugggaccccaacggcuggacaaauaccgacucugauuuuucaguaaaacaggacguggucgcuauaacugauuggaguggguauagcggauccuucgugcagcacccugagcugacaggucucgacugcauccgcccauguuucuggguugaauuagugcgaggccugcccagagagaacaccacgauuuggaccucugggucgagcaucuccuuuugcggagucaacucagauacagccaauuggaguuggccugacggcgcagagcuuccauucacuauugauaaguga

SEQ ID NO: 143229 - RNA, 1413 nt, Artificial Sequence
  derived and/or modified sequence opt3 from neuraminidase__InfluenzaA__AET84275
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccaaaagacggcgaggggucauguaauccggugacggucgauggagccaacggcguuaaggguuucaguuauaaauacgggaauggcguguggaucggaagaacuaaguccaacaggcugcggaaaggcuuugaaaugauuugggaccccaauggguggacaaacaccgacagcgauuucucuguaaagcaggacguggucgcuauaacugauuggucaggauauagugguagcuuugugcagcacccugagcucacaggcuuagacugcauccgcccauguuucuggguugaacuggugcgagggcuucccagagagaacaccacgauuuggaccuccggaucuucgaucagcuucugcggcgucaauuccgauacagccaacuggucauggccugacggugcagaauugccauuuacuauugauaaguga

SEQ ID NO: 143230 - RNA, 1413 nt, Artificial Sequence; identical to SEQ ID NO: 139477
  derived and/or modified sequence opt3 from neuraminidase__InfluenzaA__AET84286

SEQ ID NO: 143231 - RNA, 1413 nt, Artificial Sequence
  derived and/or modified sequence opt3 from neuraminidase__InfluenzaA__AET84297
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucgauggagccaacggcguuaaagguuucaguuauaaguacgacaaugggguguggaucggcagaacuaaauccaacaggcugcggaagggauuugagaugauuugggaccccaauggcuggacaaacaccgauagcgacuucucuguaaaacaggauguggucgcuauaacugacuggucaggguauagugguagcuuugugcagcacccugaacucacaggauuagauugcauccgcccauguuucuggguugagcuggugcgaggccuucccagagaaaacaccacgauuuggaccuccgggucuucgaucagcuucugcggagucaauuccgacacaacuaacuggucauggccugauggcgccgaguugccauuuaccauugacaaguga

SEQ ID NO: 143232 - RNA, 1413 nt, Artificial Sequence
  derived and/or modified sequence opt3 from neuraminidase__InfluenzaA__AET84308
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacugagaccaucaaaagcuggaagaaacagaucuugagaacacaggagucggaaugcguguguaugaacggcucuugcuuuacuauuaugaccgauggucccuccaauaaggccgcgucauacaaaaucuucaagauugagaaggggaaaguaacaaagaguauagaacucaacgcaccuaauuuucauuaugaggaguguagcugcuacccagacaccggaaucguuaugugugugugcagggauaacuggcacggcuccaaucggcccugggucucuuucaaccagaaucuggacuaccaaauuggcuauaucugcagcgggguguuuggagauaacccucgcccagaagacggugagggcucauguaauccggugacggucgauggggccaacggaguuaaaggcuucaguuacaaguaugacaaugguguguggaucgggagaacuaaauccaacaggcugcggaagggcuuugaaaugauuugggaccccaauggauggacaaacaccgauagcgacuucucuguaaaacaggauguggucgcuauaacugacuggucaggcuacagugggagcuuugugcagcacccugagcucacaggauuagauugcauccgcccauguuucuggguugaacuggugcgaggucuucccagagagaacaccacgauuuggaccuccgggucuucgaucagcuucugcggcgucaauuccgacacaacuaacuggucauggccugauggagccgaguugccauuuaccauugacaaguga

SEQ ID NO: 143233 - RNA, 1413 nt, Artificial Sequence
  derived and/or modified sequence opt3 from neuraminidase__InfluenzaA__AET84319
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugugaacaucaauaacacuaauguuguggcaggggaagacaaaaccucgaugacacuugccggaaacucaagccuguguaguauuuccggcugggcgaucuacaccaaggauaauucuaucaggauugguagcaaaggggacguauucgugauacgggagccuuuuaucuccugcucacacuuggaaugucgcacuuucuuuuuaacacaaggagcucugcuaaacgauaagcauaguaaucgaaccgucaaagaccguagcccauauagagcccucaugucuugcccgcugggcgaggcacccuccccuuacaacucaaaguucgaaagcguggccuggagugcuucugcaugucacgauggcaugggguggcuuacgauuggaaucuccgguccagacaacggcgccguugcugugcugaaguauaaugggauaauuacugagaccaucaaaagcuggaagaaacagaucuugaggacacaggagucggaaugcgucuguaugaacggaucuugcuuuacuauuaugaccgauggccccuccaauaaggccgcgucauacaaaaucuucaagauugagaaggguaaagugacaaagaguauagaacucaacgcaccuaauuuuuauuacgaggaguguagcugcuacccagacaccgggaucguaauguguguuugccgggauaacuggcauggauccaaucgccccugggugucuuucaaccagaaucuggacuaucaaauuggcuacaucugcagcggcgucuuuggggauaacccuagaccagaagacggagaggguucauguaauccggugacgguggauggcgccaacggggucaaaggauucaguuauaaguacggcaaugguguuuggaucgggaggacuaaauccaaccggcugcgcaagggcuuugaaaugauuugggaccccaauggauggacaaacaccgacagcgauuucucugugaaacaggacguaguggcuauaacugauuggucaggcuauagugggagcuuuguccagcacccugagcucacaggauuagacugcauccgaccauguuucuggguggaacugguuagaggucuucccagggagaacaccacgauuuggaccuccgggucuucgaucagcuucugcggcgucaauuccgauacagccaacuggucauggccugacggagcagaguugccauuuacuauugauaaguga

SEQ ID NO: 143234 - RNA, 1413 nt, Artificial Sequence
  derived and/or modified sequence opt3 from neuraminidase__InfluenzaA__AET84330
augaaccccaaucagagaaucauuaccauaggcagcaucuccauugccaucgggauuaucucucugaugcuccaaauaggaaacaucauuucaaucugggcuagucacagcauucagaucgguucccagaauaacacaggcauaugcaaucagaggauuaucacuuacgagaacucuacgugggugaaucauaccuaugugaacauuaauaacacaaauguuguggcaggggaagacaagacuucgguaacccuugccggaaacucaagccuguguaguaucuccggcugggcgaucuacacaaaagauaauucuauucggauagguagcaagggggacguguucgucauccgcgagccuuuuauuuccugcucacacuuggaaugucgaaccuucuuuuuaacucaaggagcucugcuaaacgauaaacauaguaauggcacagccaaggaccguagcccauauagagcacucaugucuugcccgcugggcgaggcccccuccccuuacaacucaaaauucgaaagcguggcuuggagugcaucugccugucacgaugggaugggauggcuuaccaucgguauauccggcccagacaacggggcuguugccgugcugaaguauaauggaauuaucacgggcacuaucaagagcuggaaaaagcagauuuugaggacccaggagucggagugcgucuguaugaacgguucuugcuuuacaaucaugacugaugggcccuccaauaaagcggcaucauacaagauuuucaaaauagaaaagggaaaggugaccaaaaguaucgagcucaacgccccuaauuuuuauuacgaagaguguagcugcuacccagacacaggcauuguaauguguguuugccgggauaacuggcauggcuccaaucgccccugggugucuuucaaccagaaucuggacuaucaaaucggguacaucugcagcggagucuuuggugauaacccuagaccaaaggacggcgaggggucauguaauccggugaccguggauggagcuaacggcgucaaagguuucaguuauaaguacgggaauggcguuuggauuggaaggacgaaauccaaccggcugcgcaagggcuuugaaaugauaugggaccccaauggguggacuaacacagacagcgauuucucugugaaacaggacguaguggccaucaccgauuggucaggauauagugguagcuuuguccagcacccugagcucacuggcuuagacugcauucgaccauguuucuggguggaacugguuagagggcuucccagggagaacacaaccaucuggacguccggaucuucgauuagcuucugcggcgucaauuccgauaccgcaaacuggucauggccugacggugcugaauugccauuuacaaucgauaaguga

SEQ ID NO: 143235 - RNA, 1413 nt, Artificial Sequence
  derived and/or modified sequence opt3 from neuraminidase__InfluenzaA__AET84341
augaaccccaaucagagaaucauuaccauaggcagcaucuccauugccaucgggauuaucucucugaugcuccaaauaggaaacaucauuucaaucugggcuagucacagcauucagaucgguucccagaauaacacaggcauaugcaaucagaggauuaucacuuacgagaacucuacgugggugaaucauaccuaugugaacauuaauaacacaaauguuguggcaggggaagacaagacuucgguaacccuugccggaaacucaagccuguguaguaucuccggcugggcgaucuacacaaaagauaauucuauucggauagguagcaagggggacguguucgucauccgcgagccuuuuauuuccugcucacacuuggaaugucgaaccuucuuuuuaacucaaggagcucugcuaaacgauaaacauaguaauggcacagccaaggaccguagcccauauagagcacucaugucuugcccgcugggcgaggcccccuccccuuacaacucaaaauucgaaagcguggcuuggagugcaucugccugucacgaugggaugggauggcuuaccaucgguauauccggcccagacaacggggcuguugccgugcugaaguauaauggaauuaucacgggcacuaucaagagcuggaaaaagcagauuuugaggacccaggagucggagugcgucuguaugaacgguucuugcuuuacaaucaugacugaugggcccuccaauaaagcggcaucauacaagauuuucaaaauagaaaagggaaaggugaccaaaaguaucgagcucaacgccccuaauuuuuauuacgaagaguguagcugcuacccagacacaggcauuguaauguguguuugccgggauaacuggcauggcuccaaucgccccugggugucuuucaaccagaaucuggacuaucaaaucggguacaucugcagcggagucuuuggugauaacccuagaccaaaggacggcgaggggucauguaauccggugaccguggauggagcuaacggcgucaaagguuucaguuauaaguacgggaauggcguuuggauuggaaggacgaaauccaaccggcugcgcaagggcuuugaaaugauaugggaccccaauggguggacuaacacagacagcgauuucucugugaaacaggacguaguggccaucaccgauuggucaggauauagugguagcuuuguccagcacccugagcucacuggcuuagacugcauucgaccauguuucuggguggaacugguuagagggcuucccaaggagaacacaaccaucuggacguccggaucuucgauuagcuucugcggcgucaauuccgauaccgcaaacuggucauggccugacggugcugaauugccauuuacaaucgauaaguga

SEQ ID NO: 143236 - RNA, 1413 nt, Artificial Sequence
  derived and/or modified sequence opt3 from neuraminidase__InfluenzaA__AET84363
augaaccccaaucagagaaucauuaccauaggcagcaucuccauugccaucgggauuaucucucugaugcuccaaauaggaaacaucauuucaaucugggcuagucacagcauucagacagguucccagaauaacacuggcaucugcaaucagaggauaauuacguacgagaacucuaccugggugaaucauacauaugucaacaucaauaacacuaauguuguggcaggggaagacaagaccucgaugacacuugccggaaacucaagccuguguaguauuuccggcugggcgaucuacaccaaagauaauucuauccggauugguagcaagggggacguauucgugauacgcgagccuuuuaucuccugcucacacuuggaaugucgaacuuucuuuuuaacacaaggagcucugcuaaacgauaaacauaguaauggcaccgccaaggaccguagcccauauagagcacucaugucuugcccgcugggcgaggcccccuccccuuacaacucaaaauucgaaagcgucgcuuggagugcaucugccugucacgaugggaugggauggcuuacgauugguaucuccggcccagacaacggggcuguggccguucugaaguauaauggaauaauuacuggcaccaucaagagcuggaaaaagcagaucuugaggacacaggagucggagugcguguguaugaacgguucuugcuuuacuauuaugaccgaugggcccuccaauaaagcggcaucauacaagaucuucaaaauugaaaagggaaaggucacaaaaaguauagagcucaacgccccuaauuuuuauuacgaagaguguagcugcuacccagacaccggcaucgugauguguguaugccgggauaacuggcauggcuccaaucgccccuggguuucuuucaaccagaaucuggacuaucaaauuggguacaucugcagcggaguguuuggugauaacccuagaccaaaggacggcgaggggucauguaauccggucacgguggauggagcuaacggcgugaaagguuucaguuauaaguacgggaauggcgucuggaucggaaggacuaaauccaaccggcugcgcaagggcuuugaaaugauuugggaccccaauggguggacaaacaccgacagcgauuucucuguuaaacaggacgugguagccauaacugauuggucaggauauagugguagcuuugugcagcacccugagcucacaggcuuagacugcauccgaccauguuucugggucgaacuggugagagggcuucccagggagaacaccacgauuuggaccuccggaucuucgaucagcuucugcggcguuaauuccgauacagcaaacuggucauggccugacggugcugaauugccauuuacuauugauaaguga

SEQ ID NO: 143237 - RNA, 1413 nt, Artificial Sequence
  derived and/or modified sequence opt3 from neuraminidase__InfluenzaA__AET84374
augaaccccaaucagagaaucauuaccauaggcagcaucuccauugccaucgggauuaucucucugaugcuccaaauaggaaacaucauuucaaucugggcuagucacagcauucagaucgguucccagaauaacacaggcauaugcaaucagaggauuaucacuuacgagaacucuacgugggugaaucauaccuaugucaacauuaauaacacaaauguuguggcaggggaagacaagacuucgguaacccuugccggaaacucaagccuguguaguaucuccggcugggcgaucuacacaaaagauaauucuauucggauagguagcaagggggacguguucgucauccgcgagccuuuuauuuccugcucacacuuggaaugucgaaccuucuuuuuaacucaaggagcucugcuaaacgauaaacauaguaauggcacagccaaggaccguagcccauauagagcacucaugucuugcccgcugggcgaggcccccuccccuuacaacucaaaauucgaaagcguggcuuggagugcaucugccugucacgaugggaugggauggcuuaccaucgguauauccggcccagacaacggggcuguugccgugcugaaguauaauggaauuaucacggagacuaucaagagcuggaaaaagcagauuuugaggacccaggagucggaaugcgucuguaugaacggcucuugcuuuacaaucaugacugauggucccuccaauaaagcggcaucauacaagauuuucaaaauagagaaggggaaggugaccaaaaguaucgaacucaacgccccuaauuuuuauuacgaggaguguagcugcuacccagacacaggaauuguaauguguguuugccgggauaacuggcauggcuccaaucgccccugggugucuuucaaccagaaucuggacuaucaaaucggcuacaucugcagcggggucuuuggagauaacccuagaccaaaggacggugaaggcucauguaauccggugaccguggauggggcuaacggagucaaaggcuucaguuauaaguacgguaaugggguuuggauuggcaggacgaaauccaaccggcugcgcaagggauuugagaugauaugggaccccaauggcuggacuaacacagacagcgauuucucugugaaacaggacguaguggccaucaccgauuggucaggguauaguggauccuuuguccagcacccugaacucacugguuuagacugcauucgaccauguuucuggguggagcugguuagaggccuucccagggaaaacacaaccaucuggacguccgggucuucgauuagcuucugcggagugaauagcgauaccgcaaacuggucauggccugacggcgcugaguugccauuuacaaucgauaaguga

SEQ ID NO: 143238 - RNA, 1413 nt, Artificial Sequence
  derived and/or modified sequence opt3 from neuraminidase__InfluenzaA__AET84396
augaaccccaaucagagaaucauuaccauaggcagcaucuccauugccaucgggauuaucucucugaugcuccaaauaggaaacaucauuucaaucugggcuagucacagcauucagacagguucccagaauaacacuggcaucugcaaucagaggauaauuacguacgagaacucuaccugggugaaucauacauaugucaacaucaauaacacuaauguuguggcaggggaagacaagaccucgaugacacuugccggaaacucaagccuguguaguauuuccggcugggcgaucuacaccaaagauaauucuauccggauugguagcaagggggacguauucgugauacgcgagccuuuuaucuccugcucacacuuggaaugucgaacuuucuuuuuaacacaaggagcucugcuaaacgauaaacauaguaauggcaccgccaaggaccguagcccauauagagcacucaugucuugcccgcugggcgaggcccccuccccuuacaacucaaaauucgaaagcgucgcuuggagugcaucugccugucacgaugggaugggauggcuuacgauugguaucuccggcccagacaacggggcuguggccguucugaaguauaauggaauaauuacugagaccaucaagagcuggaaaaagcagaucuugaggacacaggagucggaaugcguguguaugaacggcucuugcuuuacuauuaugaccgauggucccuccaauaaagcggcaucauacaagaucuucaaaauugagaaggggaaggucacaaaaaguauagaacucaacgccccuaauuuuuauuacgaggaguguagcugcuacccagacaccggaaucgugauguguguaugccgggauaacuggcauggcuccaaucgccccuggguuucuuucaaccagaaucuggacuaucaaauuggcuacaucugcagcgggguguuuggagauaacccuagaccaaaggacggugaaggcucauguaauccggucacgguggauggggcuaacggagugaaaggcuucaguuauaaguacgguaauggggucuggaucggcaggacuaaauccaaccggcugcgcaagggauuugagaugauuugggaccccaauggcuggacaaacaccgacagcgauuucucuguuaaacaggacgugguagccauaacugauuggucaggguauagugguagcuuugugcagcacccugaacucacaggauuagacugcauccgaccauguuucugggucgagcuggugagaggccuucccagggaaaacaccacgauuuggaccuccgggucuucgaucagcuucugcggaguuaauuccgauacagcaaacuggucauggccugacggcgcugaguugccauuuacuauugauaaguga

SEQ ID NO: 143239 - RNA, 1413 nt, Artificial Sequence
  derived and/or modified sequence opt3 from neuraminidase__InfluenzaA__AET84407
augaaccccaaucagagaaucauuaccauaggcagcaucuccauugccaucgggauuaucucucugaugcuccaaauaggaaacaucauuucaaucugggcuagucacagcauucagaucgguucccagaauaacacaggcauaugcaaucagaggauuaucacuuacgagaacucuacgugggugaaucauaccuaugugaacauuaauaacacaaauguuguggcaggggaagacaagacuucgguaacccuugccggaaacucaagccuguguaguaucuccggcugggcgaucuacacaaaagauaauucuauucggauagguagcaagggggacguguucgucauccgcgagccuuuuauuuccugcucacacuuggaaugucgaaccuucuuuuuaacucaaggagcucugcuaaacgauaaacauaguaauggcacagccaaggaccguagcccauauagagcacucaugucuugcccgcugggcgaggcccccuccccuuacaacucaaaauucgaaagcguggcuuggagugcaucugccugucacgaugggaugggauggcuuaccaucgguauauccggcccagacaacggggcuguugccgugcugaaguauaauggaauuaucacgggcacuaucaagagcuggaaaaagcagauuuugaggacccaggagucggagugcgucuguaugaacgguucuugcuuuacaaucaugacugaugggcccuccaauaaagcggcaucauacaagauuuucaaaauagaaaagggaaaggugaccaaaaguaucgagcucaacgccccuaauuuuuauuacgaagaguguagcugcuacccagacacaggcauuguaauguguguuugccgggauaacuggcauggcuccaaucgccccugggugucuuucaaccagaaucuggacuaucaaaucggguacaucugcagcggagucuuuggugauaacccuagaccagaggacggcgaagggucauguaauccggugaccguggauggagcuaacggcgucaaggguuucaguuauaaauacgggaauggcguuuggauuggaaggacgaaguccaaccggcugcgcaaaggcuuugagaugauaugggaccccaauggguggacuaacacagacagcgauuucucugugaagcaggacguaguggccaucaccgauuggucaggauauagugguagcuuuguccagcacccugaacucacuggcuuagacugcauucgaccauguuucuggguggagcugguuagagggcuucccagggaaaacacaaccaucuggacguccggaucuucgauuagcuucugcggcgucaauuccgauaccgcaaacuggucauggccugacggugcugaguugccauuuacaaucgauaaauga

SEQ ID NO: 143240 - RNA, 1413 nt, Artificial Sequence
  derived and/or modified sequence opt3 from neuraminidase__InfluenzaA__AET84418
augaaccccaaucagagaaucauugccauaggcagcaucuccauugcuaucgggauuaucucucugaugcuccaaauaggaaacaucauuucaaucugggcaagucacagcauucagaucgguucccagaauaacaccggcauaugcaaucagaggauuaucacauacgagaacucuacuugggugaaucauacguaugucaacauuaauaacaccaauguuguggccggggaagacaagacaucgguaacucuugcgggaaacucaagccuguguaguaucuccggcugggcuaucuacaccaaagauaauucuauucggauagguagcaagggggacguguucgucauccgcgagccuuuuauuuccugcucacacuuggaaugucgaacauucuuuuuaacccaaggagcccugcuaaacgauaaacauaguaauggcacugcaaaggaccguagcccauauagagcccucaugucuugcccgcugggcgaggcucccuccccuuacaacucaaaauucgaaagcguggcauggagugccucugcuugucacgaugggaugggauggcuuacaaucgguauauccggcccagacaacggggccguugcggugcugaaguauaauggaauuaucaccgagacgaucaagagcuggaaaaagcagauuuugaggacucaggagucggaaugcgucuguaugaacggcucuugcuuuaccaucaugacagauggucccuccaauaaagcagccucauacaagauuuucaaaauagagaaggggaaggugacuaaaaguaucgaacucaacgcuccuaauuuuuauuacgaggaguguagcugcuacccagacaccggaauuguaauguguguuugccgggauaacuggcauggcuccaaucgccccugggugucuuucaaccagaaucuggacuaucaaaucggcuacaucugcagcggggucuuuggagauaacccuagaccagaagacggugagggcucauguaauccggugacaguggauggggccaacggagucaagggcuucaguuauaaauacgguaaugggguuuggauuggcaggaccaaguccaaccggcugcgcaaaggauuugaaaugauaugggaccccaauggcuggacgaacacugacagcgauuucucugugaagcaggacguaguggcaaucacagauuggucaggguauaguggauccuuuguccagcacccugagcucaccgguuuagacugcauucgaccauguuucuggguggaacugguuagaggccuucccagggagaacacuacaaucuggaccuccgggucuucgauuagcuucugcggagugaauagcgauacggcuaacuggucauggccugacggcgccgaguugccauuuaccaucgauaaauga

SEQ ID NO: 143241 - RNA, 1413 nt, Artificial Sequence
  derived and/or modified sequence opt3 from neuraminidase__InfluenzaA__AET84429
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucucgaucaacaauacuaacguuguggcagggaaagacaagaccucaguaacacuugccggaaauagcagucuguguuccauuucuggcugggcgaucuacaccaaagauaacagcaucaggauugguuccaagggggacguguucgucauacgggaaccuuuuaucucaugcagucacuuggagugucgcacuuucuuuuuaacacaaggagcucugcuaaaugauaaacauagcaacggcaccgugaaggaccgaucuccauaucgugcccucauguccugcccgcugggcgaagcacccucaccuuacaauagcaaguucgagaguguugccuggucugcuuccgcaugucacgaugggaugggauggcuuacgauugguaucagcggcccagacaacggggccguggcuguccugaaauauaacggaauaauuacuggcaccaucaagucguggaaaaagcagaucuugagaacacaggaaucugagugcguguguaugaaugguuccugcuuuacuauuaugaccgaugggcccucaaacaaagccgcgaguuacaagaucuucaagauugagaaaggaaagguaacaaaaagcauagaacucaaugcaccuaacuuuuauuacgaggaauguuccugcuacccagacaccggcaucguuaugugugugugcagggauaauuggcauggcucuaaccggcccugggucagcuucaaucaggaccuggauuaucaaauuggguacaucugcucaggaguguuuggugacaacccucgcccaaaggauggcgaggggaguuguaauccggugacggucgacggagccaacggcguuaaagguuucuccuauaaguacgggaauggcguguggaucggaagaacuaaaagcaacaggcugcggaagggcuuugagaugauuugggaccccaauggguggacaaacaccgauucugacuucucaguaaagcaggauguggucgcuauaacugacuggaguggauauagcgguuccuuugugcagcacccugaacucacaggcuuagauugcauccgcccauguuucuggguugagcuggugcgagggcuucccagagaaaauaccacgauuuggaccucuggaucgagcaucuccuucugcggcgucaacucagacacagccaacuggaguuggccugauggugcagaguugccauuuacuauugacaaauga

SEQ ID NO: 143242 - RNA, 1413 nt, Artificial Sequence
  derived and/or modified sequence opt3 from neuraminidase__InfluenzaA__AET84440
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacugagaccaucaaaagcuggaagaaacagaucuugagaacacaggagucggaaugcguguguaugaacggcucuugcuuuacuauuaugaccgauggucccuccaauaaggccgcgucauacaaaaucuucaagauugagaaggggaaaguaacaaagaguauagaacucaacgcaccuaauuuuuauuacgaggaguguagcugcuacccagacaccggaaucguuaugugugugugcagggauaacuggcauggcuccaaucggcccugggucucuuucaaccagaaucuggacuaucaaauuggcuacaucugcagcgggguguuuggagauaacccucgcccaaaagacggugaaggcucauguaauccggugacggucgauggggccaacggaguuaagggcuucaguuauaaauacgguaaugggguguggaucggcagaacuaaguccaacaggcugcggaaaggauuugagaugauuugggaccccaauggcuggacaaacaccgacagcgauuucucuguaaagcaggacguggucgcuauaacugauuggucaggguauagugguagcuuugugcagcacccugaacucacaggauuagacugcauccgcccauguuucuggguugagcuggugcgaggccuucccagagaaaacaccacgauuuggaccuccgggucuucgaucagcuucugcggagucaauuccgauacagccaacuggucauggccugacggcgcagaguugccauuuacuauugauaaguga

SEQ ID NO: 143243 - RNA, 1413 nt, Artificial Sequence
  derived and/or modified sequence opt3 from neuraminidase__InfluenzaA__AET84451
augaaccccaaucagaagaucauuaccauaggcagcaucuccauugccaucgggauuaucucucugauacuccaaaucggaaacauuaucucaauuugggcuagucacagcauccagacagguucccagaaucauacuggcauaugcaaccagagaauuaucacguacgaaaauucuaccugggugaacaauacauaugucaacauuaauaacacuaauguuguggcagagaaagacaagaccucgguaacacuugccgggaacucaagccuguguaguaucuccggaugggcgaucuacaccaaagauaauucuauuaggauaggcagcaagggugacguguucgucauccgggagccuuuuauuuccugcucacacuuggaaugucgcacuuucuuuuuaacaaaaggggcucugcuaaacgauaagcauaguaauggaaccgugacggaccgaagcccauaucgugcccucaugucuugcccgcugggcgaggcacccuccccuuacaacucaagauucgaaagcguugccuggagugcuucugcaugucacgauggcaugggguggcuuacuaucggaauauccgguccagacaacggcgccguggcuguccugaaguauaaugggauuaucaccgagacaaucaaaagcuggaagaaaaggauuuugcggacucaagagucggaaugcguguguaugaacggaucuugcuuuaccaucaugacagauggccccuccaauggugccgcgucauacaagauuuucaaaauagagaaggggaagguaaccaaaacgaucgaacucaacgcaccuaauuuucauuaugaggaguguaguugcuacccagacacuggaacaguuaugugugugugccgcgauaacuggcacggcagcaauagacccugggucuccuucaaccagaaucuggacuaccagauuggcuauaucugcucugggguguuuggagauaacccuaggccaaaggacggugaaggcagcuguaauccggugaccgucgauggggccgacggaguuaaaggcuucucauacaaguaugguaacgggguguggaucggccggacuaaaaguaaucgccugcgaaagggauuugagaugauuugggaccccaacggcuggacaaauaccgauuccgacuucagcguaaaacaggauguggucgcuauaacggacuggucuggguacucaggaaguuuugugcaacacccugaacucaccgguuuagauugcaucagaccauguuucuggguugagcuggugaggggccuuccccgggaaaacacaacuauuuggaccagcggguccucuaucucguucugcggagucaacagcggcacagccaauugguccuggccugacggugcagaguugccauuuacuauugauaaguga

SEQ ID NO: 143244 - RNA, 1410 nt, Artificial Sequence; identical to SEQ ID NO: 138754
  derived and/or modified sequence opt3 from neuraminidase__InfluenzaA__AEV53421

SEQ ID NO: 143245 - RNA, 1410 nt, Artificial Sequence; identical to SEQ ID NO: 138754
  derived and/or modified sequence opt3 from neuraminidase__InfluenzaA__AEV53423

SEQ ID NO: 143246 - RNA, 1410 nt, Artificial Sequence; identical to SEQ ID NO: 140216
  derived and/or modified sequence opt3 from neuraminidase__InfluenzaA__AEV53425

SEQ ID NO: 143247 - RNA, 1410 nt, Artificial Sequence; identical to SEQ ID NO: 138754
  derived and/or modified sequence opt3 from neuraminidase__InfluenzaA__AEV53427

SEQ ID NO: 143248 - RNA, 1410 nt, Artificial Sequence; identical to SEQ ID NO: 140216
  derived and/or modified sequence opt3 from neuraminidase__InfluenzaA__AEV53429

SEQ ID NO: 143249 - RNA, 1410 nt, Artificial Sequence
  derived and/or modified sequence opt3 from neuraminidase__InfluenzaA__AEV53431
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugccugucaaacuggccggaaauucuucguugugcccagugucagggugggcgauauacagcaaggacaacaguauuagaaucggcuccaaaggugauguuuuugugauuagggagccguucaucucuuguagccccuuagaaugccggaccuuuuuccugacacagggggcucuacucaaugacaagcauuccaacggaaccaucaaagaucgcucaccuuaucgaacucugaugaguuguccaauuggcgagguccccagcccuuacaacucucguuuugaauccguggccuggucagcaagcgccugccacgacggcauaaauuggcuuacaaucgggauuaguggaccagauaacggugcuguagcaguucugaaguauaauggcaucauaaccgacacgauuaagucuuggagaaacaauaucuugaggacucaagaguccgagugugccugcgugaacgggagcuguuucaccgucaugacagauggacccucggacggccaggcuucuuacaaaaucuuucggauugaaaaggguaaaaucgugaaguccguggagaugaaugccccuaacuaucauuacgaagagugcucauguuacccagauaguagcgagauuacuugcgucugccgcgacaauuggcacggguccaacagaccguggguuucuuucaaucagaaccucgaauaucagauaggauacaucuguagcggcauuuuuggcgauaaucccaggccuaacgacaaaaccgggucaugcggaccagugaguuccaauggugcgaacggcguaaagggguucagcuuuaaguauggaaacggcguguggaucggucggacaaaaucuaucucaagucgcaauggguucgagaugauuugggaucccaacggcuggaccggaacggacaauaacuuuagcauaaagcaagacaucgucggcauuaaugaaugguccggguacucuggaucguucgugcagcauccugagcugacuggucuggauuguauccgaccaugcuucuggguugaacucauuagaggcaggcccaaagagaacacaaucuggaccagcggguccucaauaaguuuuuguggagucaauucuggcacuguggguuggagcuggccggacggggcagaguuaccuuucacaaucgauaaguga

SEQ ID NO: 143250 - RNA, 1410 nt, Artificial Sequence; identical to SEQ ID NO: 138754
  derived and/or modified sequence opt3 from neuraminidase__InfluenzaA__AEV53435

SEQ ID NO: 143251 - RNA, 1410 nt, Artificial Sequence
  derived and/or modified sequence opt3 from neuraminidase__InfluenzaA__AEV53437
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauacuuugaggacccaagagagcgagugugccugcgugaacgggucguguuucacagucaugacugauggaccaucugacggccaggcuuccuacaaaaucuuucggaucgaaaaggguaaaauugugaagucaguggagaugaaugcccccaacuaucauuacgaagagugcaguuguuacccugauagcuccgagauuaccugcgucugccgcgacaauuggcacgggucuaacagaccauggguuagcuucaaucagaaccucgaauaucagaucggauacauauguucaggcaucuuuggcgauaauccgaggcccaacgacaaaacagggaguugcggaccuguguccagcaauggugcgaacggcguaaagggguucucuuuuaaguauggaaacggcguguggauuggucggaccaaaucaaucaguagccgcaauggguucgagaugaucugggauccaaacggcuggacgggaacugacaauaacuuuuccauuaagcaagacauagucggcaucaaugaauggucuggguacucggggagcuucgugcagcaucccgagcugacaggucuggauuguauucgaccuugcuucuggguugaacucaucagaggcaggccaaaagagaacaccauuuggacuuccgggucaaguaucucuuuuuguggagugaauagcgacacagucggcugguccuggcccgauggugcagaguuaccguucaccauagacaaguga

SEQ ID NO: 143252 - RNA, 1410 nt, Artificial Sequence; identical to SEQ ID NO: 138754
  derived and/or modified sequence opt3 from neuraminidase__InfluenzaA__AEV53439

SEQ ID NO: 143253 - RNA, 1410 nt, Artificial Sequence; identical to SEQ ID NO: 138754
  derived and/or modified sequence opt3 from neuraminidase__InfluenzaA__AEV53441

SEQ ID NO: 143254 - RNA, 1410 nt, Artificial Sequence; identical to SEQ ID NO: 138754
  derived and/or modified sequence opt3 from neuraminidase__InfluenzaA__AEV53443

SEQ ID NO: 143255 - RNA, 1410 nt, Artificial Sequence
  derived and/or modified sequence opt3 from neuraminidase__InfluenzaA__AEV53445
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggaccauaauuuuuccauaaagcaagacaucgucggcauuaacgaauggucuggguacucggggagcuucgugcagcaccccgagcugacuggucuggauuguauccgaccuugcuucuggguugaacucauuagaggcaggccaaaagagaauacaaucuggaccuccgggucaaguauaucuuuuuguggagugaacagcgacacugucggcugguccuggcccgauggugcagaguuaccguucacaaucgacaaguga

SEQ ID NO: 143256 - RNA, 1410 nt, Artificial Sequence; identical to SEQ ID NO: 138754
  derived and/or modified sequence opt3 from neuraminidase__InfluenzaA__AEV53447

SEQ ID NO: 143257 - RNA, 1410 nt, Artificial Sequence; identical to SEQ ID NO: 140656
  derived and/or modified sequence opt3 from neuraminidase__InfluenzaA__AEV53449

SEQ ID NO: 143258 - RNA, 1410 nt, Artificial Sequence
  derived and/or modified sequence opt3 from neuraminidase__InfluenzaA__AEV53451
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuuaagauugaaaaagguaagaucgugaaaucaguggagaugaaugcccccgauuaucauuacgaagagugcaguuguuacccugacagcuccgagauuacuugcgucugccgggauaacuggcacgggucuaaucgcccauggguuagcuucaaccagaaucucgaauaucagauaggauacaucuguucaggcauuuuuggcgacaacccgagacccaaugauaagaccgggaguugcggaccuguguccagcaacggugcgaauggcguaaagggguucucuuuuaaauauggaaacggcguguggaucgguaggacaaagucaaucaguagccggaacggguucgagaugauuugggacccaaauggcuggaccggaacggacaacaauuuuuccauaaaacaagauaucgucggcauuaacgaauggucuggguacucggggagcuucgugcagcaucccgagcugacuggucuggacuguauccgcccuugcuucuggguugaacucauucgaggcagaccaaaggagaauacaaucuggaccuccgggucaaguauaucuuuuuguggagugaacagcgauacugucggcugguccuggcccgacggugcagaguuaccguucacaaucgauaaauga

SEQ ID NO: 143259 - RNA, 1410 nt, Artificial Sequence; identical to SEQ ID NO: 138754
  derived and/or modified sequence opt3 from neuraminidase__InfluenzaA__AEV53453

SEQ ID NO: 143260 - RNA, 1410 nt, Artificial Sequence
  derived and/or modified sequence opt3 from neuraminidase__InfluenzaA__AEV53455
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccgaaacggacaauaacuuuuccauaaagcaagacaucgucggaauuaaugaguggucuggcuacucggggagcuucgugcagcaucccgaacugacuggacugaacuguauccgaccuugcuucuggguugagcucauuagagguaggccaaaagagaauacaaucuggaccuccggcucaaguauaucuuuuuguggggugaacagcgauacugucggaugguccuggcccgacggcgcagaauuaccguucacaaucgauaaguga

SEQ ID NO: 143261 - RNA, 1410 nt, Artificial Sequence
  derived and/or modified sequence opt3 from neuraminidase__InfluenzaA__AEV53457
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggguggaaaaggguaaaauugugaagucagucgagaugaaugcccccaacuaucauuacgaagagugcaguuguuacccugauagcuccgagaucacuugcguuugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacaauaacuuuuccauuaagcaagacauagugggcaucaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcagaguuaccguucacaauagacaaguga

SEQ ID NO: 143262 - RNA, 1410 nt, Artificial Sequence
  derived and/or modified sequence opt3 from neuraminidase__InfluenzaA__AEV53459
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaucacagauggaccaucugacggccaggcuuccuacaaaauuuuucggaucgaaaaggguaaaauugugaagucaguggagaugaaugcccccaacuaucauuacgaagagugcaguuguuacccugauagcuccgagauaacuugcgucugccgcgacaauuggcacgggucuaacagaccauggguuagcuucaaucagaaccucgaauaucagaucggauacauuuguucaggcaucuuuggcgauaauccgaggcccaacgacaaaaccgggaguugcggaccuguguccagcaauggugcgaacggcguaaagggguucucuuuuaaguauggaaacggcguguggaucggucggacaaaaucaauuaguagccgcaauggguucgagaugauaugggauccaaacggcuggaccgaaacggacaauaacuuuuccaucaagcaagacauugucggaaucaaugaguggucuggcuacucggggagcuucgugcagcaucccgaacugacuggacugaacuguauucgaccuugcuucuggguugagcucaucagagguaggccaaaagagaauacaauauggaccuccggcucaaguaucucuuuuuguggggugaacagcgauacugucggaugguccuggcccgacggcgcagaauuaccguucacaauugauaaguga

SEQ ID NO: 143263 - RNA, 1410 nt, Artificial Sequence; identical to SEQ ID NO: 138754
  derived and/or modified sequence opt3 from neuraminidase__InfluenzaA__AEV53461

SEQ ID NO: 143264 - RNA, 1410 nt, Artificial Sequence
  derived and/or modified sequence opt3 from neuraminidase__InfluenzaA__AEV53463
augaaccccaaucagaagaucauuaccauaggcagcgugugcaugacaaucgggauggccaaccugauucuccaaaucggaaauauuaucuccauauggaucucucacucaauucagcuugagaaccagaaucagaucgaaacuuguaaccaaagugucauuacguacgagaauaacaccuggguuaaucagacauaugugaacaucagcaauacuaacuucgcugcaggucaguccguagugucugucaaacuggccggcaauucgucauugugcccugugagcgggugggcgauauacaguaaggacaacuccauuagaaucggaucuaaaggcgauguuuuugugauuagggaaccauucaucagcuguuccccguuagagugccggaccuuuuuccugacacagggugcucuacucaaugacaagcauucaaacgggaccaucaaagaucgcagucccuaucgaacucugaugagcuguccuauuggagaagucccaucucccuacaacucccguuuugagucaguggccuggagcgcaagugccugccacgacggcauaaauuggcuuacaaucggcauuucugggccugauaacggagcuguagcaguucugaaguauaaugguaucauaaccgacacgauuaaguccuggagaaacaauaucuugaggacucaagagagcgaaugugccugcaucaacggcucguguuucaccgugaugacagaugggccaucugacggacaggcuuccuacaaaauuuuucggaucgagaagggcaaaauugucaagucaguggaaaugaaugcccccaacuaucauuacgaggagugcaguuguuacccugauagcuccgaaauaacuugcgugugccgcgacaauuggcacgguucuaacagaccaugggucagcuucaaucagaaccucgaguaucagaucggguacauuuguucaggaaucuuuggcgauaauccgaggcccaacgacaaaaccggcaguugcgggccuguuuccagcaauggagcgaacggugugaagggcuucucuuuuaaguaugggaacggaguauggaucggccggacaaaaucaauuaguagccgcaaugguuucgaaaugauaugggauccaaacggguggaccggcacggacaauaacuuuuccaucaagcaagacauugugggaaucaaugaguggucuggcuacucggggagcuucguccagcaucccgaacugacuggacuggauuguauucgaccuugcuucuggguggagcucaucagagguaggccaaaagagaacacaauauggaccuccggcucaaguaucucuuuuugugggguuaauagcgacacugugggaugguccuggcccgauggcgcagaauuaccguucacaauugacaaguga

SEQ ID NO: 143265 - RNA, 1410 nt, Artificial Sequence
  derived and/or modified sequence opt3 from neuraminidase__InfluenzaA__AEV53465
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugaccggcaggcuuccuacaaaaucuuucgcauugaaaagggcaaaaucgugaagucaguggagaugaaugcccccaacuaucauuacgaagagugcaguuguuacccugauagcuccgagauuacuugcgucugcagagacaauuggcacgguucuaacaggccauggguuagcuucaaucagaaccucgaauaucagauaggguacaucuguucaggaauuuuuggcgauaauccgcggcccaacgacaaaaccggcaguugcgggccuguguccagcaauggagcgaacgguguaaagggcuucucuuauaaguacgggaacggaguguggaucggccgcacaaaaucaaucaguagccgaaaugguuuugagaugauuugggauccaaacggguggaccggcacggacaauaacuucuccauaaagcaagacaucgucggaauuaaugaauggucuggcuauucggggagcuuugugcagcaucccgagcugacuggacuggauuguaucagaccuugcuucuggguugaacucauuaggggucggccaaaagagaacacaaucuggaccuccggcucaaguauaucuuucuguggggugaauagcgacacugucggaugguccuggcccgauggcgcagaguuaccguuuacaaucgacaaguga

SEQ ID NO: 143266 - RNA, 1410 nt, Artificial Sequence; identical to SEQ ID NO: 140555
  derived and/or modified sequence opt3 from neuraminidase__InfluenzaA__AEV53467

SEQ ID NO: 143267 - RNA, 1410 nt, Artificial Sequence; identical to SEQ ID NO: 140555
  derived and/or modified sequence opt3 from neuraminidase__InfluenzaA__AEV53469

SEQ ID NO: 143268 - RNA, 1410 nt, Artificial Sequence; identical to SEQ ID NO: 138754
  derived and/or modified sequence opt3 from neuraminidase__InfluenzaA__AEV53471

SEQ ID NO: 143269 - RNA, 1410 nt, Artificial Sequence; identical to SEQ ID NO: 138754
  derived and/or modified sequence opt3 from neuraminidase__InfluenzaA__AEV53473

SEQ ID NO: 143270 - RNA, 1410 nt, Artificial Sequence; identical to SEQ ID NO: 138754
  derived and/or modified sequence opt3 from neuraminidase__InfluenzaA__AEV53475

SEQ ID NO: 143271 - RNA, 1410 nt, Artificial Sequence; identical to SEQ ID NO: 138754
  derived and/or modified sequence opt3 from neuraminidase__InfluenzaA__AEV53477

SEQ ID NO: 143272 - RNA, 1410 nt, Artificial Sequence; identical to SEQ ID NO: 138754
  derived and/or modified sequence opt3 from neuraminidase__InfluenzaA__AEV53479

SEQ ID NO: 143273 - RNA, 1410 nt, Artificial Sequence; identical to SEQ ID NO: 138754
  derived and/or modified sequence opt3 from neuraminidase__InfluenzaA__AEV53481

SEQ ID NO: 143274 - RNA, 1410 nt, Artificial Sequence; identical to SEQ ID NO: 138754
  derived and/or modified sequence opt3 from neuraminidase__InfluenzaA__AEV53483

SEQ ID NO: 143275 - RNA, 1410 nt, Artificial Sequence
  derived and/or modified sequence opt3 from neuraminidase__InfluenzaA__AEV53485
augaaccccaaucagaagaucauuaccauaggcagcgugugcaugacaaucgggauggccaaccugauucuccaaaucggaaauauuaucuccauaugggucucucacucaauccagcuugguaaccagaaucagauugagacuuguaaccaaaguguuaucacguacgaaaauaacaccugggugaaucagacauauguaaacauuagcaauacuaacuucgcugcaggccaguccguggucucugugaaacuggccggaaauucgucauugugcccuguuagcggaugggcgaucuacaguaaggacaacuccauaagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucugacggccaggcuuccuacaaaaucuuucggaucgaaaaggguaaaauugugaagucagucgagaugaaugcccccaacuaucauuacgaagagugcaguuguuacccugauagcuccgagaucacuugcguuugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacaauaacuuuuccauuaagcaagacauagugggcaucaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcagaguuaccguucacaauagacaaguga

SEQ ID NO: 143276 - RNA, 1410 nt, Artificial Sequence; identical to SEQ ID NO: 140555
  derived and/or modified sequence opt3 from neuraminidase__InfluenzaA__AEV53487

SEQ ID NO: 143277 - RNA, 1410 nt, Artificial Sequence; identical to SEQ ID NO: 139772
  derived and/or modified sequence opt3 from neuraminidase__InfluenzaA__AEV53489

SEQ ID NO: 143278 - RNA, 1410 nt, Artificial Sequence
  derived and/or modified sequence opt3 from neuraminidase__InfluenzaA__AEV53491
augaaccccaaucagaagaucauuaccauaggccuggugugcaugacaaucgggauggccaaccucauucuucaaaucggaaauauuaucagcauauggaucucccacucuauucagcuggguaaccagaaucagaucgagacuuguaaccaaucagucauuacguacgaaaauaacaccuggguuaaucagacauaugugaacaucaguaauacuaacuucgcugcaggccagagcguaguguccgucaaauuggccggaaauucuucguuaugcccugugucagggugggcgauauacagcaaggacaacaguauuagaaucggcuccaaaggugauguuuuugugauuagggagccauucaucucuuguagcccgcuggaaugccggaccuuuuuccuaacacagggggcucuccugaaugacaagcauuccaacggaaccaucaaagaucgcucacccuaucgaacucuuaugaguuguccuauuggcgaggucccaagccccuacaacucucguuuugaauccguggccuggucagcaagcgccugccacgacggcauaaauuggcugacaaucgggauuaguggaccugauaacggugcuguagcaguuuugaaguauaauggcaucauaaccgacacgauuaagucuuggagaaacaauauccucaggacucaagaguccgagugugccugcgugaacgggagcuguuucaccgucaugacagauggaccaucggacggccaggcuucuuacaaaaucuuucggauugaaaaggguaaaaucgugaaguccguggagaugaaugcccccaacuaucauuacgaagagugcucauguuacccugauaguagcgagauuacuugcgucugccgcgacaauuggcacggguccaacagaccauggguuucuuucaaucagaaccuggaauaucagauaggauacaucuguagcggcauuuuuggcgauaauccgaggcccaacgacaaaaccgggucaugcggaccugugaguuccaauggugcgaacggcguaaagggguucagcuuuaaguauggaaacggcguguggaucggucggacaaaaucuaucucaagucgcaauggguucgagaugauuugggauccaaacggcuggaccggaacggacaauaacuuuagcauaaagcaagacaucgucggcauuaaugaaugguccggguacucuggaucguucgugcagcaucccgagcugacuggucucgauuguauccgaccuugcuucuggguugaauuaauuagaggcaggccaaaagagaacacaaucuggaccagcggguccucaauaaguuuuuguggagucaauucugacacugugggcuggagcuggcccgauggugcagagcugccguucacaaucgacaaguga

SEQ ID NO: 143279 - RNA, 1410 nt, Artificial Sequence; identical to SEQ ID NO: 138754
  derived and/or modified sequence opt3 from neuraminidase__InfluenzaA__AEV53493

SEQ ID NO: 143280 - RNA, 1410 nt, Artificial Sequence; identical to SEQ ID NO: 140216
  derived and/or modified sequence opt3 from neuraminidase__InfluenzaA__AEV53495

SEQ ID NO: 143281 - RNA, 1410 nt, Artificial Sequence
  derived and/or modified sequence opt3 from neuraminidase__InfluenzaA__AEV53497
augaaccccaaucagaagaucauuaccauaggcagcgugugcaugacaaucgggauggccaaccugauucuccaaaucggaaauauuaucuccauauggaucucucacucaauucagcuugagaaccagaaucagaucgaaacuuguaaccaaagugucauuacguacgagaauaacaccuggguuaaucagacauaugugaacaucagcaauacuaacuucgcugcaggucaguccguagugucugucaaucuggccggcaacucgucauugugcccugugagcgggugggcgauauacaguaaagacaauuccauuagaaucggaucuaagggcgauguuuuugugauuagggaaccauucaucagcuguuccccguuagagugccggaccuuuuuccugacacagggugcucuacucaacgacaaacauucaaacgggaccaucaaggaucgcagucccuaucgaacucugaugagcuguccuauuggagaagucccaucucccuacaauucccguuuugagucaguggccuggagcgcaagugccugccacgacggcauaaacuggcuuacaaucggcauuucugggccugauaauggagcuguagcaguucugaaauauaacgguaucauaaccgacacgauuaaguccuggagaaauaacaucuugaggacucaagagagcgaaugugccugcgugaauggcucguguuucaccgucaugacagaugggccaucugacggacaggcuuccuacaagaucuuucggauugagaaaggcaagaucgugaaaucaguggaaaugaacgcccccaauuaucauuacgaggagugcaguuguuacccugauagcuccgaaauuacuugcgucugccgcgacaacuggcacgguucuaauagaccauggguuagcuucaaccagaaucucgaguaucagauaggguacaucuguucaggaauuuuuggcgauaacccgaggcccaaugacaagaccggcaguugcgggccuguguccagcaacggagcgaacgguguaaaaggcuucucuuuuaaguaugggaauggaguguggaucggccggacaaagucaaucaguagccgcaacgguuucgaaaugauuugggauccaaauggguggaccggcacggacaacaauuuuuccauaaaacaagacaucgucggaauuaacgaguggucuggcuacucggggagcuucgugcagcaucccgaacugacuggacuggauuguauccgaccuugcuucuggguugagcucauuagagguaggccaaaggagaauacaaucuggaccuccggcucaaguauaucuuuuuguggggugaacagcgacacugucggaugguccuggcccgauggcgcagaauuaccguucacaaucgacaaauga

SEQ ID NO: 143282 - RNA, 1410 nt, Artificial Sequence; identical to SEQ ID NO: 139772
  derived and/or modified sequence opt3 from neuraminidase__InfluenzaA__AEV53499

SEQ ID NO: 143283 - RNA, 1410 nt, Artificial Sequence; identical to SEQ ID NO: 138754
  derived and/or modified sequence opt3 from neuraminidase__InfluenzaA__AEV53501

SEQ ID NO: 143284 - RNA, 1410 nt, Artificial Sequence; identical to SEQ ID NO: 138754
  derived and/or modified sequence opt3 from neuraminidase__InfluenzaA__AEV53503

SEQ ID NO: 143285 - RNA, 1410 nt, Artificial Sequence; identical to SEQ ID NO: 138754
  derived and/or modified sequence opt3 from neuraminidase__InfluenzaA__AEV53505

SEQ ID NO: 143286 - RNA, 1410 nt, Artificial Sequence; identical to SEQ ID NO: 138754
  derived and/or modified sequence opt3 from neuraminidase__InfluenzaA__AEV53507

SEQ ID NO: 143287 - RNA, 1410 nt, Artificial Sequence; identical to SEQ ID NO: 138754
  derived and/or modified sequence opt3 from neuraminidase__InfluenzaA__AEV53509

SEQ ID NO: 143288 - RNA, 1410 nt, Artificial Sequence; identical to SEQ ID NO: 140216
  derived and/or modified sequence opt3 from neuraminidase__InfluenzaA__AEV53511

SEQ ID NO: 143289 - RNA, 1410 nt, Artificial Sequence; identical to SEQ ID NO: 140216
  derived and/or modified sequence opt3 from neuraminidase__InfluenzaA__AEV53513

SEQ ID NO: 143290 - RNA, 1410 nt, Artificial Sequence; identical to SEQ ID NO: 140216
  derived and/or modified sequence opt3 from neuraminidase__InfluenzaA__AEV53515

SEQ ID NO: 143291 - RNA, 1410 nt, Artificial Sequence
  derived and/or modified sequence opt3 from neuraminidase__InfluenzaA__AEV53517
augaaccccaaucagagaaucauuaccauaggcagcgugugcaugacaaucgggauggccaaccugauucuccaaaucggaaauauuaucuccauaugggucucucacucaauccagcuugguaaccagaaucagauugagacuuguaaccaaaguguuaucacguacgaaaauaacaccugggugaaucagacauauguaaacauuagcaauacuaacuucgcugcaggccaguccguggucucugugaagcuggccggaaauucgucauugugcccuguuagcggaugggcgaucuacaguaaagacaacuccauaaggauuggcucuaagggugauguguuugucauccgggagccauucauuagcuguuccccguuagaaugccgcaccuuuuuccugacacagggggcucuacucaaugacaaacauucaaacggaaccaucaaggaucgaagucccuaucguacucugaugagcuguccuaucggcgaggugccaucucccuacaacuccagauuugaaucaguagccuggagcgcaagugccugccacgacggcauuaauuggcuuacaauagggaucucuggaccugauaacggugcuguugcagugcugaaauauaauggcauuaucaccgacacgauaaaguccuggaggaacaauauuuugcggacucaagagagcgagugugccugcgucaacgggucguguuucaccgugaugacagauggaccaucugacggccaggcuuccuacaagaucuuucgcaucgaaaaagguaagauugugaaaucagucgagaugaaugcccccaacuaucauuacgaagagugcaguuguuacccugauagcuccgagaucacuugcguuugcagagacaauuggcacgggucuaacaggccaugggugagcuucaaucagaaccucgaauaucagauuggauacauauguucaggcaucuuuggcgauaauccgcggcccaacgacaagaccgggaguugcggaccuguauccagcaauggugcgaacggcgugaaaggguucucuuuuaaguauggaaacggcgucuggauuggucgcacaaagucaaucaguagccgaaauggguucgagaugaucugggauccaaacggcuggaccggaacggacaauaacuuuuccauuaaacaagacauagugggcaucaaugaauggucuggguacucggggagcuucguucagcaucccgagcugacuggucuggauuguauuagaccuugcuucuggguggaacucaucaggggccggccaaaggagaacacaauuuggaccuccgggucaaguaucucuuuuuguggagucaauagcgacacugugggcugguccuggcccgauggugcagaguuaccguucacaauagacaaauga

SEQ ID NO: 143292 - RNA, 1410 nt, Artificial Sequence; identical to SEQ ID NO: 138754
  derived and/or modified sequence opt3 from neuraminidase__InfluenzaA__AEV53519

SEQ ID NO: 143293 - RNA, 1410 nt, Artificial Sequence; identical to SEQ ID NO: 140216
  derived and/or modified sequence opt3 from neuraminidase__InfluenzaA__AEV53521

SEQ ID NO: 143294 - RNA, 1410 nt, Artificial Sequence; identical to SEQ ID NO: 140042
  derived and/or modified sequence opt3 from neuraminidase__InfluenzaA__AEV53523

SEQ ID NO: 143295 - RNA, 1410 nt, Artificial Sequence; identical to SEQ ID NO: 139108
  derived and/or modified sequence opt3 from neuraminidase__InfluenzaA__AEV53525

SEQ ID NO: 143296 - RNA, 1410 nt, Artificial Sequence; identical to SEQ ID NO: 138754
  derived and/or modified sequence opt3 from neuraminidase__InfluenzaA__AEV53527

SEQ ID NO: 143297 - RNA, 1410 nt, Artificial Sequence
  derived and/or modified sequence opt3 from neuraminidase__InfluenzaA__AEV53529
augaaccccaaucagaagaucauuaccauaggcagcgugugcaugacaaucgggauggccaaccugauucuccaaaucggaaauauuaucuccauauggaucucucacucaauucagcuugagaaccagaaucagaucgaaacuuguaaccaaagugucauuacguacgagaauaacaccuggguuaaucagacauaugugaacaucagcaauacuaacuucgcugcaggucaguccguagugucugucaaacuggccggcaauucgucauugugcccugugagcgggugggcgauauacaguaaggacaacuccauuagaaucggaucuaaaggcgauguuuuugugauuagggaaccauucaucagcuguuccccguuagagugccggaccuuuuuccugacacagggugcucuacucaaugacaagcauucaaacgggaccaucaaagaucgcagucccuaucgaacucugaugagcuguccuauuggagaagucccaucucccuacaacucccguuuugagucaguggccuggagcgcaagugccugccacgacggcauaaauuggcuuacaaucggcauuucugggccugauaacggagcuguagcaguucugaaguauaaugguaucauaaccgacacgauuaaguccuggagaaacaauaucuugaggacucaagagagcgaaugugccugcgugaacggcucguguuucaccgucaugacagaugggccaucugacggacaggcuuccuacaaaaucuuucggauugagaagggcaaaaucgugaagucaguggaaaugaaugcccccaacuaucauuacgaggagugcaguuguuacccugauagcuccgaaauuacuugcgucugccgcgacaauuggcacgguucuaacagaccauggguuagcuucaaucagaaccucgaguaucagauaggguacaucuguucaggaauuuuuggcgauaauccgaggcccaacgacaaaaccggcaguugcgggccuguguccagcaauggagcgaacgguguaaagggcuucucuuuuaaguaugggaacggaguguggaucggccggacaaaaucaaucaguagccgcaaugguuucgaaaugauuugggauccaaacggguggaccggcacggacaauaacuuuuccauaaagcaagacaucgucggaauuaaagaguggucuggcuacucggggagcuucgugcagcaucccgaacugacuggacuggauuguauccgaccuugcuucuggguugagcucauuagagguaggccaaaggagaauacaaucuggaccuccggcucaaguauaucuuuuuguggggugaacagcgacacugucggaugguccuggcccgauggcgcagaauuaccguucacaaucgacaaauga

SEQ ID NO: 143298 - RNA, 1410 nt, Artificial Sequence; identical to SEQ ID NO: 140216
  derived and/or modified sequence opt3 from neuraminidase__InfluenzaA__AEV53531

SEQ ID NO: 143299 - RNA, 1410 nt, Artificial Sequence
  derived and/or modified sequence opt3 from neuraminidase__InfluenzaA__AEV53533
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuauuacuacgaagagugcaguuguuauccugauagcuccgagauuacuugcgucugccgcgacaauuggcaugggucuaacagaccauggguuagcuucaaucagaaccucgaauaccagauaggauauaucuguucaggcauuuuuggcgauaauccgaggcccaacgacaaaaccgggaguugcggaccuguguccagcaauggugcgaacggcguaaagggguucucuuuuaaguacggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguauucggggagcuucgugcagcaccccgagcugacuggucugaacuguauccgaccuugcuucuggguugaacucauuagaggcaggccaaaagagaauacaaucuggaccuccgggucaaguauaucuuuuuguggagugaacagcgauacugucggcugguccuggcccgacggugcagaguuaccguucacaaucgauaaguga

SEQ ID NO: 143300 - RNA, 1410 nt, Artificial Sequence; identical to SEQ ID NO: 138754
  derived and/or modified sequence opt3 from neuraminidase__InfluenzaA__AEV53535

SEQ ID NO: 143301 - RNA, 1410 nt, Artificial Sequence; identical to SEQ ID NO: 143275
  derived and/or modified sequence opt3 from neuraminidase__InfluenzaA__AEV53537

SEQ ID NO: 143302 - RNA, 1410 nt, Artificial Sequence; identical to SEQ ID NO: 138754
  derived and/or modified sequence opt3 from neuraminidase__InfluenzaA__AEV53539

SEQ ID NO: 143303 - RNA, 1410 nt, Artificial Sequence; identical to SEQ ID NO: 142193
  derived and/or modified sequence opt3 from neuraminidase__InfluenzaA__AEV53541

SEQ ID NO: 143304 - RNA, 1410 nt, Artificial Sequence; identical to SEQ ID NO: 142193
  derived and/or modified sequence opt3 from neuraminidase__InfluenzaA__AEV53543

SEQ ID NO: 143305 - RNA, 1410 nt, Artificial Sequence; identical to SEQ ID NO: 140402
  derived and/or modified sequence opt3 from neuraminidase__InfluenzaA__AEV53545

SEQ ID NO: 143306 - RNA, 1410 nt, Artificial Sequence; identical to SEQ ID NO: 142193
  derived and/or modified sequence opt3 from neuraminidase__InfluenzaA__AEV53547

SEQ ID NO: 143307 - RNA, 1410 nt, Artificial Sequence; identical to SEQ ID NO: 142193
  derived and/or modified sequence opt3 from neuraminidase__InfluenzaA__AEV53549

SEQ ID NO: 143308 - RNA, 1410 nt, Artificial Sequence; identical to SEQ ID NO: 142193
  derived and/or modified sequence opt3 from neuraminidase__InfluenzaA__AEV53551

SEQ ID NO: 143309 - RNA, 1410 nt, Artificial Sequence; identical to SEQ ID NO: 142193
  derived and/or modified sequence opt3 from neuraminidase__InfluenzaA__AEV53553

SEQ ID NO: 143310 - RNA, 1410 nt, Artificial Sequence; identical to SEQ ID NO: 143275
  derived and/or modified sequence opt3 from neuraminidase__InfluenzaA__AEV53555

SEQ ID NO: 143311 - RNA, 1410 nt, Artificial Sequence; identical to SEQ ID NO: 139772
  derived and/or modified sequence opt3 from neuraminidase__InfluenzaA__AEV53557

SEQ ID NO: 143312 - RNA, 1410 nt, Artificial Sequence; identical to SEQ ID NO: 138754
  derived and/or modified sequence opt3 from neuraminidase__InfluenzaA__AEV53559

SEQ ID NO: 143313 - RNA, 1410 nt, Artificial Sequence; identical to SEQ ID NO: 138754
  derived and/or modified sequence opt3 from neuraminidase__InfluenzaA__AEV53561

SEQ ID NO: 143314 - RNA, 1410 nt, Artificial Sequence; identical to SEQ ID NO: 140346
  derived and/or modified sequence opt3 from neuraminidase__InfluenzaA__AEV53563

SEQ ID NO: 143315 - RNA, 1410 nt, Artificial Sequence
  derived and/or modified sequence opt3 from neuraminidase__InfluenzaA__AEV53565
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugaacgggugggcgauauacagcaaggacaauaguauuagaaucggcuccaaaggugauguuuuugugauuagggagccauucaucucuuguagcccguuagaaugccggaccuuuuuccugacacagggggcucuacucaacgacaagcauuccaacggaaccaucaaagaucgcucacccuaucgaacucugaugaguuguccuauuggcgaggucccaagccccuacaauucucguuuugaauccguggccuggucagcaagcgccugccacgacggcauaaacuggcuuacaaucgggauuaguggaccugauaauggugcuguagcaguucugaaguauaacggcaucauaaccgacacgauuaagucuuggagaaauaacaucuugaggacucaagaguccgagugugccugcgugaaugggagcuguuucaccgucaugacagauggaccaucggacggccaggcuucuuacaaaaucuuucggauugaaaaggguaaaaucgugaaguccguggagaugaacgcccccaauuaucauuacgaagagugcucauguuacccugauaguagcgagauuacuugcgucugccgcgacaacuggcacggguccaauagaccauggguuucuuucaaccagaaucucgaauaucagauaggauacaucuguagcggcauuuuuggcgauaacccgaggcccaaugacaaaaccgggucaugcggaccugugaguuccaacggugcgaacggcguaaagggguucagcuuuaaguauggaaauggcguguggaucggucggacaaaaucuaucucaagucgcaacggguucgagaugauuugggauccaaauggcuggaccggaacggacaacaauuuuagcauaaagcaagacaucgucggcauuaacgaaugguccggguacucuggaucguucgugcagcaucccgagcugacuggucuggauuguauccgaccuugcuucuggguugaacucauuagaggcaggccaaaagagaauacaaucuggaccagcggguccucaauaaguuuuuguggagugaacucugacacugucggcuggagcuggcccgauggugcagaguuaccgcugacaaucgacaaguga

SEQ ID NO: 143316 - RNA, 1410 nt, Artificial Sequence
  derived and/or modified sequence opt3 from neuraminidase__InfluenzaA__AEV53567
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcgcauggaucggucggacaaaaucaaucaguagccgcaauggguucgagaugauuugggauccaaacggcuggaccgaaacggacaauaacuuuuccauaaagcaagacaucgugggaauuaaugaguggucuggcuacucggggagcuucguccagcaucccgaacugacuggacugaacuguauccgaccuugcuucuggguggagcucauuagagguaggccaaaagagaauacaaucuggaccuccggcucaaguauaucuuuuugugggguuaacagcgauacugugggaugguccuggcccgacggcgccgaauuaccguucacaaucgauaaguga

SEQ ID NO: 143317 - RNA, 1410 nt, Artificial Sequence; identical to SEQ ID NO: 138754
  derived and/or modified sequence opt3 from neuraminidase__InfluenzaA__AEV53569

SEQ ID NO: 143318 - RNA, 1410 nt, Artificial Sequence; identical to SEQ ID NO: 142193
  derived and/or modified sequence opt3 from neuraminidase__InfluenzaA__AEV53571

SEQ ID NO: 143319 - RNA, 1410 nt, Artificial Sequence; identical to SEQ ID NO: 142193
  derived and/or modified sequence opt3 from neuraminidase__InfluenzaA__AEV53573

SEQ ID NO: 143320 - RNA, 1410 nt, Artificial Sequence; identical to SEQ ID NO: 140555
  derived and/or modified sequence opt3 from neuraminidase__InfluenzaA__AEV53575

SEQ ID NO: 143321 - RNA, 1410 nt, Artificial Sequence
  derived and/or modified sequence opt3 from neuraminidase__InfluenzaA__AEV53577
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcagcccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucacaaucgacaaguga

SEQ ID NO: 143322 - RNA, 1410 nt, Artificial Sequence; identical to SEQ ID NO: 143260
  derived and/or modified sequence opt3 from neuraminidase__InfluenzaA__AEV53579

SEQ ID NO: 143323 - RNA, 1410 nt, Artificial Sequence; identical to SEQ ID NO: 140555
  derived and/or modified sequence opt3 from neuraminidase__InfluenzaA__AEV53581

SEQ ID NO: 143324 - RNA, 1410 nt, Artificial Sequence; identical to SEQ ID NO: 140216
  derived and/or modified sequence opt3 from neuraminidase__InfluenzaA__AEV53583

SEQ ID NO: 143325 - RNA, 1410 nt, Artificial Sequence; identical to SEQ ID NO: 140216
  derived and/or modified sequence opt3 from neuraminidase__InfluenzaA__AEV53585

SEQ ID NO: 143326 - RNA, 1410 nt, Artificial Sequence
  derived and/or modified sequence opt3 from neuraminidase__InfluenzaA__AEV76877
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccacuaccaacuucgcugcaggccagucuguagugucggucaaacuggccgggaauagcucauugugcccugugaguggaugggcgauauacuccaaggacaacucuauuagaaucggcagcaaaggugauguuuuugugauuagggagccauucaucuccuguucaccguuagaaugccggacauuuuuccugacccagggggcucuacucaaugacaagcauaguaacggaacuaucaaagaucgcagccccuaucgaacacugaugucuuguccuauuggcgaggucccaucccccuacaauucacguuuugaaagcguggccuggagugcaucugccugccacgacggcauaaacuggcuuaccaucgggauuuccggaccugauaacggugcuguagcaguucugaaguauaauggcaucauaacggacacuauuaagagcuggagaaacaauaucuugaggacccaagagucggagugugccugcgugaacgggucuuguuucacaaucaugacugauggaccauccgacggccaggcuucauacaaaauuuuucggaucgaaaaggguaaaauugucaagaguguggagaugaaugcccccaacuaucauuacgaagagugcagcuguuacccugauuccucugagauaaccugcgugugccgcgacaauuggcacgggagcaacagaccaugggucucauucaaucagaaccucgaauaucagaucggauacauuuguaguggcaucuuuggcgauaauccgaggcccaacgacaaaacaggguccugcggaccuguuagcucuaauggugcgaacggcgugaagggguucucauuuaaguauggaaauggcguauggaucggucggaccaaaaguauuagcucccgcaagggguucgagaugauaugggauccaaacggcuggacgggaacugacaacaauuuuucuaucaaacaagacauugugggcaucaacgaauggucgggguacagcggauccuucguccagcaucccgagcugacaggucuggauuguauucgaccuugcuucuggguggaacucaucagaggcaggccaaaggagaauaccauauggacuucagggaguucuaucagcuuuuguggaguuaacuccgacacagugggcuggucauggcccgauggugcagaguuaccguucaccauugacaaauga

SEQ ID NO: 143327 - RNA, 1410 nt, Artificial Sequence; identical to SEQ ID NO: 138754
  derived and/or modified sequence opt3 from neuraminidase__InfluenzaA__AEW10576

SEQ ID NO: 143328 - RNA, 1410 nt, Artificial Sequence; identical to SEQ ID NO: 138754
  derived and/or modified sequence opt3 from neuraminidase__InfluenzaA__AEW10586

SEQ ID NO: 143329 - RNA, 1410 nt, Artificial Sequence; identical to SEQ ID NO: 138754
  derived and/or modified sequence opt3 from neuraminidase__InfluenzaA__AEW10596

SEQ ID NO: 143330 - RNA, 1410 nt, Artificial Sequence; identical to SEQ ID NO: 138754
  derived and/or modified sequence opt3 from neuraminidase__InfluenzaA__AEW10606

SEQ ID NO: 143331 - RNA, 1410 nt, Artificial Sequence; identical to SEQ ID NO: 139641
  derived and/or modified sequence opt3 from neuraminidase__InfluenzaA__AEW10616

SEQ ID NO: 143332 - RNA, 1410 nt, Artificial Sequence
  derived and/or modified sequence opt3 from neuraminidase__InfluenzaA__AEW10626
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuauggcaguacugaaguauaauggcaucauaaccgacacgauuaaguccuggagaaacaauaucuugaggacucaagagagcgagugugccugcguuaacgggucguguuucaccgugaugacagauggaccaucugacggccaggcuuccuacaaaaucuuucggauugaaaaggguaaaaucgucaagucaguggagaugaaugcccccaacuaucauuacgaagagugcaguuguuacccugauagcuccgagauuacuugcgugugccgcgacaauuggcacgggucuaacagaccaugggucagcuucaaucagaaccucgaauaucagauaggauacaucuguucaggcauuuuuggcgauaauccgaggcccaacgacaaaaccgggaguugcggaccuguuuccagcaauggugcgaacggcgugaagggguucucuuuuaaguauggaaacggcguauggaucggucggacaaaaucaaucaguagccgcaauggguucgagaugauuugggauccaaacggcuggaccggaacggacaauaacuuuuccauaaagcaagacaucgugggcauuaaugaauggucuggguacucggggagcuucguccagcaucccgagcugacuggucuggauuguauccgaccuugcuucuggguggaacucauuagaggcaggccaaaagagaacacaaucuggaccuccgggucaaguauaucuuuuuguggaguuaauagcgacacugugggcugguccuggcccgauggugcagaguuaccguucacaaucgacaaguga

SEQ ID NO: 143333 - RNA, 1410 nt, Artificial Sequence; identical to SEQ ID NO: 138754
  derived and/or modified sequence opt3 from neuraminidase__InfluenzaA__AEW10636

SEQ ID NO: 143334 - RNA, 1410 nt, Artificial Sequence; identical to SEQ ID NO: 138744
  derived and/or modified sequence opt3 from neuraminidase__InfluenzaA__AEW10646

SEQ ID NO: 143335 - RNA, 1410 nt, Artificial Sequence; identical to SEQ ID NO: 138754
  derived and/or modified sequence opt3 from neuraminidase__InfluenzaA__AEW10656

SEQ ID NO: 143336 - RNA, 1410 nt, Artificial Sequence; identical to SEQ ID NO: 138754
  derived and/or modified sequence opt3 from neuraminidase__InfluenzaA__AEW10666

SEQ ID NO: 143337 - RNA, 1410 nt, Artificial Sequence; identical to SEQ ID NO: 138754
  derived and/or modified sequence opt3 from neuraminidase__InfluenzaA__AEW10676

SEQ ID NO: 143338 - RNA, 1410 nt, Artificial Sequence; identical to SEQ ID NO: 138754
  derived and/or modified sequence opt3 from neuraminidase__InfluenzaA__AEW10686

SEQ ID NO: 143339 - RNA, 1410 nt, Artificial Sequence; identical to SEQ ID NO: 138754
  derived and/or modified sequence opt3 from neuraminidase__InfluenzaA__AEW10696

SEQ ID NO: 143340 - RNA, 1410 nt, Artificial Sequence; identical to SEQ ID NO: 138754
  derived and/or modified sequence opt3 from neuraminidase__InfluenzaA__AEW10706

SEQ ID NO: 143341 - RNA, 1410 nt, Artificial Sequence; identical to SEQ ID NO: 138744
  derived and/or modified sequence opt3 from neuraminidase__InfluenzaA__AEW10716

SEQ ID NO: 143342 - RNA, 1410 nt, Artificial Sequence; identical to SEQ ID NO: 138754
  derived and/or modified sequence opt3 from neuraminidase__InfluenzaA__AEW10726

SEQ ID NO: 143343 - RNA, 1410 nt, Artificial Sequence; identical to SEQ ID NO: 138754
  derived and/or modified sequence opt3 from neuraminidase__InfluenzaA__AEW10736

SEQ ID NO: 143344 - RNA, 1410 nt, Artificial Sequence; identical to SEQ ID NO: 138744
  derived and/or modified sequence opt3 from neuraminidase__InfluenzaA__AEW10746

SEQ ID NO: 143345 - RNA, 1410 nt, Artificial Sequence; identical to SEQ ID NO: 138744
  derived and/or modified sequence opt3 from neuraminidase__InfluenzaA__AEW10756

SEQ ID NO: 143346 - RNA, 1410 nt, Artificial Sequence; identical to SEQ ID NO: 138744
  derived and/or modified sequence opt3 from neuraminidase__InfluenzaA__AEW10766

SEQ ID NO: 143347 - RNA, 1410 nt, Artificial Sequence; identical to SEQ ID NO: 138744
  derived and/or modified sequence opt3 from neuraminidase__InfluenzaA__AEW10776

SEQ ID NO: 143348 - RNA, 1410 nt, Artificial Sequence; identical to SEQ ID NO: 138744
  derived and/or modified sequence opt3 from neuraminidase__InfluenzaA__AEW10786

SEQ ID NO: 143349 - RNA, 1410 nt, Artificial Sequence; identical to SEQ ID NO: 138744
  derived and/or modified sequence opt3 from neuraminidase__InfluenzaA__AEW10796

SEQ ID NO: 143350 - RNA, 1410 nt, Artificial Sequence; identical to SEQ ID NO: 138744
  derived and/or modified sequence opt3 from neuraminidase__InfluenzaA__AEW10806

SEQ ID NO: 143351 - RNA, 1410 nt, Artificial Sequence; identical to SEQ ID NO: 138744
  derived and/or modified sequence opt3 from neuraminidase__InfluenzaA__AEW10816

SEQ ID NO: 143352 - RNA, 1410 nt, Artificial Sequence; identical to SEQ ID NO: 138754
  derived and/or modified sequence opt3 from neuraminidase__InfluenzaA__AEW10826

SEQ ID NO: 143353 - RNA, 1410 nt, Artificial Sequence; identical to SEQ ID NO: 138744
  derived and/or modified sequence opt3 from neuraminidase__InfluenzaA__AEW10836

SEQ ID NO: 143354 - RNA, 1410 nt, Artificial Sequence; identical to SEQ ID NO: 138744
  derived and/or modified sequence opt3 from neuraminidase__InfluenzaA__AEW10846

SEQ ID NO: 143355 - RNA, 1410 nt, Artificial Sequence; identical to SEQ ID NO: 138744
  derived and/or modified sequence opt3 from neuraminidase__InfluenzaA__AEW10856

SEQ ID NO: 143356 - RNA, 1410 nt, Artificial Sequence; identical to SEQ ID NO: 138744
  derived and/or modified sequence opt3 from neuraminidase__InfluenzaA__AEW10866

SEQ ID NO: 143357 - RNA, 1410 nt, Artificial Sequence; identical to SEQ ID NO: 138744
  derived and/or modified sequence opt3 from neuraminidase__InfluenzaA__AEW10876

SEQ ID NO: 143358 - RNA, 1410 nt, Artificial Sequence; identical to SEQ ID NO: 138744
  derived and/or modified sequence opt3 from neuraminidase__InfluenzaA__AEW10886

SEQ ID NO: 143359 - RNA, 1410 nt, Artificial Sequence; identical to SEQ ID NO: 138744
  derived and/or modified sequence opt3 from neuraminidase__InfluenzaA__AEW10896

SEQ ID NO: 143360 - RNA, 1410 nt, Artificial Sequence; identical to SEQ ID NO: 138744
  derived and/or modified sequence opt3 from neuraminidase__InfluenzaA__AEW10906

SEQ ID NO: 143361 - RNA, 1410 nt, Artificial Sequence; identical to SEQ ID NO: 138744
  derived and/or modified sequence opt3 from neuraminidase__InfluenzaA__AEW10916

SEQ ID NO: 143362 - RNA, 1410 nt, Artificial Sequence
  derived and/or modified sequence opt3 from neuraminidase__InfluenzaA__AEW10926
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuuauuaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggugccaucucccuacaacucccguuuugaaucagucgccuggagcgcaagugccugccacgacggcaucaauuggcuuacaauugggaucucuggaccugauaacggugcuguggcaguacugaaguauaauggcauaauuaccgacacgaucaaguccuggagaaacaauaucuugaggacucaagagagcgagugugccugcguuaacgggucguguuucaccgugaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcaauggguucgagaugauaugggauccaaacggcuggaccggaacggacaauaacuuuuccaucaagcaagacauugugggcaucaaugaauggucuggguacucggggagcuucguccagcaucccgagcugacuggucuggauuguauucgaccuugcuucuggguggaacucaucagaggcaggccaaaagagaacacaauauggaccuccgggucaaguaucucuuuuuguggaguuaauagcgacacugugggcugguccuggcccgauggugcagaguuaccguucacaauugacaaguga

SEQ ID NO: 143363 - RNA, 1410 nt, Artificial Sequence; identical to SEQ ID NO: 138744
  derived and/or modified sequence opt3 from neuraminidase__InfluenzaA__AEW10936

SEQ ID NO: 143364 - RNA, 1410 nt, Artificial Sequence; identical to SEQ ID NO: 138744
  derived and/or modified sequence opt3 from neuraminidase__InfluenzaA__AEW10946

SEQ ID NO: 143365 - RNA, 1410 nt, Artificial Sequence; identical to SEQ ID NO: 138754
  derived and/or modified sequence opt3 from neuraminidase__InfluenzaA__AEW10956

SEQ ID NO: 143366 - RNA, 1410 nt, Artificial Sequence; identical to SEQ ID NO: 138754
  derived and/or modified sequence opt3 from neuraminidase__InfluenzaA__AEW10966

SEQ ID NO: 143367 - RNA, 1410 nt, Artificial Sequence; identical to SEQ ID NO: 138744
  derived and/or modified sequence opt3 from neuraminidase__InfluenzaA__AEW10976

SEQ ID NO: 143368 - RNA, 1410 nt, Artificial Sequence; identical to SEQ ID NO: 138754
  derived and/or modified sequence opt3 from neuraminidase__InfluenzaA__AEW10986

SEQ ID NO: 143369 - RNA, 1410 nt, Artificial Sequence; identical to SEQ ID NO: 138754
  derived and/or modified sequence opt3 from neuraminidase__InfluenzaA__AEW10996

SEQ ID NO: 143370 - RNA, 1410 nt, Artificial Sequence; identical to SEQ ID NO: 138754
  derived and/or modified sequence opt3 from neuraminidase__InfluenzaA__AEW11006

SEQ ID NO: 143371 - RNA, 1410 nt, Artificial Sequence; identical to SEQ ID NO: 138754
  derived and/or modified sequence opt3 from neuraminidase__InfluenzaA__AEW11016

SEQ ID NO: 143372 - RNA, 1410 nt, Artificial Sequence; identical to SEQ ID NO: 138754
  derived and/or modified sequence opt3 from neuraminidase__InfluenzaA__AEW11026

SEQ ID NO: 143373 - RNA, 1410 nt, Artificial Sequence; identical to SEQ ID NO: 138754
  derived and/or modified sequence opt3 from neuraminidase__InfluenzaA__AEW11036

SEQ ID NO: 143374 - RNA, 1410 nt, Artificial Sequence; identical to SEQ ID NO: 138744
  derived and/or modified sequence opt3 from neuraminidase__InfluenzaA__AEW11046

SEQ ID NO: 143375 - RNA, 1410 nt, Artificial Sequence; identical to SEQ ID NO: 138754
  derived and/or modified sequence opt3 from neuraminidase__InfluenzaA__AEW11056

SEQ ID NO: 143376 - RNA, 1410 nt, Artificial Sequence; identical to SEQ ID NO: 139558
  derived and/or modified sequence opt3 from neuraminidase__InfluenzaA__AEW11066

SEQ ID NO: 143377 - RNA, 1410 nt, Artificial Sequence; identical to SEQ ID NO: 139558
  derived and/or modified sequence opt3 from neuraminidase__InfluenzaA__AEW11076

SEQ ID NO: 143378 - RNA, 1410 nt, Artificial Sequence; identical to SEQ ID NO: 139558
  derived and/or modified sequence opt3 from neuraminidase__InfluenzaA__AEW11086

SEQ ID NO: 143379 - RNA, 1410 nt, Artificial Sequence; identical to SEQ ID NO: 139558
  derived and/or modified sequence opt3 from neuraminidase__InfluenzaA__AEW11096

SEQ ID NO: 143380 - RNA, 1410 nt, Artificial Sequence; identical to SEQ ID NO: 139558
  derived and/or modified sequence opt3 from neuraminidase__InfluenzaA__AEW11106

SEQ ID NO: 143381 - RNA, 1410 nt, Artificial Sequence; identical to SEQ ID NO: 138754
  derived and/or modified sequence opt3 from neuraminidase__InfluenzaA__AEW11116

SEQ ID NO: 143382 - RNA, 1410 nt, Artificial Sequence; identical to SEQ ID NO: 139558
  derived and/or modified sequence opt3 from neuraminidase__InfluenzaA__AEW11126

SEQ ID NO: 143383 - RNA, 1410 nt, Artificial Sequence; identical to SEQ ID NO: 139462
  derived and/or modified sequence opt3 from neuraminidase__InfluenzaA__AEW11136

SEQ ID NO: 143384 - RNA, 1410 nt, Artificial Sequence; identical to SEQ ID NO: 138754
  derived and/or modified sequence opt3 from neuraminidase__InfluenzaA__AEW11146

SEQ ID NO: 143385 - RNA, 1410 nt, Artificial Sequence; identical to SEQ ID NO: 138754
  derived and/or modified sequence opt3 from neuraminidase__InfluenzaA__AEW11156

SEQ ID NO: 143386 - RNA, 1410 nt, Artificial Sequence; identical to SEQ ID NO: 139558
  derived and/or modified sequence opt3 from neuraminidase__InfluenzaA__AEW11166

SEQ ID NO: 143387 - RNA, 1410 nt, Artificial Sequence; identical to SEQ ID NO: 139558
  derived and/or modified sequence opt3 from neuraminidase__InfluenzaA__AEW11176

SEQ ID NO: 143388 - RNA, 1410 nt, Artificial Sequence; identical to SEQ ID NO: 138754
  derived and/or modified sequence opt3 from neuraminidase__InfluenzaA__AEW11186

SEQ ID NO: 143389 - RNA, 1410 nt, Artificial Sequence; identical to SEQ ID NO: 139558
  derived and/or modified sequence opt3 from neuraminidase__InfluenzaA__AEW11196

SEQ ID NO: 143390 - RNA, 1410 nt, Artificial Sequence; identical to SEQ ID NO: 138754
  derived and/or modified sequence opt3 from neuraminidase__InfluenzaA__AEW11206

SEQ ID NO: 143391 - RNA, 1410 nt, Artificial Sequence; identical to SEQ ID NO: 138754
  derived and/or modified sequence opt3 from neuraminidase__InfluenzaA__AEW11216

SEQ ID NO: 143392 - RNA, 1410 nt, Artificial Sequence; identical to SEQ ID NO: 139462
  derived and/or modified sequence opt3 from neuraminidase__InfluenzaA__AEW11226

SEQ ID NO: 143393 - RNA, 1410 nt, Artificial Sequence; identical to SEQ ID NO: 138754
  derived and/or modified sequence opt3 from neuraminidase__InfluenzaA__AEW11236

SEQ ID NO: 143394 - RNA, 1410 nt, Artificial Sequence; identical to SEQ ID NO: 138754
  derived and/or modified sequence opt3 from neuraminidase__InfluenzaA__AEW11246

SEQ ID NO: 143395 - RNA, 1410 nt, Artificial Sequence; identical to SEQ ID NO: 139558
  derived and/or modified sequence opt3 from neuraminidase__InfluenzaA__AEW11255

SEQ ID NO: 143396 - RNA, 1410 nt, Artificial Sequence; identical to SEQ ID NO: 139558
  derived and/or modified sequence opt3 from neuraminidase__InfluenzaA__AEW11265

SEQ ID NO: 143397 - RNA, 1410 nt, Artificial Sequence; identical to SEQ ID NO: 138754
  derived and/or modified sequence opt3 from neuraminidase__InfluenzaA__AEW11275

SEQ ID NO: 143398 - RNA, 1410 nt, Artificial Sequence
  derived and/or modified sequence opt3 from neuraminidase__InfluenzaA__AEW11285
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucuaauggccaggcuuccuacaaaaucuuucggaucgaaaaggguaaaauugugaagucagucgagaugaacgcccccaauuaucauuacgaagagugcaguuguuacccugacagcuccgagaucacuugcguuugccgcgauaacuggcacgggucuaauagaccaugggugagcuucaaccagaaucucgaauaucagauuggauacauauguucaggcaucuuuggcgacaacccgaggcccaaugauaaaaccgggaguugcggaccuguauccagcaacggugcgaacggcgugaagggguucucuuuuaaguauggaaauggcgucuggauuggucggacaaaaucaaucaguagccgcaacggguucgagaugaucugggacccaaauggcuggaccggaacggauaacaauuuuuccauuaagcaagacauagugggcaucaacgaauggucuggguacucggggagcuucguucagaaucccgagcugacuggucuggacuguauucgaccuugcuucuggguggaacucaucagaggcaggccaaaagagaacacaauuuggaccuccgggucaaguaucucuuuuuguggagucaauagcgauacugugggcugguccuggcccgacggugcagaguuaccguucacaauagauaaguga

SEQ ID NO: 143399 - RNA, 1410 nt, Artificial Sequence; identical to SEQ ID NO: 139558
  derived and/or modified sequence opt3 from neuraminidase__InfluenzaA__AEW11295

SEQ ID NO: 143400 - RNA, 1410 nt, Artificial Sequence; identical to SEQ ID NO: 138754
  derived and/or modified sequence opt3 from neuraminidase__InfluenzaA__AEW11305

SEQ ID NO: 143401 - RNA, 1410 nt, Artificial Sequence; identical to SEQ ID NO: 139558
  derived and/or modified sequence opt3 from neuraminidase__InfluenzaA__AEW11315

SEQ ID NO: 143402 - RNA, 1410 nt, Artificial Sequence; identical to SEQ ID NO: 138754
  derived and/or modified sequence opt3 from neuraminidase__InfluenzaA__AEW11325

SEQ ID NO: 143403 - RNA, 1410 nt, Artificial Sequence; identical to SEQ ID NO: 138754
  derived and/or modified sequence opt3 from neuraminidase__InfluenzaA__AEW25299

SEQ ID NO: 143404 - RNA, 1410 nt, Artificial Sequence; identical to SEQ ID NO: 138754
  derived and/or modified sequence opt3 from neuraminidase__InfluenzaA__AEW25308

SEQ ID NO: 143405 - RNA, 1410 nt, Artificial Sequence; identical to SEQ ID NO: 139827
  derived and/or modified sequence opt3 from neuraminidase__InfluenzaA__AEW25317

SEQ ID NO: 143406 - RNA, 1410 nt, Artificial Sequence; identical to SEQ ID NO: 138754
  derived and/or modified sequence opt3 from neuraminidase__InfluenzaA__AEW25324

SEQ ID NO: 143407 - RNA, 1410 nt, Artificial Sequence
  derived and/or modified sequence opt3 from neuraminidase__InfluenzaA__AEW25327
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccacccccuuacaacucucguuuugaauccguggccuggucagcaagcgccugccacgacggcauaaauuggcuuacaaucgggauuaguggaccagauaacggugcuguagcaguucugaaguauaauggcaucauaaccgacacgauuaagucuuggagaaacaauaucuugaggacucaagaguccgagugugccugcgugaacgggagcuguuucaccgucaugacagauggacccucggacggccaggcuucuuacaaaaucuuucggauugaaaaggguaaaaucgugaaguccguggagaugaaugccccuaacuaucauugcgaagaguguucaugcuacccagauaguagcgagauuacuugcgucugucgcgacaauuggcacggguccaacagaccguggguuucuuucaaucagaaccucgaauaccagauaggauauaucugcagcggcauuuuuggcgauaaucccaggccuaacgacaaaaccgggucauguggaccagugaguuccaauggugcgaacggcguaaagggguucagcuuuaaguacggaaacggcguguggaucggucggacaaaaucuaucucaagucgcaauggguucgagaugauuugggaucccaacggcuggaccggaacggacaauaacuuuagcauaaagcaagacaucgucggcauuaaugaaugguccggguauucuggaucguucgugcagcauccugagcugacuggucuggauugcauccgaccauguuucuggguugaacucauuagaggcaggcccaaagagaacacaaucuggaccagcggguccucaauaaguuuuugcggagucaauucugacacugugggcuggagcuggccggauggugcagaguuaccuuucacaaucgacaaguga

SEQ ID NO: 143408 - RNA, 1410 nt, Artificial Sequence
  derived and/or modified sequence opt3 from neuraminidase__InfluenzaA__AEW25333
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucauacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcacucaaacggaaccaucaaagaucgcagucccuaucgaacucugaugagcuguccuauuggcgaggucccaucucccuacaacucccguuuugaaucaguggccuggagcgcaagugccugccaugacggcauaaauuggcuuacaaucgggauuucuggaccugauaacggugcuguagcaguucugaaguauaauggcaucauaaccgacacgauuaaguccuggagaaacaauaucuugaggacucaggagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucacuacgaagagugcaguuguuacccugauagcuccgagauuacuugcgucugccgcgacaauuggcaugggucuaacagaccauggguuagcuucaaucaaaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcgugugggucggucggacaaaaucaaucaguagccgcaauggguucgagaugaucugggauccaaacggcuggaccggaacggacaauaacuuuuccauuaagcaggacauagugggcaucaaugaauggucuggguacucggggagcuucguucaacaccccgagcugacuggucuggauuguauucgacacugcuucuggguggaacucaucagaggcaggccuaaagagaacacaauuuggaccuccgggucaaguaucucuuuuuguggagucaauagcgacacugugggcugguccuggccagauggugcagaguuacccuucacaauagacaaguga

SEQ ID NO: 143409 - RNA, 1410 nt, Artificial Sequence
  derived and/or modified sequence opt3 from neuraminidase__InfluenzaA__AEW25338
augaaccccaaucagaagaucauuaccauaggcagcgugugcauggccaucgggauggcuaaccugauucuccaaaucggaaauauuaucuccauauggaucucucacucaauucagcuugguaaccagaaucagaucgagacauguaaccaaagugucauuacuuacgaaaauaacacguggguuaaucagaccuaugugaacaucagcaauacaaacuucgcagccggccaguccguagugucugucaaacuggcgggaaauucgucauugugcccugugagcggaugggcuauauacaguaaggacaacuccauuagaaucggcucuaaaggugauguuuuugugauuagggagccauucaucagcuguuccccguuagaaugccggaccuuuuuccugacucagggggcccuacucaaugacaagcauucaaacggaacaaucaaagaucgcagucccuaucgaacccugaugagcuguccuauuggcgaggucccaucucccuacaacucccguuuugaaucaguggcauggagcgccagugcuugccacgacggcauaaauuggcuuacuaucgggauuucuggaccugauaacggugcaguagccguucugaaguauaauggcaucauaacagacaccauuaaguccuggagaaacaauaucuugaggacgcaagagagcgagugugcuugcgugaacgggucguguuucacugucaugaccgauggaccaucugacggccaggccuccuacaaaaucuuucggauugaaaaggguaaaaucgugaagucaguggagaugaaugcgcccaacuaucauuacgaagagugcaguuguuacccugauagcuccgagauuacaugcgucugccgcgacaauuggcacgggucuaacagaccauggguuagcuucaaucagaaccucgaauaucagauaggauacaucaggucaggcauuuuuggcgauaauccgcggcccaacgacaaaacugggaguuguggaccuguguccagcaauggugcaaacggcguaaagggguucucuuuuaaguauggaaacggcguguggaucggucgcaccaaaucaaucaguagccgaaauggguucgagaugauuugggauccaaacggcuggacaggaaccgacaauaacuuuuccauaaagcaagacaucgucggcauuaaugaauggucuggguacucggggagcuucgugcagcaucccgagcugacgggucuggauugcaucagaccuuguuucuggguugaacucauuaggggccggccaaaagagaacacuaucuggacauccgggucaaguauaucuuuuugcggagugaauagcgacaccgucggcugguccuggcccgauggugccgaguuaccguucacuaucgacaaguga

SEQ ID NO: 143410 - RNA, 1410 nt, Artificial Sequence
  derived and/or modified sequence opt3 from neuraminidase__InfluenzaA__AEW25343
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguucagaaagcguggccuggagugcaucugccugccacgacggcauaaauuggcuuacaaucgggauuuccggaccugauaacggugcuguagcaguucugaaguauaauggcaucauaaccgacacgauuaagagcuggagaaacaauaucuugaggacucaagagucggugugugccugcgucaacgggucuuguuuuaccgugaugacagauggaccauccgacggccaggcuucauacaaaaucuuccggauugagaaggguaaaaucgugaagagugucgaaaugaaugcccccaacuaucauuacgaggaaugcagcuguuacccugauuccucugagauuacuugcguuugccgcgacaauuggcacgggagcaacagaccaugggugucauuuaaucagaaccucgaguaucagauaggauacaucuguaguggcauuuucggcgauuccccgaggcccaaugacaaaaccgggagcugcggaccuguaucuucaaacggugcgaauggcgugaagggguuuaguuucaaguauggaaacggcgucuggaucggucggacaaaaagcaucuccucucgcaacggguuugaaaugauuugggauccaaauggcuggaccggaacggacaacaauuucucgauaaagcaagacaucgugggcauuaacgaguggagcggguacuccggaucauuuguucagcaucccgaacugacuggucuggauuguauccgaccuugcuucuggguggagcucauuagaggcaggccaaaagaaaauacaaucuggaccagugggucuagcauauccuucuguggagucaacucagacacugugggcuggagcuggcccgauggugcagaguuaccguuuacaaucgacaaguga

SEQ ID NO: 143411 - RNA, 1410 nt, Artificial Sequence
  derived and/or modified sequence opt3 from neuraminidase__InfluenzaA__AEW25351
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucauacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcacucaaacggaaccaucaacgaucgcagucccuaucgaacucugaugagcuguccuauuggcgaggucccaucucccuacaauucccguuuugaaucaguggccuggagcgcaagugccugccaugacggcauaaacuggcuuacaaucgggauuucuggaccugauaauggugcuguagcaguucugaaauauaacggcaucauaaccgacacgauuaaguccuggagaaauaacaucuugaggacucaggagagcgagugugccugcgugaaugggucguguuucaccgucaugacagauggaccaucugacggccaggcuuccuacaagaucuuucggauugaaaaagguaagaucgugaaaucaguggagaugaacgcccccaauuaucacuacgaagagugcaguuguuacccugauagcuccgagauuacuugcgucugccgcgacaacuggcaugggucuaauagaccauggguuagcuucaaccaaaaucucgaauaucagauaggauacaucuguucaggcaccuuuggcgauaacccgaggcccaaugacaagacagggaguugcggaccuguguccagcaacggugcgaacggcguaaaaggguucucuuuuaaguauggaaauggcguguggauuggucggaccaagucaaucaguagccgcaacggguucgagaugaucugggauccaaauggcuggacgggaacugacaacaauuuuuccauuaaacaggacauagucggcaucaacgaauggucuggguacucggggagcuucgugcaacaccccgagcugacaggucuggauuguauucgaccuugcuucuggguugaacucaucagaggcaggccaaaggagaauaccauuuggacuuccgggucaaguaucucuuuuuguggagugaacagcgacacagucggcugguccuggcccgauggugcagaguuaccguucaccauagacaaauga

SEQ ID NO: 143412 - RNA, 1410 nt, Artificial Sequence
  derived and/or modified sequence opt3 from neuraminidase__InfluenzaA__AEW25358
augaaccccaaucagaagaucauuaccauaggcagcgugugcaugacaaucgggauggccaaccugauucuccaaaucggaaauauuaucuccauaugggucucucacucaauccagcuugguaaccagaaucagauugagacuuguaaccaaaguguuaucacguacgaaaauaacaccugggugaaucagacauauguaaacauuagcaauacuaacuucgcugcaggccaguccguggucucugugaaacuggccggaaauucgucauugugcccuguuagcggaugggcgaucuacaguaaggacaacuccauaagaauuggcucuaaaggugauguguuugucaucagggagccauucaccagcuguuccccguuagaaugccggacauuuuuccugacccagggggcucuacucaaugacaagcauucaaacggaacuauuaaagaucgcagucccuaucgaacacugaugagcuguccuaucggcgaggugccaucucccuacaacucccguuuugaaucaguagccuggagcgcaagugccugccacgacggcaucaauuggcuuaccauugggauaucuggaccugauaacggugcuguugcagugcugaaguauaauggcaucauuacggacacuaucaaguccuggagaaacaauauauugaggacccaagagagcgagugugccugcgucaacgggucguguuucacagugaugacugauggaccaucugacggccaggcuuccuacaaaauuuuucggaucgaaaaggguaaaaucgugaagucagucgagaugaaugcccccaacuaucauuacgaagagugcaguuguuacccugauagcuccgagauuaccugcguuugccgcgacaauuggcacgggucuaacagaccaugggugagcuucaaucagaaccucgaauaucagaucggauacauuuguucaggcauauuuggcgauaauccgaggcccaacgacaaaacagggaguugcggaccuguauccagcaauggugcgaacggcgugaagggguucucuuuuaaguauggaaacggcgucuggaucggucggaccaaaucaauuaguagccgcaauggguucgagaugaucugggauccaaacggcuggacgggaacugacaauaacuuuuccaucaagcaagacauugugggcauaaaugaauggucuggguacucggggagcuucguucagcaucccgagcugacaggucuggauuguauccgaccuugcuucuggguggaacucauuagaggcaggccaaaagagaacaccaucuggacuuccgggucaaguauuucuuuuuguggagucaauagcgacacagugggcugguccuggcccgauggugcagaguuaccguucaccaucguaaaguga

SEQ ID NO: 143413 - RNA, 1410 nt, Artificial Sequence; identical to SEQ ID NO: 138754
  derived and/or modified sequence opt3 from neuraminidase__InfluenzaA__AEW25361

SEQ ID NO: 143414 - RNA, 1410 nt, Artificial Sequence
  derived and/or modified sequence opt3 from neuraminidase__InfluenzaA__AEW25379
augaaccccaaucagaagaucauuaccauaggcagcgugugcaugacaaucgggauggccaaccugauucuccaaaucggaaauauuaucuccauauggacuucucacucaauccagcuugguaaccagaaucagauugagacguguaaccaaagugucaucaccuacgaaaauaacacauggguuaaucagacuuaugugaacauuagcaauaccaacuucgcugcaggccaguccguagugucugucaaacuggccggaaauucgucauugugcccugugagcggaugggcgaucuacaguaaggacaacuccauaagaauuggcucuaaaggugauguuuuugugaucagggagccauucauuagcuguuccccguuagaaugccggacauuuuuccugacccagggggcucuacucaaugacaagcauucaaacggaacuaucaaagaucgcagucccuaucgaacacugaugagcuguccuaucggcgaggucccaucucccuacaacucccguuuugaaucaguggccuggagcgcaagugccugccacgacggcauuaauuggcuuaccauagggaucucuggaccugauaacggugcuguagcaguucugaaguauaauggcauuaucacggacacuauaaaguccuggagaaacaauauuuugaggacccaagagagcgagugugccugcgugaacgggucguguuucacagucaugacugauggaccaucugacggccaggcuuccuacaaaaucuuucggaucgaaaaggguaaaauugugaagucaguggagaugaaugcccccaacuaucauuacgaagagugcaguuguuacccugauagcuccgagguuaccugcgucugccgcgacaauuggcacgggucuaacagaccaugggugagcuucaaucagaaccucgaauaucagaucggauacauuuguucaggcauauuuggcgauaauccgaggcccaacgacaaaacagggaguugcggaccuguauccagcgauggugcgaauggcgugaagggguucucuuuuaaguauggaaacggcgucuggaucggucggaccaaaucaauuaguagccgcaacggguucgagaugaucugggacccaaauggcuggacgggaacugacaacaauuuuuccaucaagcaagauauugugggcauaaacgaauggucuggguacucggggagcuucguucagcaucccgagcugacaggucuggacuguauccgaccuugcuucuggguggaacucauuagaggcaggccaaaagagaauaccaucuggacuuccgggucaaguauuucuuuuuguggagucaacagcgauacagugggcugguccuggcccgacggugcagaguuaccguucaccaucgauaaguga

SEQ ID NO: 143415 - RNA, 1410 nt, Artificial Sequence
  derived and/or modified sequence opt3 from neuraminidase__InfluenzaA__AEW25387
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcguggaugggucguguuucaccgucaugacagacggaccaucugauggccaggcuuccuacaaaaucuuucggauugaaaaggguaaaaucgugaagucaguggagaugaacgcccccaauuaucauuacgaagagugcaguuguuacccugacagcuccgagauuacuugcgucugccgcgauaacuggcacgggucuaauagaccauggguuagcuucaaccagaaucucgaauaucagauaggauacaucuguucaggcauuuuugaggacaacccgaggcccaaugauaaaaccggcaguugcgggccuguguccagcaacggagcgaaugguguaaagggcuucucuuuuaaguaugggaacggaguguggaucggccggacaaaaucaaucaguagccgcaacgguuucgaaaugauuugggacccaaauggguggaccggcacggacaacaauuuuuccauaaagcaagauaucgucggaauuaacgaguggucuggcuacucggggagcuucgugcagcaucccgaacugacuggacuggacuguauccgaccuugcuucuggguugagcucauuagagguaggccaaaagagaauacaaucuggaccuccggcucaaguauaucuuuuuguggggugaacagcgauacugucggaugguccuggcccgacggcgcagaauuaccguucacaaucgauaaguga

SEQ ID NO: 143416 - RNA, 1410 nt, Artificial Sequence
  derived and/or modified sequence opt3 from neuraminidase__InfluenzaA__AEW25392
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaugacaucgucggcauuaaugaauggucuggguacucggggagcuucgugcaacaccccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucacaaucgacaaguga

SEQ ID NO: 143417 - RNA, 1410 nt, Artificial Sequence
  derived and/or modified sequence opt3 from neuraminidase__InfluenzaA__AEW25397
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaccuguggccuggucagcaagcgccugccacgacggcauaaauuggcuuacaaucgggauuaguggaccagauaacggugcuguagcaguucugaaguauaauggcaucauaaccgacacgauuaagucuuggagaaacaauaucuugaggacucaagaguccgagugugccugcgugaacgggagcuguuucaccgucaugacagauggacccucggacggccaggcuucuuacaaaaucuuucggauugaaaaggguaaaaucgugaaguccguggagaugaaugccccuaacuaucauuacgaagagugcucauguuacccagauaguagcgagauuacuugcgucugccgcgacaauuggcacggguccaacagaccguggguuucuuucaaucagaaccucgaauaucagauaggauacaucuguagcggcauuuuuggcgauucacccaggccuaaugacaaaaccgggaguugcggaccaguguccagcaacggugcgaauggcguaaagggguucucuuuuaaguauggaaacggcguguggaucggucggacaaaaucaaucaguagccgcaacggguucgagaugauuugggaucccaauggcuggaccggaacggacaacaauuuuuccauaaagcaagacaucgucggcauuaacgaauggucuggguacucggggagcuucgugcagcauccugagcugacuggucuggauuguauccgaccaugcuucuggguugaacucauuagaggcaggcccaaagagaauacaaucuggaccuccgggucaaguauaucuuuuuguggagugaacagcgacaaugucggcugguccuggccggauggugcagaguuaccuuucacuaucgacaaguga

SEQ ID NO: 143418 - RNA, 1410 nt, Artificial Sequence; identical to SEQ ID NO: 138754
  derived and/or modified sequence opt3 from neuraminidase__InfluenzaA__AEW25402

SEQ ID NO: 143419 - RNA, 1410 nt, Artificial Sequence; identical to SEQ ID NO: 138754
  derived and/or modified sequence opt3 from neuraminidase__InfluenzaA__AEW25407

SEQ ID NO: 143420 - RNA, 1410 nt, Artificial Sequence
  derived and/or modified sequence opt3 from neuraminidase__InfluenzaA__AEW25418
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucauacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcacucaaacggaaccaucaaagaucgcagucccuaucgaacucugaugagcuguccuauuggcgaggucccaucucccuacaacucccguuuugaaucaguggccuggagcgcaagugccugccaugacggcauaaauuggcuuacaaucgggauuucuggaccugauaacggugcuguagcaguucugaaguauaauggcaucauaaccgacacgauuaaguccuggagaaacaauaucuugaggacucaggagagcgagugugccugcgugaacgggucguguuucaccgucaugacagauggaccaucugacggccaggcuuccuacaaaaucuuucggauugguaaggggaaaaucgugaagucaguggaaaugaaugcccccaacuaucacuacgaggaaugcaguuguuacccugauagcuccgagauuacuugcgucugccgcgacaauuggcauggaucuaacagaccauggguuagcuucaaucaaaaccucgaguaucagauaggcuacaucuguucaggcauuuuuggggauaauccgaggcccaacgacaaaaccggaaguugcgguccuguguccagcaauggcgaaaacgggguaaagggauucucuuuuaaguauggcaacgguguguggaucgggcggacaaaaucaaucaguagccgcaauggcuucgagaugauuugggauccaaacggauggaccggcacggacaauaacuuuuccauaaagcaggacaucgucgggauuaaugaauggucuggauacucggguagcuucgugcaacaccccgagcugacuggccuggauuguauccgaccuugcuucuggguugaacucauuagagggaggccaaaagagaacacaaucuggaccuccggaucaaguauaucuuuuuguggcgugaauagcgacacugucgguugguucuggcccgauggggcggaguuaccguuuacaaucgacaaguga

SEQ ID NO: 143421 - RNA, 1410 nt, Artificial Sequence
  derived and/or modified sequence opt3 from neuraminidase__InfluenzaA__AEW25423
augaaccccaaucagaagaucauuaccauaggcagcgugugcaugacaaucgggauggccaaccugauucuccaaaucggaaauauuaucuccauauggaucucuaacucaauucagcuugguaaucagaaccagaucgagacuuguaaucaaagugucauuacguacgaaaacaauaccuggguuaaccagacauaugugaauaucagcaacacuaauuucgcugcaggccaguccguagugucugucaaacuggccgggaacucgucauugugcccugugagcggaugggcgauauacaguaaggacaauuccauuagaaucggcucuaaaggugauguuuuugugauuagggagccauucaucagcuguuccccguuagaaugccggaccuuuuuccugacacagggggcucuacucaacgacaagcacucaaacggaaccaucaaagaucgcagucccuaucgaacucugaugagcuguccuauuggcgaggucccaucucccuacaauucccguuuugaaucaguggccuggagcgcaagugccugccaugacggcauaaacuggcuuacaaucgggauuucuggaccugauaauggugcuguagcaguucugaaguauaacggcaucauaaccgacacgauuaaguccuggagaaauaacaucuugaggacucaagagagcgagugugccugcgugaaugggucguguuucaccgucaugacagauggaccaucugacggccaggcuuccuacaaaaucuuucggauugaaaaggguaaaaucgugaagucaguggagaugaacgcccccaauuaucacuacgaagagugcaguuguuacccugauagcuccgagauuacuugcgucugccgcgacaacuggcaugggucuaauagaccauggguuagcuucaaccagaaucucgaauaucagauaggauacaucuguucaggcauuuuuggcgauaacccgaggcccaaugacaaaaccgggaguugcggaccuguguccagcaacggugcgaacggcguaaagggguucucuuuuaaguauggaaauggcguguggaucggucggacaaaaucaaucaguagccgcaacggguucgagaugauuugggauccaaauggcuggaccggaacggacaacaauuuuuccauaaagcaagacaucgucggcauuaacgaauggucuggguacucggguagcuucgugcagcaccccgagcugacuggacuggauuguauccgaccuugcuucuggguugaacucauuagaggcaggccaaaagagaauacaaucuggaccuccgggucaaguauaucuuuuuguggagugaacagcgacacugucggcugguccuggcccgauggugcagaguuaccguucacaaucgacaaguga

SEQ ID NO: 143422 - RNA, 1410 nt, Artificial Sequence; identical to SEQ ID NO: 138754
  derived and/or modified sequence opt3 from neuraminidase__InfluenzaA__AEW25426

SEQ ID NO: 143423 - RNA, 1410 nt, Artificial Sequence
  derived and/or modified sequence opt3 from neuraminidase__InfluenzaA__AEW25432
augaaccccaaucagaagaucauuaccauaggcagcgugugcaugacaaucgggauggccaaccugauucuccaaaucggaaauauuaucuccauauggacuucucacucaauccagcuugguaaccagaaucagauugagacguguaaccaaagugucaucaccuacgaaaauaacacauggguuaaucagacuuaugugaacauuagcaauaccaacuucgcugcaggccaguccguagugucugucaaacuggccggaaauucgucauugugcccugugagcgggugggcgaucuacaguaaggacaacuccauaagaauuggcucuaaaggugauguuuuugugaucagggagccauucauuagcuguuccccguuagaaugccggacauuuuuccugacccagggggcucuacucaaugacaagcauucaaacggaacuaucaaagaucgcagucccuaucgaacacugaugagcuguccuaucggcgaggucccaucucccuacaacucccguuuugaaucaguggccuggagcgcaagugccugccacgacggcauuaauuggcuuaccauagggaucucuggaccugauaacggugcuguagcaguucugaaguauaauggcauuaucacggacacuauaaaguccuggagaaacaauauuuugaggacccaagagagcgagugugccugcgugaacgggucguguuucacagucaugacugauggaccaucugacggccaggcuuccuacaaaaucuuucggaucgaaaaggguaaaauugugaagucaguggagaugaaugcccccaacuaucauuacgaagagugcaguuguuacccugauagcuccgagauuaccugcgucugccgcgacaauuggcacgggucuaacagaccauggguuagcuucaaucagaaccucgaauaucagaucggauacauauguucaggcaucuuuggcgauaauccgaggcccaacgacaaaacagggaguugcggaccuguguccagcaauggugcgaacggcguaaagggguucucuuuuaaguauggaaacggcguguggauuggucggaccaaaucaaucaguagccgcaauggguucgagaugaucugggauccaaacggcuggacgggaacugacaauaacuccucuauuaagcaagacauagucggcaucaaugaauggucgggguacagcggauccuuugugcagcaucccgagcugacaggucuggauuguauucgaccuugcuucuggguugaacucaucagaggcaggccaaaagagaacaccauuuggacuucagggaguucuaucagcuucuguggaauaaauuccgacgcagugggcuggucauggcccgauggugccgaguuaccguuuacaaucgacaaguga

SEQ ID NO: 143424 - RNA, 1410 nt, Artificial Sequence
  derived and/or modified sequence opt3 from neuraminidase__InfluenzaA__AEW25436
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaaguauuaucacguacgaaaauaacaccugggucaaucagacauauguuaacauaagcaauacuaacuucgcugcaggccaguccgugguaucugugaaacuggccggaaauucgucauugugcccugucagcggaugggcgauuuacaguaaggacaacuccaucagaauuggcucuaaaggugauguguuuguuaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggugccaucucccuacaacucccguuuugaaucagucgccuggagcgcaagugccugccacgacggcaucaauuggcuuacaauugggaucucuggaccugauaacggugcuguggcaguacugaaguauaauggcauaauuaccgacacgaucaaguccuggagaaacaauaucuugaggacucaagagagcgagugugccugcguuaacgggucguguuucaccgugaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauauaggaucggauacauuuguucaggcaucuuuggcgauaauccgcggcccaacgacaaaaccgggaguugcggaccuguuuccagcaauggugcgaacggcgugaagggguucucuuuuaaguauggaaacggcguauggaucggucgcacaaaaucaauuaguagccgaaauggguucgagaugauaugggauccaaacggcuggaccggaacggacaauaacuuuuccaucaagcaggacauugugggcacuaaugaauggucuggguacucggggagcuucguccaacaucccgagcugacaggucuggauuguaucagaccuugcuucuggguggaacucauuaggggccggccaaaagagaacaccaucuggacuuccgggucaaguauaucuuuuuguggaguuaauagcgacacaaugggcugguccuggcccgauggugcagaguuaccguucaccaucgacaaguga

SEQ ID NO: 143425 - RNA, 1410 nt, Artificial Sequence; identical to SEQ ID NO: 138754
  derived and/or modified sequence opt3 from neuraminidase__InfluenzaA__AEW25440

SEQ ID NO: 143426 - RNA, 1410 nt, Artificial Sequence
  derived and/or modified sequence opt3 from neuraminidase__InfluenzaA__AEW25448
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucacaaccgacaaguga

SEQ ID NO: 143427 - RNA, 1410 nt, Artificial Sequence; identical to SEQ ID NO: 138754
  derived and/or modified sequence opt3 from neuraminidase__InfluenzaA__AEW25456

SEQ ID NO: 143428 - RNA, 1410 nt, Artificial Sequence
  derived and/or modified sequence opt3 from neuraminidase__InfluenzaA__AEW25464
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagcucaaugcccccaacuaucauuacgaagagugcaguuguuacccugauagcuccgagauuacuugcgucugccgcgacaauuggcacgggucuaacagaccauggguuagcuucaaucagaaccuggaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucucgauuguauccgaccuugcuucuggguugaauuaauuagaggcaggccaaaagagaacacaaucuggaccuccgggucaaguauaucuuuuuguggagugaauagcgacacugucggcugguccuggcccgauggugcagagcugccguucacaaucgacaaguga

SEQ ID NO: 143429 - RNA, 1410 nt, Artificial Sequence
  derived and/or modified sequence opt3 from neuraminidase__InfluenzaA__AEW25474
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccgucaacaaucgacaaguga

SEQ ID NO: 143430 - RNA, 1410 nt, Artificial Sequence
  derived and/or modified sequence opt3 from neuraminidase__InfluenzaA__AEW25484
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggaucaaucagacauauguuaacauaagcaauacuaacuucgcugcaggccaguccgugguaucugugaaacuggccggaaauucgucauugugcccugucagcggaugggcgauuuacaguaaggacaacuccaucagaauuggcucuaaaggugauguguuuguuaucagggagccauucaucagcuguucccauuuagaaugccggaccuuuuuccugacacagggggcucuacucaaugacaagcacucaaacggaaccauuaaagaucgcaguccguaucgaacucugaugagcugucccauaggcgaggugccuucuccauacaacucccguuuugaaucagucgccuggagcgcaagugccugccaugacggcaucaauuggcuuacaauugggaucucuggacccgaucacggugcuguggcaguacugaaguauaacggcauaauuaccgacacgaucaaguccuggagaaauaacaucuugaggacucaagagagcgagugugccugcguuaaugggucguguuucaccgugaugacagauggaccuucugacggccaggcuuccuacaaaauuuuucggaucgaaaaggguaaaauugucaagucaguggagaugaacgccccaaauuaucauuacgaagagugcaguuguuaccccgauagcuccgagauaacuugcgugugccgcgacaacuggcacgggucuaauagaccuugggucagcuucaaccagaaucucgaauaucagaucggauacauuuguucaggcaucuuuggcgauaacccaaggccgaaugacaaaaccgggaguugcggacccguuuccagcaacggugcgaauggcgugaagggguucucuuuuaaguauggaaacggcguauggaucggucggacaaaaucaauuaguagccgcaacggguucgagaugauaugggauccuaauggcuggaccggaacggacaacaauuuuuccaucaagcaagacauugugggcaucaacgaauggucuggguacucggggagcuucguccagcacccagagcugacuggucuggauuguauucgacccugcuucuggguggaacucaucagaggcaggccuaaagagaauacaauauggaccuccgggucaaguaucucuuuuuguggaguuaacagcgacacugugggcugguccuggccagauggugcagaguuacccuucacaauugacaaguga

SEQ ID NO: 143431 - RNA, 1410 nt, Artificial Sequence
  derived and/or modified sequence opt3 from neuraminidase__InfluenzaA__AEW25494
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacuccauuaagagcuggagaaacaauaucuugaggacgcaagagucggagugugccugcgugaacgggucuuguuucacugucaugaccgauggaccauccgacggccaggcuucauacaaaaucuuucggauugaaaaggguaaaaucgugaagaguguggagaugaaugcccccaacuaucauuacgaagagugcagcuguuacccugauuccucugagauuacaugcgucugccgcgacaauuggcacgggagcaacagaccauggguuucauucaaucagaaccucgaauaucagauaggauacaucuguaguggcacuuuuggcgauaauccgaggcccaacgacaaaaccggguccugcggaccugugagcucuaauggugcgaacggcguaaagggguucucauuuaaguauggaaacggcguguggauuggucggacaaaaaguaucagcucccgcaauggguucgagaugaucugggauccaaacggcuggaccggaacggacaauaacuuuucuauuaagcaagacauagucggcaucaaugaauggucgggguacagcggauccuucgugcagcaucccgagcugacuggucuggauuguauucgaccuugcuucuggguugaacucaucagaggcaggccaaaagagaacacaauuuggaccucagggaguucuaucagcuuuuguggagucaauuccgacacugugggcuggucauggcccgauggugcagaguuaccguucacaauagacaaguga

SEQ ID NO: 143432 - RNA, 1410 nt, Artificial Sequence
  derived and/or modified sequence opt3 from neuraminidase__InfluenzaA__AEW25503
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcgcauggaucggucggacaaaaucaaucaguagccgcaauggguucgagaugauuugggauccaaacggcuggaccggaacggacaauaacuuuuccauaaagcaagacaucgugggcauuaaugaauggucuggguacucggggagcuucguccagcaucccgagcugacuggucuggauuguauccgaccuugcuucuggguggaacucauuagaggcaggccaaaagagaacacaaucuggaccuccgggucaaguauaucuuuuuguggaguuaauagcgacacugugggcugguccuggcccgauggugccgaguuaccguucacaaucgacaaguga

SEQ ID NO: 143433 - RNA, 1410 nt, Artificial Sequence
  derived and/or modified sequence opt3 from neuraminidase__InfluenzaA__AEW25511
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucauacauaugugaacaucagcaauacuaacuucgcugcaggccaguccguagugucugucaaacuggccggaaauucgucauugugcccugugagcggaugggcgauauacaguaaggacaacuccauuagaaucggcucuaaagguguuguguuugucauuagggagccauucaucagcuguuccccguuagaaugccggaccuuuuuccugacacagggggcucuacucaaugauaagcacucaaacggaaccaucaaagaccgcagucccuaucgaacucugaugagcuguccuauuggcgaggugccaucucccuacaacucccguuuugaaucaguagccuggagcgcaagugccugccaugauggcauaaauuggcuuacaaucgggauuucuggaccugacaacggugcuguugcagugcugaaguauaauggcaucauaaccgauacgauuaaguccuggagaaacaauaucuugaggacucaggagagcgagugugccugcgucaacgggucguguuucaccgugaugacagacggaccaucugauggccaggcuuccuacaaaaucuuucggauugaaaaggguaaaaucgugaagucagucgagaugaaugcccccaacuaucacuacgaagagugcaguuguuacccugacagcuccgagauuacuugcguuugccgcgauaauuggcaugggucuaacagaccaugggugagcuucaaucaaaaccucgaauaucagauaggauacaucuguucaggcauuuuuggcgacaauccgaggcccaacgauaaaaccgggaguugcggaccuguauccagcaauggugcgaacggcgugaagggguucucuuuuaaguauggaaacggcgucuggaucggucggacaaaaucaaucaguagccgcaauggguucgagaugauuugggacccaaacggcuggaccggaacggauaauaacuuuuccauaaagcaggacaucgugggcauuaaugaauggucuggguacucggggagcuucguucaacaccccgagcugacuggucuggacuguauccgaccuugcuucuggguggaacucauuagaggcaggccaaaagagaacacaaucuggaccuccgggucaaguauaucuuuuuguggagucaauagcgauacugugggcugguccuggcccgacggugcagaguuaccguucacaaucgauaaguga

SEQ ID NO: 143434 - RNA, 1410 nt, Artificial Sequence
  derived and/or modified sequence opt3 from neuraminidase__InfluenzaA__AEW25530
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucauacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcacucaaacggaaccaucaaagaucgcagucccuaucgaacucugaugagcuguccuauuggcgaggucccaucucccuacaacucccguuuugaaucaguggccuggagcgcaagugccugccaugacggcauaaauuggcuuacaaucgggauuucuggaccugauaacggugcuguagcaguucugaaguauaauggcaucauaaccgacacgauuaaguccuggagauacaacaucuugaggacucaggagagcgagugugccugcgugaaugggucguguuucaccgucaugacagauggaccaucugacggccaggcuuccuauaaaaucuuucggauugaaaaggguaaaaucgugaagucaguggagaugaacgcccccaauuaccacuacgaagagugcaguuguuauccugauagcuccgagauuacuugcgucugccgcgacaacuggcaugggucuaauagaccauggguuagcuucaaccaaaaucucgaauaccagauaggauauaucuguucaggcauuuuuggcgauaacccgaggcccaaugacaaaaccgggaguugcggaccuguguccagcaacggugagaauggcguaaagggguucucuuuuaaguacggaaacggcguguggaucggucggacaaaaucaaucaguagccgcaacggguucgaaaugauuugggauccaaauggcuggaccggaacggacaacaauuuuuccauaaagcaggacaucgucggcauuaacgaguggucuggguauucggggagcuucgugcaacaccccgaacugacuggucuggauuguauccgaccuugcuucuggguugagcucauuagaggcaggccaaaagagaauacaaucuggaccuccgggucaaguauaucuuuuuguggagugaacagcgacacugucggcugguccuggcccgauggugcggaauuaccguucacaaucgacaaguga

SEQ ID NO: 143435 - RNA, 1410 nt, Artificial Sequence
  derived and/or modified sequence opt3 from neuraminidase__InfluenzaA__AEW25537
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaaccaucacuaugaagagugcaguuguuacccugauagcuccgagauuacuugcgucugccgcgacaauuggcaugggucuaacagaccauggguuagcuucaaucagaaccucgaauaccagauaggauauaucuguucaggcauuuuuggcgauaauccgaggcccaacgacaaaaccgggaguugcggaccuguguccagcaauggugcgaacggcguaaagggguucucuuuuaaguacggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguauucggggagcuucgugcagcaccccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucacaaucgacaaguga

SEQ ID NO: 143436 - RNA, 1410 nt, Artificial Sequence; identical to SEQ ID NO: 138754
  derived and/or modified sequence opt3 from neuraminidase__InfluenzaA__AEW25547

SEQ ID NO: 143437 - RNA, 1410 nt, Artificial Sequence; identical to SEQ ID NO: 138754
  derived and/or modified sequence opt3 from neuraminidase__InfluenzaA__AEW25556

SEQ ID NO: 143438 - RNA, 1410 nt, Artificial Sequence; identical to SEQ ID NO: 138754
  derived and/or modified sequence opt3 from neuraminidase__InfluenzaA__AEW25566

SEQ ID NO: 143439 - RNA, 1410 nt, Artificial Sequence
  derived and/or modified sequence opt3 from neuraminidase__InfluenzaA__AEW25584
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaaggcaucgucgggauuaaugaauggucuggauacgguggcucguucgugcagcaucccgagcugacugggcuggacuguauccgaccuugcuucuggguugaacucauuagaggaaggccaaaagagaacacaaucuggaccagcggcuccucaauaaguuuuuguggugucaauucugauacugugggguggagcuggcccgacggcgcagaguuaccguucacaaucgauaaguga

SEQ ID NO: 143440 - RNA, 1410 nt, Artificial Sequence; identical to SEQ ID NO: 138754
  derived and/or modified sequence opt3 from neuraminidase__InfluenzaA__AEW25592

SEQ ID NO: 143441 - RNA, 1410 nt, Artificial Sequence
  derived and/or modified sequence opt3 from neuraminidase__InfluenzaA__AEW25602
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaagaauuuuuccauaaaacaagacaucgucggcauuaacgaauggucuggguacucggggagcuucgugcagcaucccgagcugacuggucuggauuguauccgaccuugcuucuggguugaacucauuagaggcaggccaaaggagaauacaaucuggaccuccgggucaaguauaucuuuuuguggagugaacagcgacacugucggcugguccuggcccgauggugcagaguuaccguucacaaucgacaaauga

SEQ ID NO: 143442 - RNA, 1410 nt, Artificial Sequence
  derived and/or modified sequence opt3 from neuraminidase__InfluenzaA__AEW25612
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugaccggcaggcuuccuacaaaaucuuucgcauugaaaagggcaaaaucgugaagucaguggagaugaaugcccccaacuaucauuacgaagagugcaguuguuacccugauagcuccgagauuacuugcgucugcagagacaauuggcacgguucuaacaggccauggguuagcuucaaucagaaccucgaauaucagauaggguacaucuguucaggaauuuuuggcgauaauccgcggcccaacgacaaaaccggcaguugcgggccuguguccagcaauggagcgaacgguguaaagggcuucucuuuuaaguaugggaacggaguguggaucggccgcacaaaaucaaucaguagccgaaaugguuucgagaugauuugggauccaaacggguggaccggcacggacaauaacuuuuccauaaagcaagacaucgucggaauuaaugaauggucuggcuacucggggagcuucgugcagcaucccgagcugacuggacuggauuguaucagaccuugcuucuggguugaacucauuaggggucggccaaaagagaacacaaucuggaccuccggcucaaguauaucuuuuuguggggugaauagcgacacugucggaugguccuggcccgauggcgcagaguuaccguucacaaucgacaaguga

SEQ ID NO: 143443 - RNA, 1410 nt, Artificial Sequence
  derived and/or modified sequence opt3 from neuraminidase__InfluenzaA__AEW25622
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacuccaucuggacaucagggaguucuauauccuuuuguggagugaauagcgacaccgucggcuggucauggcccgauggugcagaguuaccguucacuaucgacaaguga

SEQ ID NO: 143444 - RNA, 1410 nt, Artificial Sequence
  derived and/or modified sequence opt3 from neuraminidase__InfluenzaA__AEW25631
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgucuggcguaaagggguucucauuuaaguauggaaacggcguguggaucggucggacaaaaaguaucagcucccgcaacggguucgagaugauuugggauccaaauggcuggaccggaacggacaacaauuuuucuauaaagcaagacaucgucggcauuaacgaauggucgggguacagcggauccuucgugcagcaucccgagcugacuggucuggauuguauccgaccuugcuucuggguugaacucauuagaggcaggccaaaagagaauacaaucuggaccucagggaguucuauaucguuuuguggagugaacuccgacacugucggcuggucauggcccgauggugcagaguuaccguucacaaucgacaaguga

SEQ ID NO: 143445 - RNA, 1410 nt, Artificial Sequence; identical to SEQ ID NO: 138754
  derived and/or modified sequence opt3 from neuraminidase__InfluenzaA__AEW25639

SEQ ID NO: 143446 - RNA, 1410 nt, Artificial Sequence
  derived and/or modified sequence opt3 from neuraminidase__InfluenzaA__AEW25648
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucauacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcacucaaacggaaccaucaaagaucgcagucccuaucgaacucugaugagcuguccuauuggcgaggucccaucucccuacaacucccguuuugaaucaguggccuggagcgcaagugccugccaugacggcauaaauuggcuuacaaucgggauuucuggaccugauaacggugcuguagcaguucugaaguauaauggcaucauaaccgacacgauuaaguccuggagaaacaauaucuugaggacucaggagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucacuacgaagagugcaguuguuacccugauagcuccgagauuacuugcgucugccgcgacaauuggcaugggucuaacagaccauggguuagcuucaaucaaaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaggacaucgucggcauuaaugaauggucuggguacucggggagcuucgugcaacaccccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucacaaucgacaaguga

SEQ ID NO: 143447 - RNA, 1410 nt, Artificial Sequence
  derived and/or modified sequence opt3 from neuraminidase__InfluenzaA__AEW25656
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuucccauaaagcaagacaucgucggcauuaaugaaugguccggguacucuggaucguucgugcagcauccugagcugacuggucuggauuguauccgaccaugcuucuggguugaacucauuagaggcaggcccaaagagaacacaaucuggaccagcggguccucaauaaguuuuuguggagucaauucugacacugugggcuggagcuggccggauggugcagaguuaccuuucacaaucgacaaguga

SEQ ID NO: 143448 - RNA, 1410 nt, Artificial Sequence
  derived and/or modified sequence opt3 from neuraminidase__InfluenzaA__AEW25664
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucaccgcuggccaguccguagugucugucaaacuggcaggaaauucgucauugugcccugugagcggaugggccauauacaguaaggacaacuccauuagaaucggcucuaaaggugauguuuuugugauuagggagccauucaucagcuguuccccguuagaaugccggacauuuuuccugacccagggggcgcuacucaaugacaagcauucaaacggaacuaucaaagaucgcagucccuaucgaacacugaugagcuguccuauuggcgaggucccaucucccuacaacucccguuuugaaucaguggcuuggagcgccagugcaugccacgacggcauaaauuggcuuaccaucgggauuucuggaccugauaacggugccguagcuguucugaaguauaauggcaucauaacggacacuauuaaguccuggagaaacaauaucuugaggacccaagagagcgagugugcaugcgugaacgggucguguuucacagucaugacugauggaccaucugacggccaggccuccuacaaaaucuuucggauugaaaaggguaaaaucgugaagucaguggagaugaaugcucccaacuaucauuacgaagagugcaguuguuacccugauagcuccgagauuaccugcgucugccgcgacaauuggcacgggucuaacagaccauggguuagcuucaaucagaaccucgaauaucagauaggauacaucuguucaggcauuuuuggcgauaauccgaggcccaacgacaaaacagggaguugcggaccuguguccagcaauggugccaacggcguaaagggguucucuuuuaaguauggaaacggcguguggaucggucggaccaaaucaaucaguagccgcaauggguucgagaugauuugggauccaaacggcuggacgggaacugacaauaacuuuuccauaaagcaagacaucgucggcauuaaugaauggucuggguacucggggagcuucgugcagcaucccgagcugacaggucuggauuguauccgaccuugcuucuggguugaacucauuagaggcaggccaaaagagaacaccaucuggacuuccgggucaaguauaucuuuuuguggagugaauagcgacacaggcgguugguccuggcccgauggggcggaguuaccguucaccaucgacaaguga

SEQ ID NO: 143449 - RNA, 1410 nt, Artificial Sequence; identical to SEQ ID NO: 143443
  derived and/or modified sequence opt3 from neuraminidase__InfluenzaA__AEW25671

SEQ ID NO: 143450 - RNA, 1410 nt, Artificial Sequence; identical to SEQ ID NO: 139931
  derived and/or modified sequence opt3 from neuraminidase__InfluenzaA__AEW25680

SEQ ID NO: 143451 - RNA, 1410 nt, Artificial Sequence
  derived and/or modified sequence opt3 from neuraminidase__InfluenzaA__AEW25689
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaguuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucugacggccaggcuuccuacaaaaucuuucggaucgaaaaggguaaaauugugaagucagucgagaugaaugcccccaacuaucauuacgaagagugcaguuguuacccugauagcuccgagaucacuugcguuugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacaauaacuuuuccauuaagcaagacauagugggcaucaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcagaguuaccguucacaauagacaaguga

SEQ ID NO: 143452 - RNA, 1410 nt, Artificial Sequence; identical to SEQ ID NO: 143446
  derived and/or modified sequence opt3 from neuraminidase__InfluenzaA__AEW25698

SEQ ID NO: 143453 - RNA, 1410 nt, Artificial Sequence; identical to SEQ ID NO: 138754
  derived and/or modified sequence opt3 from neuraminidase__InfluenzaA__AEW25708

SEQ ID NO: 143454 - RNA, 1410 nt, Artificial Sequence; identical to SEQ ID NO: 138754
  derived and/or modified sequence opt3 from neuraminidase__InfluenzaA__AEX09177

SEQ ID NO: 143455 - RNA, 1413 nt, Artificial Sequence
  derived and/or modified sequence opt3 from neuraminidase__InfluenzaA__AEX33324
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucacuaucaauaacaccaauguuguggcagggaaagacaagacaucgguaacccuugccggaaacucaagccuguguaguauuuccggcugggcgaucuacacuaaagauaauucuaucaggauugguagcaagggggacguguucgucauacgggagccuuuuaucuccugcucacauuuggagugucgcacauucuuuuuaacccaaggagcucugcuaaacgauaaacacaguaauggcacggugaaggaccgaagcccauaucgugcccucaugucuugcccgcugggcgaagcacccuccccuuacaacucaaaguucgagagcguugccuggagugcuucugcaugucaugaugggaugggauggcuuacuauugguaucuccggcccagacaauggggccguggcuguccugaaauauaacggaauaauuaccgaaacaaucaagagcuggaaaaagagaaucuugaggacucaggagucggagugcguguguguaaacggcucuugcuuuaccauuaugacagauggucccuccaauggggccgcgucauacaaaaucuucaagauugaaaagggaaaaguuaccaagaguauagagcucaacgcaccuaauuuucacuaugaagaguguagcugcuacccagacacgggcacugugaugugugucugccgggauaacuggcacggcuccaaucgccccugggugucuuucaaccagaaucuggacuaccagaucggguauauuugcagcggaguguuuggugauaacccuagaccaaaagacggcgaggggucauguaauccggucacaguugauggagccgacggcgugaaggguuucaguuacaaauaugggaacggcguauggaucggaaggaccaaguccaaucggcugcgcaaaggcuuugaaaugaucugggaccccaacggguggacugauacagacagcgauuucucugugaagcaagacgucguggcuauuaccgauuggucaggauacagugguagcuuuguucagcauccugagcucacgggcuuagacugcauacgaccauguuucuggguggaacuggucagagggcuucccagggagaauaccacaaucuggacuuccggaucuucgauuagcuucugcggcgugaacuccgauaccgccaauuggucauggccugacggugcagaauugccauuuacaaucgauaaguga

SEQ ID NO: 143456 - RNA, 1413 nt, Artificial Sequence
  derived and/or modified sequence opt3 from neuraminidase__InfluenzaA__AEX33368
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccugugugcgauuaguggcugggcuaucuacaccaaagauaacuccaucaggauugguucuaagggggacguguucgucauacgggagccuuuuaucagcugcucccauuuggagugucgcacuuucuuuuuaacacaaggagcccugcuaaaugauaaacacucaaacggcaccgugaaggaccgaaguccauaucgugcacucaugagcugcccgcugggcgaagcccccucuccuuacaauuccaaguucgagucaguugcuuggagcgcaagugccugucaugaugggaugggauggcuuacgauugguaucucuggcccagacaacggggcuguggccguccugaaauauaacggaauaauuacugaaaccaucaaguccuggaaaaagagaaucuugaggacacaggagagcgagugcguguguguaaauggcucgugcuuuacuauuaugaccgauggucccucuaacggggcggcauccuacaaaaucuucaagauugaaaagggaaaaguuacaaagucaauagagcucaaugccccuaacuuucacuaugaagaguguaguugcuacccagacaccggcacggugaugugugucugccgggauaauuggcacggcagcaaccgccccuggguguccuucaaucagaaccuggacuaccagaucggguauauuugcucuggaguguuuggugauaauccuagaccaaaagacggcgaggggagcuguaacccggucacuguugauggagcugacggcgugaaggguuucucauacaaauaugggaauggcguauggaucggaaggacaaagaguaaccggcugcgcaaaggcuuugaaaugaucugggaccccaauggguggaccgauacugacuccgauuucagcgugaagcaagacgucguggccauuacagauuggucuggauacucagguaguuuuguucagcauccugagcucaccggcuuagacugcauacgaccauguuucuggguggaacuggucagagggcuucccagggagaacacgaccaucuggacaagcggauccucuauuucguucugcggcgugaauagcgauacugcaaacugguccuggccugacggugcugaauugccauuuaccaucgauaaguga

SEQ ID NO: 143457 - RNA, 1413 nt, Artificial Sequence
  derived and/or modified sequence opt3 from neuraminidase__InfluenzaA__AEX33379
augaaccccaaucagaagaucauuaccauaggcagcaucuccauugccaucgggauuaucucucugaugcuccaaauaggaaacaucauuucaaucugggcuagucacagcauucagacagguauccagaaucauacuggcauaugcaaccagagaauuaucacguacgaaaauuccaccugggugaaccacacauaugucacuauuaauaacaccaauguuguggcagggaaagacaagacaucuguaacccuugccggaaacucgucacuguguagcaucaguggcugggcgaucuacacuaaagauaauuccauuaggauagguucuaagggggacguguucgucauccgggagccuuuuauuagcugcucccauuuggagugucgcacauucuuuuuaacccaaggagcucugcuaaacgauaaacacucaaauggcacggugaaggaccgaaguccauaucgugcccucaugagcugcccgcugggcgaagcacccucuccuuacaacuccaaguucgagucaguugccuggagcgcuagugcaugucaugaugggaugggauggcuuacuaucgguauaucuggcccagacaauggggccguggcuguccugaaauauaacggaauuaucaccgaaacaaucaaguccuggaaaaagagaauuuugaggacucaggagagcgagugcguguguguaaacggcucgugcuuuaccaucaugacagauggucccucuaauggggccgcguccuacaaaauuuucaagauagaaaagggaaaaguuaccaagucaaucgagcucaacgcaccuaauuuucacuaugaagaguguaguugcuacccagacacgggcacugugaugugugucugccgggauaacuggcacggcagcaaucgccccuggguguccuucaaccagaaucuggacuaccagauuggguauaucugcucuggaguguuuggugauaacccuagaccaagggacggcgaggggagcuguaauccggucacaguugauggagccgacggcgugaaagguuucucauacaaguaugggaacggcguauggaucggacggaccaaaaguaaucgccugcgaaagggcuuugaaaugauuugggaccccaacggguggacugauacagacuccgauuucagcgugaaacaagacgucguggcuauaaccgauuggucuggauacucagguaguuuuguucagcauccugagcucacgggcuuagacugcaucagaccauguuucuggguggaacuggucagggggcuuccccgggagaauaccacaauuuggacuagcggauccucuaucucguucugcggcgugaacagcgauaccgccaauugguccuggccugacggugcagaauugccauuuacaauugauaaguga

SEQ ID NO: 143458 - RNA, 1413 nt, Artificial Sequence; identical to SEQ ID NO: 143457
  derived and/or modified sequence opt3 from neuraminidase__InfluenzaA__AEX33390

SEQ ID NO: 143459 - RNA, 1413 nt, Artificial Sequence; identical to SEQ ID NO: 143457
  derived and/or modified sequence opt3 from neuraminidase__InfluenzaA__AEX33401

SEQ ID NO: 143460 - RNA, 1413 nt, Artificial Sequence; identical to SEQ ID NO: 143457
  derived and/or modified sequence opt3 from neuraminidase__InfluenzaA__AEX33412

SEQ ID NO: 143461 - RNA, 1413 nt, Artificial Sequence; identical to SEQ ID NO: 143457
  derived and/or modified sequence opt3 from neuraminidase__InfluenzaA__AEX33423

SEQ ID NO: 143462 - RNA, 1413 nt, Artificial Sequence; identical to SEQ ID NO: 143457
  derived and/or modified sequence opt3 from neuraminidase__InfluenzaA__AEX33434

SEQ ID NO: 143463 - RNA, 1413 nt, Artificial Sequence; identical to SEQ ID NO: 143457
  derived and/or modified sequence opt3 from neuraminidase__InfluenzaA__AEX33445

SEQ ID NO: 143464 - RNA, 1410 nt, Artificial Sequence
  derived and/or modified sequence opt3 from neuraminidase__InfluenzaA__AEX33544
augaaccccaaucagaagaucauuaccauaggcagcuucucccugacaaucgccgcuauuugcuuucucaugcaaaucgcaauucuugugacuacggucacccugcacuucaaacagcaugaguguaacucuccuccaaauaaccagguuauguugugcgaaccgacaaucauagagagaaauaucacugaaauuguguacuuaaccaacacaaccaucgagaaggaaauuugucccaaacuggccgaguauaggaauuggucaaagccucagugcaacaucacuggguuugcgccauucaguaaagacaauagcauacggcuauccgcuggaggugauauuuggguaacacgcgagcccuacgugucuugugacccugauaagugcuaucaauuugcccucggccaggggaccacgcugaacaauggacacucgaacgacacuguccaugaucgaaccccauaccguacacuucugaugaaugaauugggcgugcccuuccaccucgguacuagacagguuuguaucgcauggucaagcaguuccugccaugacgggaaggccuggcugcacgugugugucaccggagaugacaaaaacgcuacagcaucuuuuauuuauaauggcaggcugguggauagcaucggcuccuggucaaagaaaauccuccggacccaggagagugaaugcguauguauuaacgggacgugcacuguugugaugacagacggaagcgccucugguaaggcugauaccaaaauauuauucaucgaggagggcaagauuguccacaucuccacucugucagggagcgcccaacauguggaagagugcaguuguuacccucgcuauccaggagugagaugcgucuguagggacaacuggaagggcucuaaucggccgauaguugauauuaacgugaaagacuacuccaucguaagcucguacgugugcucuggucuugucggggacacaccccgcaagaaugauuccuuuucaaguagccacuguuuggacccuaacaaugaagagggaggccauggcgugaaagggugggcguucgaugacggaaacgauguuuggaugggucgaaccaucuccgaaaagcugagaucuggcuaugagacguuuaaagugauugagggguggagcaagccaaauucaaaacuacagaucaacaggcaggucauuguggaacggggaaaucguaguggcuacuccgguauauucagcguagaggggaagucuugcaucaaccgcuguuuuuauguugaacucauuagaggcaggaaggagaaaaccgaagugugguggacaucaaauaguaucgucguguucugcggaacuagcggcaccuacgggacaggauccuggcccgacggugcagauaucaaccugaugccuauuuga

SEQ ID NO: 143465 - RNA, 1410 nt, Artificial Sequence; identical to SEQ ID NO: 136730
  derived and/or modified sequence opt3 from neuraminidase__InfluenzaA__AEX33555

SEQ ID NO: 143466 - RNA, 1410 nt, Artificial Sequence
  derived and/or modified sequence opt3 from neuraminidase__InfluenzaA__AEX33610
augaaccccaaucagaagaucauuaccauaggcagcgugucccugacaaucucuacuauuugcuucuuuaugcaaaucgccauucucaucacgaccgucacacuucacuucaaacaguacgaguuuaacccuccaccgaauaaccagguuaugcugugugaacccacuauaaucgagagaaauauuaccgaaaucguguauuugacaaacaccacuauugagaaggaaaucugcccuaaauuagcugaguacaggaauuggucaaagccacagugugacauaacaggguucgcacccuuuaguaaagauaacagcauucggcuguccgccggaggugacaucuggguaacccgcgagccuuaugugucuugcgauccagacaaguguuaccaauucgcgcuaggccaggggacgacucucaauaacguccauucgaaugauaccgugcacgaccgaacacccuaucguacucugcuuaugaacgaacugggaguuccuuuucauuugggcaccaaacaggugugcauugcuuggucaagcaguuccugucacgaugguaaagccuggcuccaugucugcgugacaggggacgauaagaaugcaaccgccucuuucaucuacaacggaagacugguagacagcaucguuuccuggucaaagaagauucugaggacgcaggagagugaaugugugugcauaaauggcacuuguacagucgugaugaccgauggcagcgcuucugggaaagcagacacuaagauccucuuuauugaggagggaaagaucgugcacacauccaccuuaucagguagcgcccaacacgucgaagagugcaguugcuauccacgguacccgggcguucgcugugugugcagagauaacuggaaagggucuaacaggcccauaguagacauuaauaucaaggacuacaacaucguguccagcuaugucuguucgggacuggugggcgauacgccucggaaaaaugacucuuccucaaguagccauugccuugauccaaacaaugaagagggugggcacggaguuaagggcugggcuuucgacgauggcaacgacguguggauggggcgcaccauuuccgaaaaauugcgaucuggauacgagacauuuaaggucaucgguggcuggagcaaucccaacucaaaacugcagauuaauagacaggugauaguagauagggggaaccggaguggauauuccggcaucuucagcguugaggguaagucuuguauuaaucguugcuuuuacguggaacuaauccgcgggagaaaggaggaaacugagguccucuggaccucaaacaguaucguggucuucuguggcacaagcggaacuuauggcaccggguccuggccugacggagccgauauuaaucugaugccaauauga

SEQ ID NO: 143467 - RNA, 1410 nt, Artificial Sequence
  derived and/or modified sequence opt3 from neuraminidase__InfluenzaA__AEX33828
augaaccccaaucagaagaucauuaccauaggcagcgugucccugacaaucucuacuauuugcuucuuuaugcaaaucgccauucucaucacgaccgucacacuucacuucaaacaguacgaguuuaacccuccaccgaauaaccagguuaugcugugugaacccacuauaaucgagagaaauauuaccgaaaucguguauuugacaaacaccacuauugagaaggaaaucugcccuaaauuagcugaguacaggaauuggucaaagccacagugugacauaacaggguucgcacccuuuaguaaagauaacagcauucggcuguccgccggaggugacaucuggguaacccgcgagccuuaugugucuugcgauccagacaaguguuaccaauucgcgcuaggccaggggacgacucucaauaacguccauucgaaugauaccgugcacgaccgaacacccuaucguacucugcuuaugaacgaacugggaguuccuuuucauuugggcaccaaacaggugugcauugcuuggucaagcaguuccugucacgaugguaaggccuggcuccaugucugcgugacaggggacgauaagaaugcaaccgccucuuucaucuacaacggaagacugguagacagcaucguuuccuggucaaaagagauucugaggacgcaggaaagugagugugugugcauaaauggcacuuguacagucgugaugaccgauggcagcgcuucugggaaggcagacacuaaaauccucuuuauugaggaaggaaagaucgugcacacauccaccuuaucagguagcgcccaacacgucgaggaaugcaguugcuauccacgguacccgggcguucgcugugugugcagagauaacuggaaggggucuaacaggcccauaguagacauuaauaucaaagacuacuccaucgugagcucguaugucuguucuggacuggugggcgauacgccucggaagaacgacuccucaaguagcucccauugccuugauccaaauaacgaggaaggugggcacggaguuaaaggcugggcuuucgacgauggcaaugacguguggauggggcgcaccauuucugagaaguugcgaagcggauacgagacauuuaaagucaucgaagguuggucaaaccccaauaguaagcugcagauuaacagacaggugauaguagauaggggcaaucgguccggguauagcggaaucuucucuguugagggcaaaucauguauuaaccguugcuuuuacguggaacuaauccgcgguagaaaggaggaaacugagguccucuggaccaguaauagcaucguggucuucugugggacauccggcacuuauggaaccggcucuuggccugacggggccgauauuaaccugaugccaauauga

SEQ ID NO: 143468 - RNA, 1410 nt, Artificial Sequence; identical to SEQ ID NO: 136728
  derived and/or modified sequence opt3 from neuraminidase__InfluenzaA__AEX33839

SEQ ID NO: 143469 - RNA, 1413 nt, Artificial Sequence
  derived and/or modified sequence opt3 from neuraminidase__InfluenzaA__AEX33861
augaaccccaaucagaagaucauuaccauaggcagcaucuccauugccaucgggacaauuucucugaugcuccaagugggaaacaucauaucaaucugggcuagucacagcauucagacugguucccagaaucauacgggcaucugcaaccagagaauuaucaccuacgaaaauucuacaugggucaaccacacuuauguuaauauaaacaauaccaacgugguagcagggaaagacaagacaucgguggcccuugcgggaaauucaagccuguguaguauuuccggcugggcuaucuacaccaaagauaacucuauuaggaucgguagcaagggggacgucuucgugauccgggagccuuuuauuuccugcucacauuuggagugucgcacuuucuuuuuaacacaaggagcccugcuaaaugauaaacacaguaacggcaccguuaaggaccgaagcccauaucgugcacucaugucuugcccgcugggcgaagcccccuccccuuacaauucaaaguucgagagcguggcuuggagugcaucugccugucaugaugggaugggauggcuuacgauagguaucuccggcccagacaacggggcugucgccgugcugaaauauaacggaauuaucacugaaaccauaaagagcuggaaaaagagaauuuugaggacacaggagucggagugcguauguguuaauggcucuugcuuuacuaucaugaccgauggucccuccaacggggcggcaucauacaaaaucuucaagauugaaaagggacaggugacaaaaagugucgagcucaaugccccuaacuuucacuaugaagaguguagcugcuacccagacaccggcacggugaugugugugugccgggauaauuggcacggcuccaaccgccccugggucucuuucaaucagaaccuggacuaccaaaucggguauauuugcagcggaguuuuuggugauaauccuagaccaaaggacggcaaagggucauguaacccggugacuguagauggagcugacggcgugaaggguuucaguuacaaauaugggaauggcgucuggauaggaaggacaaaguccaaccggcugcgcaaaggcuuugagaugaucugggaccccaauggguggaccgauacugacagcgauuucucugugaagcaggacguuguggccauuacagauuggucaggauacagugguagcuuuguccagcauccugaacucaccggcuuagacugcauccgaccauguuucuggguggagcugguaagagggcuucccagggaaaacacgaccaucuggacauccggaucuucgauuagcuucugcggcguugauuccgacacugcaaauuggucauggccugauggugcugaguugccauuuaccauagacaaguga

SEQ ID NO: 143470 - RNA, 1410 nt, Artificial Sequence
  derived and/or modified sequence opt3 from neuraminidase__InfluenzaA__AEX33872
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcagugugaaccgacuauaaucgagagaaauauuaccgaaaucguguaucugacaaacaccacuauugagaaggaaaucugccccaaauuggcugaguacaggaauuggaguaagccucaaugugacauaacaggguucgcaccauuuagcaaagauaacuccauucgguuaucugccggaggugacaucuggguaacccgcgagcccuaugugucgugcgauccugacaaguguuaccaguucgcgcugggccaggggacgacucuaaauaacguccauucaaaugauaccgugcacgaccgaacaccauaucguacucuccugaugaacgaacuuggaguucccuuucaucugggcaccaaacaggugugcauugcuuggagcaguuccucuugucacgaugguaaggccugguugcaugucugcgugacaggggacgauaagaaugcaaccgccagcuucaucuacaacggaagacucguagacuccaucguuucauggaguaaagagauucugaggacgcaagaaagcgagugugugugcauaaauggcacuuguacagucgugaugaccgauggcucugcuuccgggaaggcagacacuaaaauccuguuuauugaggaaggaaagaucgugcacacaucaacccucagcgguagugcccagcacgucgaggaaugcucuugcuauccucgguacccaggcguucgcugugugugcagagauaacuggaagggguccaacaggccgauaguagacauuaauaucaaagacuacagcaucgugucgucuuaugucuguuccggauuagugggcgauacgccccggaagaacgacucaaguagcuccucucauugccugaauccuaacaaugaggaaggugggcacggaguuaaaggcugggcuuucgaugacggcaacgauguguggauggggcgcaccauuagcgagaaacuucgauugggauacgagacauuuaaggucaucgaagguuggucaaauccaaacaguaagcugcagauuaauagacaggugauaguagacaggggcaaccgguccggguauagcggaaucuucucuguugagggcaaaucauguauuaaucguugcuuuuacguggaacuaauccgcgguagaaaggaggaaacugagguccucuggaccaguaacagcaucguggucuucugugggacauccggcacuuauggaaccggcucuuggcccgauggggccgacauuaaucugaugccuauauga

SEQ ID NO: 143471 - RNA, 1410 nt, Artificial Sequence; identical to SEQ ID NO: 136728
  derived and/or modified sequence opt3 from neuraminidase__InfluenzaA__AEX33883

SEQ ID NO: 143472 - RNA, 1410 nt, Artificial Sequence
  derived and/or modified sequence opt3 from neuraminidase__InfluenzaA__AEX33894
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauagacggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaacuggaagggguccaacaggccgauaguagacauuaauaucaaagacuacagcaucgugucgucuuaugucuguuccggacuggugggcgauacgccccggaagaacgacucaaguagcuccucucauugccuugauccuaauaacgaggaaggugggcacggaguuaaaggcugggcuuucgacgauggcaaugacguguggauggggcgcaccauuagcgagaaguugcgaucaggauacgagacauuuaaagucaucgaagguuggaguaacccaaauuccaagcugcagauuaacagacaggugauaguagauaggggcaaucggagcggguauucuggaaucuucucaguugagggcaaaaguuguauuaaccguugcuuuuacguggaacuaauccgcgguagaaaggaggaaacugagguccucuggaccagcaauuccaucguggucuucugugggacaucuggcacuuauggaaccggcucguggcccgacggggccgauauuaaccugaugccuauauga

SEQ ID NO: 143473 - RNA, 1413 nt, Artificial Sequence
  derived and/or modified sequence opt3 from neuraminidase__InfluenzaA__AEX33916
augaaccccaaucagaagaucauuaccauaggcagcaucuccauugccaucgggauuaucucucugauacuccaaaucggaaacauuaucucaauuugggcuagucacagcauccagacagguucccagaaucauacuggcauaugcaaccagagaauuaucacguacgaaaauucuaccugggugaacaauacauaugucaacauuaauaacacuaauguuguggcagagaaagacaagaccucgguaacacuugccgggaacucaagccuguguaguaucuccggaugggcgaucuacaccaaagauaauucuauuaggauaggcagcaagggugacguguucgucauccgggagccuuuuauuuccugcucacacuuggaaugucgcacuuucuuuuuaacacaaggggcucugcuaaacgauaaacauaguaauggaaccgugaaggaccgaagcccauaucgugcccucaugucuugcccgcugggcgaggcacccuccccuuacaacucaagauucgaaagcguugccuggagugcuucugcaugucacgauggcaugggguggcuuacgaucggaauauccgguccagacaacggcgccguggcuguccugaaguauaaugggauuaucacugagaccaucaaaagcuggaagaaaaggauuuugcggacacaggagucggaaugcguguguaugaacggaucuugcuuuacuaucaugaccgauggccccuccaauggugccgcgucauacaagauuuucaaaauagagaaggggaagguaacaaaaaccaucgaacucaacgcaccuaauuuucauuaugaggaguguaguugcuacccagacacgggaacuguuaugugugugugccgcgauaacuggcacggcagcaauagacccugggucuccuucaaccagaaucuggacuaccagacaggcuauauuugcucugggguguuuggagauaacccuaggccaaaggacggugaaggcagcuguaauccgaugaccguggauggggccgacggagucaaaggcuucucauacaaguaugguaacgggguuuggaucggccggacuaaaaguaaucgccugcgaaagggauuugagaugaucugggaccccaacggcuggacaaauaccgauuccgacuucagcgugaaacaagauguaguggcuauuacggacuggucuggguacucaggaaguuuuguccagcacccugaacucaccgguuuagauugcauaagaccauguuucuggguggagcugguuaggggccuuccccgggaaaacacaacuaucuggaccagcggguccucuauuucguucugcggagugaacagcggcacagccaauugguccuggccugacggugcagaguugccauuuacuaucgauaaguga

SEQ ID NO: 143474 - RNA, 1413 nt, Artificial Sequence; identical to SEQ ID NO: 137885
  derived and/or modified sequence opt3 from neuraminidase__InfluenzaA__AEX33927

SEQ ID NO: 143475 - RNA, 1413 nt, Artificial Sequence
  derived and/or modified sequence opt3 from neuraminidase__InfluenzaA__AEX33938
augaaccccaaucagaagaucauuaccauaggcagcaucuccauugccaucgggauuaucucucugauacuccaaaucggaaacauuaucucaauuugggcuagucacagcauccagacagguucccagaaucauacuggcauaugcaaccagagaauuaucacguacgaaaauucuaccugggugaacaauacauaugucaacauuaauaacacuaauguugugguagagaaagacaagaccucggugacacuugcagggaacucaagccuguguaguaucuccggaugggccaucuacaccaaagauaauucuauuaggauaggcagcaagggugacgucuucgugauccgggagccuuuuauuuccugcucacacuuggaaugucgcacuuucuuuuuaacacaaggggcgcugcuaaacgauaaacauaguaauggaaccguuaaggaccgaagcccauaucgugcucucaugucuugcccgcugggcgaggcccccuccccuuacaacucaagauucgaaagcguggcauggagugccucugcuugucacgauggcaugggguggcuuacgaucggaauauccgguccagacaacggcgcagucgccgugcugaaguauaaugggauuaucacugagaccaucaaaagcuggaagaaaaggauuuugcggacacaggagucggaaugcguauguaugaacggaucuugcuuuacuaucaugaccgauggccccuccaauggugcugccucauacaagauuuucaaaauagagaaggggaagguuacaaaaaccaucgaacucaacgcgccuaauuuucauuaugaggaguguaguugcuacccagacacgggaacugugaugugugucugccgcgauaacuggcacggcagcaauagacccuggguguccuucaaccagaaucuggacuaccagauuggcuauaucugcucugggguguuuggagauaacccuaggccaaaggacggugaaggcagcuguaauccggucacaguugauggggcagacggagugaaaggcuucucauacaaguaugguaacgggguauggaucggccggaccaaaaguaaucgccugcgaaagggauuugagaugauuugggaccccaacggcuggacuaauacagauuccgacuucagcgugaaacaagaugucguggccauaaccgacuggucuggguacucaggaaguuuuguucagcacccugaacucacggguuuagauugcaucagaccauguuucuggguggagcuggucaggggccuuccccgggaaaacaccacaauuuggacuagcggguccucuaucucguucugcggagugaacagcggcaccacaaauugguccuggccugacggugcugaguugccauuuacuauugauaaguga

SEQ ID NO: 143476 - RNA, 1413 nt, Artificial Sequence
  derived and/or modified sequence opt3 from neuraminidase__InfluenzaA__AEX33949
augaaccccaaucagaagaucauuaccauaggcagcaucuccauugccaucgggauuaucucucugauacuccaaaucggaaacauuaucucaauuugggcuagucacagcauccagacagguucccagaaucauacuggcauaugcaaccagagaauuaucacguacgaaaauucuaccugggugaacaauacauaugucaacauuaauaacacuaauguugugguagagaaagacaagaccucggugacacuugcagggaacucaagccuguguaguaucuccggaugggccaucuacaccaaagauaauucuauuaggauaggcagcaagggugacgucuucgugauccgggagccuuuuauuuccugcucacacuuggaaugucgcacuuucuuuuuaacacaaggggcgcugcuaaacgauaaacauaguaauggaaccguuaaggaccgaagcccauaucgugcucucaugucuugcccgcugggcgaggcccccuccccuuacaacucaagauucgaaagcguggcauggagugccucugcuugucacgauggcaugggguggcuuacgaucggaauauccgguccagacaacggcgcagucgccgugcugaaguauaaugggauuaucacugagaccguaaaaagcuggaagaaaaggaucuugcggacacaggagucggaaugcguuuguaugaacggaucuugcuuuacuauuaugaccgauggccccuccaauggugcugccucauacaagaucuucaaaauugagaaggggaaggugacaaaaaccauagaacucaacgcgccuaauuuucauuaugaggaguguaguugcuacccagacacgggaacugucaugugugugugccgcgauaacuggcacggcagcaauagacccuggguguccuucaaccagaaucuggacuaccagaucggcuauauuugcucuggggucuuuggagauaacccuaggccaaaggacggugaaggcagcuguaauccgguuacaguggauggggcagacggaguaaaaggcuucucauacaaguaugguaacgggguguggaucggccggaccaaaaguaaucgccugcgaaagggauuugagaugaucugggaccccaacggcuggacuaauacagauuccgacuucagcgucaaacaagaugugguugccauuaccgacuggucuggguacucaggaaguuuugugcagcacccugaacucacggguuuagauugcauaagaccauguuucugggucgagcuggugaggggccuuccccgggaaaacaccacaaucuggacuagcggguccucuauuucguucugcggaguaaacagcggcaccgcuaauugguccuggccugacggugccgaguugccauuuacaaucgauaaguga

SEQ ID NO: 143477 - RNA, 1410 nt, Artificial Sequence
  derived and/or modified sequence opt3 from neuraminidase__InfluenzaA__AEX33971
augaaccccaaucagaagaucauuaccauaggcagcgugucccugacaaucucuacuauuugcuucuuuaugcaaaucgccauucucaucacgaccgucacacuucacuucaaacaguacgaguuuucaaguccuccaaacaaucagguuaugcugugugaaccggcuauaaucgagagaaacauuacugaaaccguguauuugacaaauaccacuacagagaaggaaaucugccccaaauuagcagaguacaggaacuggagcaagccucagugugacauuaccggguucgccccauuuuccaaagauaauucuauccggcugucggcgggaggugacauauggguaacgcgcgagcccuaugugucaugcgauccugacaaguguuaccaauucgcucuaggccaggggacuacccucaacaauguccauagcaacgauacagugcacgaccgaacuccauaucguacccugcuuaugaaugaacugggaguucccuuucauuugggcacaaaacaggugugcauugccuggaguuccucuagcugucacgaugguaaggcauggcuccaugucugcgugaccggggacgauaagaacgccacggcuuccuucaucuacaauggaagacugguagacucaauuguuaguuggagcaaagagauccugaggacucaggaaucugagugugugugcaucaacggcacauguaccgucgugaugacugauggcuccgcaucagggaaggccgacacaaaaauucucuuuauagaggaaggaaagaucgugcacaccagcacguuaagugguucugcucaacacgucgaggaaugcuccugcuauccucgguacccaggcguucgcugugugugcagagauaauuggaaggggagcaacaggccgauuguagacaucaacauaaaagacuacucgauugugucucgguaugucuguuccggaaucgugggcgauacccccaggaagaaugacucaaguagcuccucucauugccuggauccuaacaaugaggaaggugggcacggaguuaaaggcugggccuucgacgauggcaacgacguguggauggggcgaacaaucagcgagaagucaagaaguggauacgagacuuuuaaagucauugaagguugguccaauccaaacagcaaacuucagaucaaucgccaggugauuguagaucggggcaaccguucuggguauucaggaauauucaguguugagggcaagagcuguaucaaucgcugcuuuuacguggaauugauuagagguaggaaggaggaaaccgagguccuguggacauccaacucuaucguggucuucugugggacuucgggcaccuauggaacaggcagcuggcccgacggggcggauaucaaucuaaugccuauuuga

SEQ ID NO: 143478 - RNA, 1410 nt, Artificial Sequence
  derived and/or modified sequence opt3 from neuraminidase__InfluenzaA__AEX33993
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccggggaggcagacacuaagauucucuuuaucgaagagggaaaaauagugcauacaucaaccuuaagcgguagugcccaacacguggaagagugcucuugcuauccucgcuacccaggcgucagauguguuugcagggauaacuggaagggguccaaccggccgauuguggacaucaauaucaaggaccacagcauuguaucgucuuacguguguuccggacuggucggcgauacgccccgcaaaaacgacucaaguagcuccucucauugccuugauccuaauaacgaagagggugggcacggagugaagggcugggcuuucgacgauggcaaugacguuuggauggggcgaaccaucagcgagaaaucaagauugggauaugaaacauuuaaggugauugaggguuggaguaacccaaaauccaagcugcagauaaauaggcaggucaucguggaucggggcaaccguagcggguacucuggaauuuucucaguagaaggcaaaaguuguaucaaucgcugcuuuuauguugagcuaaucagagguaggaaggaagagacugaggugcucuggaccagcaacuccauugucguguucugugggacaucuggcacuuacggaaccggcucguggcccgacggggccgauauaaaucugaugccugucuga

SEQ ID NO: 143479 - RNA, 1410 nt, Artificial Sequence; identical to SEQ ID NO: 138528
  derived and/or modified sequence opt3 from neuraminidase__InfluenzaA__AEX34026

SEQ ID NO: 143480 - RNA, 1410 nt, Artificial Sequence
  derived and/or modified sequence opt3 from neuraminidase__InfluenzaA__AEX34036
augaaccccaaucagaagaucauuaccauaggcagcgugucccugacaaucucuacuauuugcuucuuuaugcaaaucgccauucucaucacgaccgucacacuucacuucaaacaguacgaguuuucaaguccuccaaacaaucagguuaugcugugugaaccgacuauaaucgagagaaacauuaccgaaaucguguauuugacaaauaccacuauugagaaggaaaucugccccaaauuagcugaguacaggaacuggagcaagccucagugugacauaacaggguucgcaccauuuuccaaagauaauucuauucggcugucggccggaggugacaucuggguaacccgcgagcccuaugugucaugcgauccugacaaguguuaccaauucgcgcuaggccaggggacgacucucaacaauguccauagcaacgauaccgugcacggacgaacaccauaucguacucugcuuaugaaugaacugggcguucccuuucauuuggguaccaaacaggugugcauugcuuggaguuccucuagcugucacgacgggaaggccuggcuccaugucugcgugacaggagaugacaagaacgcaaccgccuccuucaucuacaauggcagacugguagauucaaucguuaguuggagcaaagagauucugaggacgcaggaaucugagugugugugcauaaacggcacuugugcugucgugaugacagacggguccgcaucaggaaaggccgauaccaaaauccucuuuauugaggaagguaagaucgugcacacuagcacauuaaguggcucugcucaacacgucgaggaaugcuccugcuauccucgguacccagggguucgcugugugugcagagacaauuggaagggaagcaacaggccgauaguagauauuaacaucaaagacuacucgaucgugucucgguaugucuguuccggccuggugggugacacccccaggaagaaugauucaaguagcuccucucauugccuugacccuaacaaugaggaagggggacacggcguuaaaggcugggccuucgaugacggggaugacguguggaugggacgaacgauuagcgagaagucaagaagugguuacgagaccuuuaaagucaucgaaggcugguccaacccaaauagcaaguugcagauuaaccgccaggugauaguagaucgggggaaucguucuggauauucaggcaucuucaguguugaggguaaaagcuguauuaaccgcugcuuuuacguggaacugaucagagggaggaaggaggaaacagagguccuauggacuuccaauucuaucguggucuucuguggcaccucgggaacauauggcacugggagcuggcccgacggagcggauauuaaccucaugccuauauga

SEQ ID NO: 143481 - RNA, 1410 nt, Artificial Sequence
  derived and/or modified sequence opt3 from neuraminidase__InfluenzaA__AEX34058
augaaccccaaucagaagaucauuaccauaggcagcgugucccugacaaucucuacuauuugcuucuuuaugcagaucgccauucucaucacgaccgucacacuucacuucaaacaguacgaguuuucaaguccuccaaacaaucagguuaugcugugugaaccggcuauaaucgagagaaacauuacugaaaucguguauuugaccaauacaaccauugagaaggaaaucugccccaaauuaacugaguacaggaacuggagcaagccucagugugacauaacaggguucgcaccauuuuccaaagauaauucuauucggcugucggccggaggugacaucuggguaacccgcgagcccuaugugucaugcgauccugacaaguguuaccaauucgcgcuaggccaggggacgacucucaacaauguccauagcaacgauaccgugcacgaccgaacaccauaucguacucugcuuaugaaugaacugggaguucccuuucauuugggcaccaaacaggugugcauugcuuggaguuccucuagcugucacgaugguaaggccuggcuccaugucugcgugacaggggacgauaagaacgcaaccgccuccuucaucuacaauggaagacugguagacucaaucguuaguuggagcaaagagauucugaggacgcaggaaucugagugugugugcauaaacggcacuuguacagucgugaugaccgauggcuccgcuucagggaaggcagacacuaaaauccucuuuauugaggaaggaaagaucgugcacacaagcaccuuaagugguucugcccaacacgucgaggaaugcuccugcuauccucgguacccaggcguucgcugugugugcagagauaauuggaaggggagcaacaggccgauaguagacauuaacaucaaagacuacucgaucgugucucgguaugucuguuccggacuggugggcgauacgccccgcaagaaugacucaaguagcuccucucauugccuugauccuaacaaugaggaaggugggcacggaguuaaaggcugggcuuucgacgauggcaacgacguguggauggggcgaaccauuagcgagaagucaagaaguggauacgagacauuuaaagucaucgaagguugguccaauccaaacagcaaguugcagauuaauaggcaagugauaguagaucggggcaaccguucuggguauucaggaaucuucaguguugagggcaaaagcuguauuaaucgcugcuuuuacguggaacugaucagagguaggaaggaggaaacugagguccuauggaccuccaacucuaucguggucuucugugggacaucgggcacuuauggaaccggcagcuggcccgacggggccgauauuaaucucaugccuauauga

SEQ ID NO: 143482 - RNA, 1410 nt, Artificial Sequence
  derived and/or modified sequence opt3 from neuraminidase__InfluenzaA__AEX34103
augaaccccaaucagaagaucauuaccauaggcagcgugucccugacaaucucuacuauuugcuucuuuaugcaaaucgccauucucaucacgaccgucacacuucacuucaaacaguacgaguuuucaaguccuccaaacaaucagguuaugcugugugaaccgacuauaaucgagagaaacauuaccgaaaucguguauuugacaaauaccacuauugagaaggaaguaugccccaaauuagcugaguacaggaacuggagcaagccucagugugacaucacaggguucgcaccauuuuccaaagauaauucuauacggcugucggccggaggugacauuugggugacccgcgagcccuaugucucaugcgauccugacaaguguuaccaauucgcgcuaggccaggggacgacucucaacaaugugcauagcaacgauaccguucacgaccgaacaccauaucguacucugcuuaugaaugaacugggagugcccuuucauuugggcaccaagcaggucugcaucgcuuggaguuccucuagcugucacgaugguaaagccuggcuccaugugugcguaacaggggacgauaagaacgcaaccgccuccuucauuuacaauggaagacugguugacucaaucgugaguuggagcaaagagauccugaggacgcaggaaucugagugugucugcauuaacggcacuuguacaguggugaugaccgauggcuccgcuucagggaaggcagacacuaaaauacucuuuaucgaggaaggaaagauuguccacacaagcaccuuaagugguaaugcccaacacguugaggaaugcucuugcuauccucgguacccaggcgugcgcuguguaugcagagauaacuggaagggguccaacaggccgaucguggacauaaauauuaaagacuacagcaucgucucgcgguauguguguucuggacugguuggcgauacgccccgcaagaacgacuccucaaguagcucccauugccuugauccuaauaacgaggaaggugggcacggagugaaaggcugggcuuucgacgauggcaaugacgucuggauggggcgaaccaucucugaaaagagcagaucaggauacgagacauuuaaagugauugaggguuggaguaacccaaauuccaaguugcagaucaacaggcagguaauuguugaucggggcaaucguagcggguauucuggaauauucucaguggagggcaaaaguuguaucaaccgcugcuuuuacgucgaacugauuagagguaggaaggaggaaacuaaggugcuauggaccagcaauuccaucgucguguucugugggacaucuggcacuuauggaaccggcucguggcccgacggggccgauaucaaccucaugccuauuuga

SEQ ID NO: 143483 - RNA, 1410 nt, Artificial Sequence
  derived and/or modified sequence opt3 from neuraminidase__InfluenzaA__AEX34114
augaaccccaaucagaagaucauuaccauaggcagcgugucccugacaaucucuacuauuugcuucuuuaugcagaucgccauucucaucacgaccgucacacuucacuucaaacaguacgaguuuucaaguccuccaaacaaucagguuaugcugugugaaccggcuauaaucgagagaaacauuacugaaaucguguaucccaccaauacaaccauugagaaggaaaucugcccuaaauuggcagaguacaggaacuggagcaagccacagugugacauaacuggguucgcccccuuuuccaaagauaauucuauucgguuaucggcgggaggugacaucuggguaacacgcgagccuuaugugucaugcgauccagacaaguguuaccaauucgcucugggccaggggaccacgcuaaacaauguccauagcaacgauacugugcacgaccgaacccccuaucguacacuccugaugaaugaacuuggaguuccuuuucaucugggcacuaaacaggugugcauugccuggaguuccucuagcugucacgaugguaaggcaugguugcaugucugcgugaccggggacgauaagaacgccacagcuuccuucaucuacaauggaagacucguagacucaaucguuaguuggagcaaagagauucugaggacccaggaaucugagugugugugcauaaacggcacguguacugucgugaugacagauggcuccgcaucagggaaggccgacaccaaaauccuguuuauugaggaaggaaagaucgugcacacuagcacacucagugguucugcucaacacgucgaggaaugcuccugcuauccacgguacccgggcguucgcugugugugcagagauaauuggaaggggagcaacaggcccauaguagacauuaacaucaaagacuacucgaucgugucucgguaugucuguuccggauuagugggcgauaccccucgcaagaaugacucaaguagcuccucucauugccuggauccaaacaaugaggaaggugggcacggaguuaaaggcugggccuucgacgauggcaacgacguguggauggggcgaacgauuagcgagaagucaagaaguggauacgagaccuuuaaagucaucgaagguugguccaaucccaacagcaaacuucagauuaauaggcaagugauaguagaucggggcaaccguucuggguauucaggaaucuucaguguugagggcaagagcuguauuaaucgcugcuuuuacguggaauugaucagagguaggaaggaggaaacagagguccuguggacuuccaacucuaucguggucuucugugggaccucgggcacauauggaacuggcagcuggccugacggggcggauauuaaucuaaugccaauauga

SEQ ID NO: 143484 - RNA, 1410 nt, Artificial Sequence
  derived and/or modified sequence opt3 from neuraminidase__InfluenzaA__AEX34137
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgaggacguacaccauauagaacucugcuuaugaacgaacugggcguucccuuucacuuggguaccaaacaggugugcauugcuuggagcaguuccucuugucaugacgggaaggccuggcuccacgucugcaucacaggagaugacaagaaugcaaccgccagcuucaucuacaacggcaggcugguggauuccauuguaucauggaguaaagagauacugcggacgcaggaaagcgaguguguuugcaucaauggcacuuguacaguggucaugaccgacgggucugcuuccggaaaggcagauacuaaaauucucuuuaucgaggaagguaagauagugcauacaucaaccuuaagcggcagugcccaacacguggaggaaugcucuugcuauccucgcuacccaggggucagauguguuugcagggacaacuggaagggauccaaccggccgauuguggauaucaauaucaaagaccacagcauuguaucgucuuacguguguuccggccuggucggugacacgccccgcaagaacgauucaaguagcuccucucauugccuugacccuaauaacgaggaagggggacacggcgugaaaggcugggcuuucgaugacgggaaugauguuuggaugggacgaaccaucagcgagaagucaagauuggguuaugagacauuuaaagugauugaaggcuggaguaacccaaaguccaaacugcagauaaauaggcaggucaucguggaccgggggaaccguagcggauacucuggcauuuucucaguagaggguaagaguuguaucaaucgcugcuuuuauguugaacuaaucagagggaggaaggaggaaacugaggugcucuggaccagcaacuccauugucguguucuguggcacaucuggaacuuacggcaccgggucguggcccgauggagccgacauaaaucugaugccuaucuga

SEQ ID NO: 143485 - RNA, 1410 nt, Artificial Sequence
  derived and/or modified sequence opt3 from neuraminidase__InfluenzaA__AEX34191
augaaccccaaucagaagaucauuaccauaggcagcgugucccugucuaucucaacaauuugcuucuuuaugcaaaucgccauucucaucacuacggucacccuucacuucaaacaguacgaguuuaacaguagcccuaauaaccagguuaugcugugugaaccaacaauaaucgagagaaauauuacugaaaucguguauuugaccaacacaaccauugagaaggaaaucugcccgaaauuagcugaguacaggaauugguccaagccccagugugacauaacuggguucgcaccuuuuucuaaagauaacucgauucggcugucagccggaggugacaucuggguaacacgcgagccauaugugagcugcgaucccgacaaguguuaccaauucgcgcuaggccaggggaccacgcucaauaacguccauaguaauaacacugugcgagaucguaccccuuauagaacacugcuuaugaaugaacugggaguuccauuucacuugggcacuaaacaggugugcauugcuugguccucuagcuccugucaugacgguaaggccuggcuccacgucugcaucaccggggaugacaagaacgcaacagccucauucaucuacaauggaaggcugguggauaguauuguaagcuggucuaaagagauacugcggacccaggaauccgaguguguuugcaucaacggcacguguacuguggucaugacagacggcucagcuagcgggaaggcagauaccaaaauucucuuuaucgaggaaggaaagauagugcauacaaguacuuuaucugguuccgcccaacacguggaggaaugcagcugcuauccccgcuacccuggcgucagauguguuugcagggacaacuggaaggggucgaaucggccaauuguggauaucaacaucaaagaccacucuauuguauccucauacguguguaguggacuggucggcgacaccccgcgcaagaaugauagcuccucuagcucacauugccuugaccccaacaaugaggaaggugggcacggagugaaaggcugggcuuucgaugacggcaacgauguuuggauggggcgaacgaucagugagaaguccagauugggauaugagaccuuuaaagugauugaagguuggagcaauccuaagucuaaacugcagauaaacaggcaggucaucguggaccggggcaaucguucaggguacaguggaauuuucagcguagagggcaaguccuguaucaaccgcugcuuuuauguugaacuaaucagagguaggaaggaggaaacagaggugcucuggacuucuaauucgauugucguguucugugggaccagcggcacauacggaacuggcuccuggccagauggggccgacauaaaccugaugcccaucuga

SEQ ID NO: 143486 - RNA, 1410 nt, Artificial Sequence
  derived and/or modified sequence opt3 from neuraminidase__InfluenzaA__AEX34224
augaaccccaaucagaagaucauuaccauaggcagcgugucccugacaaucucuacuauuugcuucuuuaugcagaucgccauucucaucacgaccgucacacuucacuucaaacaguacgaguuuucaaguccuccaaacaaucagguuaugcugugugaaccgacuauaaucgagagaaacauuaccgaaaucguguauuugacaaauaccacuauugagaaggaaaucugccccaaauuagcugaguacaggaacuggagcaagccucagugugacauaacaggguucgcaccauuuuccaaagauaauucuauucggcugucggccggaggugacaucuggguaacccgcgagcccuaugugucaugcgauccugacaaguguuaccaauucgcgcuaggccaggggacgacucucaacaauguccauagcaacgauaccgugcacggacgaacaccauaucguacucugcuuaugaaugaacugggcguucccuuucauuuggguaccaaacaggugugcauugcuuggaguuccucuagcugucacgacgggaaggccuggcuccaugucugcgugacaggagaugacaagaacgcaaccgccuccuucaucuacaauggcagacugguagauucaaucguuaguuggagcaaagagauucugaggacgcaggaaucugagugugugugcauaaacggcacuuguacagucgugaugaccgacggguccgcuucaggaaaggcagauacuaaaauccucuuuauugaggaagguaagaucgugcacacaagcaccuuaaguggcucugcccaacacgucgaggaaugcuccugcuauccucgguacccagggguucgcugugugugcagagacaauuggaagggaagcaacaggccgauaguagauauuaacaucaaagacuacucgaucgugucucgguaugucuguuccggccuggugggugacacgccccgcaagaaugauucaaguagcuccucucauugccuugacccuaacaaugaggaagggggacacggcguuaaaggcugggcuuucgaugacgggaacgauguguggaugggacgaaccauuagcgagaaguugagaucagguuacgagacauuuaaagucaucgaaggcuggaguaauccaaacuccaagcugcagauuaauaggcaagugauaguagaccgggggaaccguagcggauauucuggcaucuucucaguugaggguaaaaguuguauuaaucgcugcuuuuacguggaacuaaucagagggaggaaggaggaaacugagguccucuggaccagcaacuccaucguggucuucuguggcacaucuggaacuuauggcaccgggucguggcccgauggagccgacauuaaucugaugccuauauga

SEQ ID NO: 143487 - RNA, 1410 nt, Artificial Sequence
  derived and/or modified sequence opt3 from neuraminidase__InfluenzaA__AEX34235
augaaccccaaucagaagaucauuaccauaggcagcgugucccugacaaucucuacuauuugcuucuuuaugcaaaucgccauucucaucacgaccgucacacuucacuucaaacaguacgaguuuucaaguccuccaaacaaucagguuaugcugugugaaccggcuauaaucgagagaaacauuacugaaaucguguauuugaccaauacaaccauugagaaggaaaucugccccaaauuagcagaguacaggaacuggagcaagccucagugugacauaacuggguucgccccauuuuccaaagauaauucuauucggcugucggcgggaggugacaucuggguaacacgcgagcccuaugugucaugcgauccugacaaguguuaccaauucgcucuaggccaggggaccacgcucaacaauguccauagcaacgauacugugcacgaccgaaccccauaucguacacugcuuaugaaugaacugggaguucccuuucauuugggcacuaaacaggugugcauugccuggaguuccucuagcugucacgaugguaaggcauggcuccaugucugcgugaccggggacgauaagaacgccacagcuuccuucaucuacaauggaagacugguagacucaaucguuaguuggagcaaagagauucugaggacccaggaaucugagugugugugcauaaacggcacguguacugucgugaugacagauggcuccgcaucagggaaggccgacaccaaaauccucuuuauugaggaaggaaagaucgugcacacuagcacauuaagugguucugcucaacacgucgaggaaugcuccugcuauccucgguacccaggcguucgcugugugugcagagauaauuggaaggggagcaacaggccgauaguagacauuaacaucaaagacuacucgaucgugucucgguaugucuguuccggacuggugggcgauacccccaggaagucagacaguagcuccucuagccauugccuugauccuaauaacgaggaaggugggcacggaguuaaaggcugggccuucgacgauggcaaugacguguggauggggcgaacgauuucagagaagaguagauccggauacgagaccuuuaaagucaucgaagguuggagcaacccaaauucuaaguugcagauuaaccgccaggugauaguagaucggggcaaucguucaggguauaguggaaucuucagcguugagggcaaauccuguauuaaccgcugcuuuuacguggaacugaucagagguaggaaggaggaaacagagguccuauggacuucuaauucgaucguggucuucugugggaccagcggcacauauggaacuggcuccuggcccgacggggcggauauuaaccucaugccuauauga

SEQ ID NO: 143488 - RNA, 1410 nt, Artificial Sequence
  derived and/or modified sequence opt3 from neuraminidase__InfluenzaA__AEX34246
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgaggacguacaccauauagaacucugcuuaugaacgaacugggcguucccuuucacuuggguaccaaacaggugugcauugcuuggagcaguuccucuugucaugacgggaaggccuggcuccacgucugcaucacaggagaugacaagaaugcaaccgccagcuucaucuacaacggcaggcugguggauuccauuguaucauggaguaaagagauacugcggacgcaggaaagcgaguguguuugcaucaauggcacuuguacaguggucaugaccgacgggucugcuuccggaaaggcagauacuaaaauucucuuuaucgaggaagguaagauagugcauacaucaaccuuaagcggcagugcccaacacguggaggaaugcucuugcuauccucgcuacccaggggucagauguguuugcagggacaacuggaagggauccaaccggccgauuguggauaucaauaucaaagaccacagcauuguaucgucuuacguguguuccggccuggucggugacacgccccgcaagaacgauucaaguagcuccucucauugccuugacccuaauaacgaggaagggggacacggcgugaaaggcugggcuuucgaugacgggaaugauguuuggaugggacgaaccaucagcgagaagucaagauuggguuaugagacauuuaaagugauugaaggcuggaguaacccaaaguccaaacugcaggucaauaggcaagugauaguagaccgggggaaccguagcggauacucuggcaucuucucaguugaggguaagaguuguauuaaucgcugcuuuuauguggaacuaaucagagggaggaaggaggaaacugagguccucuggaccagcaacuccaucguggucuucuguggcacaucuggaacuuacggcaccgggucguggcccgauggagccgacauuaaucugaugccuauauga

SEQ ID NO: 143489 - RNA, 1410 nt, Artificial Sequence
  derived and/or modified sequence opt3 from neuraminidase__InfluenzaA__AEX34257
augaaccccaaucagaagaucauuaccauaggcagcgugucccugacaaucucuacuauuugcuucuuuaugcaaaucgccauucucaucacgaccgucacacuucacuucaaacaguacgaguuuaacucaaguccuaauaaccagguuaugcugugugaaccaacuauaaucgagagaaauauuaccgaaaucguguauuugacaaacaccacuauugagaaggaaaucugcccgaaauuagcugaguacaggaauuggagcaagccccagugugacauaacaggguucgcaccuuuuuccaaagauaacucuauucggcugucggccggaggugacaucuggguaacccgcgagccauaugugucaugcgaucccgacaaguguuaccaauucgcgcuaggccaggggacgacucucaauaacguccauagcaauaacaccgugcgaaaucguacaccuuauagaacucugcuuaugaacgaacugggaguuccauuucacuugggcaccaaacaggugugcauugcuuggaguuccucuagcugucaugaugguaaggccuggcuccacgucugcaucacaggggacgauaagaaugcaaccgccuccuucaucuacaacggaaggcugguggacucaauuguaaguuggagcaaagagauacugcggacgcaggaaucugaguguguuugcaucaacggcacuuguacaguggucaugaccgauggcuccgcuucagggaaggcagacacuaaaauucucuuuaucgaggaaggaaagauagugcauacaagcaccuuaagugguucugcccaacacguggaggaaugcuccugcuauccccgcuacccuggcgucagauguguuugcagggauaauuggaaggggagcaaccggccaauuguggacaucaauaucaaagaucacucgauuguaucuuccuacguguguucaggacuggucggcgacacgccgcgcaagaacgacaguagcuccucuagccauugccuugaucccaauaacgaggaaggugggcacggagugaaaggcugggcuuucgacgauggcaaugacguuuggauggggcgaaccaucucagagaagaguagauugggauaugagacauuuaaagugauugaagguugguccaacccuaagagcaaacugcagauaaauaggcaggucaucguggaucggggcaaccguucuggguacucaggaauuuucaguguagagggcaagagcuguaucaaucgcugcuuuuauguugaacuaaucagagguaggaaggaggaaacugaggugcucuggaccuccaacucuauugucguguucugugggacaucgggcacuuacggaaccggcagcuggccagacggggccgauauaaaucugaugcccaucuga

SEQ ID NO: 143490 - RNA, 1410 nt, Artificial Sequence
  derived and/or modified sequence opt3 from neuraminidase__InfluenzaA__AEX34268
augaaccccaauaagaaaaucauuaccauaggcagcgugucccugacaaucucuacuauuugcuucuuuaugcagaucgccauucucaucacgaccgucacacuucacuucaagcaauacgaguuuaacucaccuccaaauaaccagguuaugcugugugaaccgacuauaaucgagagaaauauuaccgaaaucguguauuugacaaacaccacuauugagaaagaaaucugccccaaguuagcugaguacaggaauuggaguaaaccucagugugacauaacaggguucgcaccauuuagcaaggauaacuccauucggcugucugccggaggugacaucuggguaacccgcgagcccuaugugucgugcgauccugacaaguguuaccaguucgcgcuaggccaagggacgacucucaauaacguccauucaaaugauaccgugcgaaaccguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaaaaacgcaaccgccagcuucaucuacaauggaaggcugguggauuccauuguaucauggaguaaggagauacugcggacgcaggaaagcgaguguguuugcaucaacggcacuuguacaguggucaugaccgacggcucugcuuccgggaaagcagauacuaagauucucuuuaucgaggaaggaaagauagugcauacaucaaaauuaagcgguagugcccagcacguggaggaaugcucuugcuauccucgcuacccaggcgucagauguguuugcagggacaacuggaagggguccaaucggccgauuguggauaucaacaucaaagaccacagcauuguaucgucuuacguguguuccggacuggucggcgacacgccccgcaagaaugauucaaguagcuccucucauugccuugacccuaacaaugaggaaggugggcacggagugaaaggcugggcuuucgaugacggcaacgauguuuggauggggcgaaccaucagcgagaagucaagauugggauaugagaccuuuaaagugauugaagguuggaguaauccaaaguccaagcugcaaauaaacaggcaggucaucguggaccggggcaaucguagcggguacucuggaauuuucucaguagagggcaaaaguuguaucaaccgcugcuuuuauguugaacuaaucagagguaggaaggaggaaacagaggugcucuggacuagcaauuccauugucguguucugugggaccucuggcacauacggaacuggcucguggcccgauggggccgacauaaaccugaugccuaucuga

SEQ ID NO: 143491 - RNA, 1410 nt, Artificial Sequence
  derived and/or modified sequence opt3 from neuraminidase__InfluenzaA__AEX34278
augaaccccaaucagaagaucauuaccauaggcagcgugucccugacaaucucuacuauuugcuucuuuaugcaaaucgccauucucaucacgaccgucacacuucacuucaaacaguacgaguuuucaaguccuccaaacaaucagguuaugcugugugaaccggcuauaaucgagagaaacauuacugaaaucguguauuugaccaauacaaccauugagaaggaaaucugccccaaauuagcagaguacaggaacuggagcaagccucagugugacauaacuggguucgccccauuuuccaaagauaauucuauucggcugucggcgggaggugacaucuggguaacacgcgagcccuaugugucaugcgauccugacaaguguuaccaauucgcucuaggccaggggaccacgcucaacaauguccauagcaacgauacugugcacgaccgaaccccauaucguacacugcuuaugaaugaacugggaguucccuuucauuugggcacuaaacaggugugcauugccuggaguuccucuagcugucacgaugguaaggcauggcuccaugucugcgugaccggggacgauaagaacgccacagcuuccuucaucuacaauggaagacugguagacucaaucguuaguuggagcaaagagauucugaggacccaggaaucugagugugugugcauaaacggcacguguacugucgugaugacagauggcuccgcaucagggaaggccgacaccaaaauccucuuuauugaggaaggaaagaucgugcacacuagcacauuaagugguucugcucaacacgucgaggaaugcuccugcuauccucgguacccaggcguucgcugugugugcagagauaauuggaaggggagcaacaggccgauaguagacauuaacaucaaagacuacucgaucgugucucgguaugucuguuccggacuggugggcgauacccccaggaagaaugacucaaguagcuccucucauugccuugauccuaacaaugagaaaggugggcacggaguuaagggcugggccuucgacgauggcaacgacguguggauggggcgaacgauuagcgaaaaaucaagaaguggauacgagaccuuuaaggucaucgaggguugguccaauccaaacagcaaauugcagauuaaucgccaggugauaguagaucggggcaaccguucuggguauucaggaaucuucaguguugaaggcaagagcuguauuaaucgcugcuuuuacguggagcugaucagagguaggaaggaagagacagaaguccuauggacuuccaacucuaucguggucuucugugggaccucgggcacauauggaacuggcagcuggcccgacggggcggauauuaaucucaugccuauauga

SEQ ID NO: 143492 - RNA, 1413 nt, Artificial Sequence
  derived and/or modified sequence opt3 from neuraminidase__InfluenzaA__AEX34310
augaaccccaaucagaagaucauuaccauaggcagcaucuccauugccaucgggauuaucucucugaugcuccaaauaggaaacaucauuucaaucugggcuagucacagcauucagacagguacucagaaucauacgggcaucugcaaccagagaauaauuaccuacgagaauaguacaugggugaaccacacuuaugucaauaucaacaauaccaacguuguggcagggaaagacaagacaccuguaacccuugugggaaauucuucgcuguguucaauuagcggcugggccaucuacacuaaagauaacaguaucaggauugguuccaagggggacgucuucgugauacgggaaccauuuaucucuugcagccauuuggaguguaaaacauucuuuuuaacccaaggagcgcugcuaaaugauaagcacuccaacggcacgguuaaggaccgcucaccguaucgagcucucaugaguugcccccugggcgaagccccuagcccauacaauucuaaauucgaguccguggcauggucagccagcgcuugucaugaugggauuggauggcuuacuaucgguauaaguggccccgacaacggggcagucgccgugcugaaguauaaaggaauuaucaccggcacaaucaagucuuggaaaaagcagauuuugcguacucaggaauccgagugcguauguaugaacgguagcugcuuuaccaucaugacagaugggccuucgaauggagcugccucuuacaagauuuucaaaauagagaagggcaaaguuaccaaguccauggaacucaacgcgccaaauuuucacuaugaggaauguucaugcuaccccgacacgggcacugugaugugugucugcagagauaacuggcacgggaguaauaggccuugggugagcuucaaccagaaucuggacuaccaaaucggauauauuugcuccgguguguuuggcgauaacccacggccgaaagaccgcgaggggucuuguaaucccgucacaguugauggagcaaacggcgugaaggguuucagcuacaaauaugggaauggcguauggaucggaagaaccaagucaaacaggauccggaagggcuuugagaugauuugggacccuaauggguggacuaacacagacagugauuucuccgugaaacaggacauagucgccaucaccgauuggagcggauacucugguucauuugugcagcauccagaacugacgggccucgacugcauucgccccuguuucuggguugaguuagugcgagggcugccuggagaaaauaccacaaucuggacuuccggcagcuccauuucuuucugcggugucaacggggauaucgcuaacuggucguggccagacggcgccgagcuucccuuuaccauagauaaguga

SEQ ID NO: 143493 - RNA, 1413 nt, Artificial Sequence
  derived and/or modified sequence opt3 from neuraminidase__InfluenzaA__AEX34321
augaaccccaaucagaagaucauuaccauaggcagcaucuccauugccaucgggauuaucucucugaugcuccaaauaggaaacaucauuucaaucugggugagucacagcauucagacagguucccagaauaacacuggcaucugcaaucagagaauaauuacguacgagaacucuaccugggugaaucauacauauguuaacaucaauaacacuaaugugguagcuggggaagacaaaaccucggugacacuugcaggaaacucaagccuguguaguauuuccggcugggccaucuacaccaaggauaauucuaucaggauugguagcaaaggggacgucuucgugauacgggagccuuuuaucuccugcucacacuuggaaugucgcacuuucuuuuuaacacaaggagcgcugcuaaacgauaagcauaguaauggcaccguuaaagaccgaagcccauaucgugcucucaugucuugcccgcugggcgaggcccccuccccuuacaacucaaaguucgaaagcguggcauggagugccucugcuugucacgaugggaugggauggcuuacgauugguaucuccggcccagacaacggggcagucgccgugcugaaguauaauggaauaauuacuggcaccaucaaaagcuggaagaaacagaucuugagaacacaggagucggagugcguauguaugaacgguucuugcuuuacuauuaugaccgaugggcccuccaauaaggcugccucauacaaaaucuucaagauugaaaagggaaaaguuacaaagaguauagagcucaacgcgccuaauuuuuauuacgaagaguguagcugcuacccagacaccggcaucgugaugugugucugcagggauaacuggcauggcuccaaucggcccugggugucuuucaaccagaaucuggacuaucaaauuggguacaucugcagcggaguguuuggugauaacccucgcccagaggacggcgaagggucauguaauccggucacgguugauggagcaaacggcgugaaagguuucaguuauaaguacgggaauggcguauggaucggaagaacuaaauccaacaggcugcggaagggcuuugagaugauuugggaccccaauggguggacaaacaccgacagcgauuucucugugaaacaggacgucguggccauaacugauuggucaggauauagugguagcuuuguucagcacccugaacucacaggcuuagacugcauccgcccauguuucuggguggagcugguccgagggcuucccagagaaaacaccacgauuuggaccuccggaucuucgaucagcuucugcggcgucaauuccgauacagcuaacuggucauggccugacggugccgaguugccauuuacuauugauaaguga

SEQ ID NO: 143494 - RNA, 1410 nt, Artificial Sequence; identical to SEQ ID NO: 138073
  derived and/or modified sequence opt3 from neuraminidase__InfluenzaA__AEX34356

SEQ ID NO: 143495 - RNA, 1410 nt, Artificial Sequence
  derived and/or modified sequence opt3 from neuraminidase__InfluenzaA__AEX34367
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccgggaaggcagacacuaaaauucucuuuaucgaggaaggaaagauagugcauacaucaaccuuaagcgguagugccaagcacguggaggaaugcucuugcuauccucgccacccaggcgucagauguguuugcagggauaacuggaaaggguccaaccggccgauuguggacaucaauaucaaggaccauagcauuguaucgucuuacguguguuccggacuggucggcgauacgccccgcaaaaacgacucaaguagcuccucucacugccuugauccuaauaacgaggaaggugggcauggagugaagggcugggcuuucgacgauggcaaugacguuuggauggggcgaaccaucagcgagaaaucaagauugggauacgagacauuuaaggugauugaagguuggaguaacccaaaauccaagcugcaaauaaauaggcaggucaucguggaucggggcaaccguagcggguauucuggaauuuucucaguagagggcaagaguuguaucaaucgcugcuuuuacguugaacuaaucagagguaggaaagaggaaacugaggugcucuggaccagcaacuccauugucguguucugugggacaucuggcacuuauggaaccggcucguggcccgacggggccgauauaaaucugaugccuaucuga

SEQ ID NO: 143496 - RNA, 1410 nt, Artificial Sequence
  derived and/or modified sequence opt3 from neuraminidase__InfluenzaA__AEX34378
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaauuuagcugaguacaggaacuggaguaaaccucagugugacauaacaggguucgcaccauuuagcaaggauaauuccauucggcugucugccggaggugacaucuggguaacccgcgagcccuaugugucgugcgauccugacaaauguuaccaauucgcgcuaggccaggggacgacucucaacaauguccauucaaacgauaccgugcgagaccguacaccauauagaacucugcuuaugaaugaacugggaguucccuuucacuugggcaccaaacaggugugcauugcuuggagcaguuccucuugucaugaugguaaggccuggcuccacgucugcaucacaggggacgauaagaacgcaaccgccagcuucaucuacaauggaaggcugguggacuccauuguaucauggaguaaggagauacugcggacgcaggaaagcgaguguguuugcaucaacggcacuuguacaguggucaugaccgauggcucugcuuccgggaaagcagacacuaagauucucuuuaucgaggaaggaaaaauagugcauacaucaaccuuaagcgguagugccaagcacguggaggaaugcucuugcuauccucgccacccaggcgucagauguguuugcagggauaacuggaagggguccaaucggccgauuguggacaucaacaucaaagaccauagcauuguaucgucuuacguguguuccggacuggucggcgauacgccccgcaagaaugacucaaguagcuccucucacugccuugauccuaacaaugaggaaggugggcauggagugaaaggcugggcuuucgacgauggcaacgacguuuggauggggcgaaccaucagcgagaagucaagauugggauacgagacauuuaaagugauugaagguuggaguaauccaaaguccaaacugcaaauaaacaggcaggucaucguggaucggggcaaucguagcggguauucuggaauuuucucaguagagggcaagaguuguaucaaccgcugcuuuuacguugaacuaaucagagguaggaaggaggaaacugaggugcucuggaccagcaauuccauugucguguucugugggacaucuggcacuuauggaaccggcucguggcccgacggggccgauauaaaccugaugccuaucuga

SEQ ID NO: 143497 - RNA, 1410 nt, Artificial Sequence
  derived and/or modified sequence opt3 from neuraminidase__InfluenzaA__AEX34400
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgaggacguacaccauauagaacucugcuuaugaacgaacugggcguucccuuucacuuggguaccaaacaggugugcauugcuuggagcaguuccucuugucaugacgggaaggccuggcuccacgucugcaucacaggagaugacaagaaugcaaccgccagcuucaucuacaacggcaggcugguggauuccguaguuucauggaguaaagagauucugcggacgcaggaaagcgagugugugugcauaaauggcacuuguacagucgugaugaccgacgggucugcuuccggaaaggcagauacuaaaauccucuuuauuaaggaggguaagaucgugcauacaucaaccuuaagcggcagugcccaacacgucgaagagugcucuugcuauccucgcuacccagggguuagaugugugugcagggacaacuggaaaggauccaaccggccgauaguagauauuaauaucaaggaccacagcaucgugucgucuuacgucuguuccggccuggugggugacacgccccgcaaaaacgauucaaguagcuccucucauugccuugacccuaauaacgaagaagggggacacggcguuaagggcugggcuuucgaugacgggaaugauguguggaugggacgaaccauuagcgagaaaucaagauuggguuaugagacauuuaaggucaucgagggcuggaguaacccaaaauccaagcugcagauuaauaggcaagugauaguagaccgggggaaccguagcggauacucuggcaucuucucaguugaagguaagaguuguauuaaucgcugcuuuuauguggagcuaaucagagggaggaaagaagagacugaaguccucuggaccagcaacuccaucguggucuucuguggcacaucuggaacuuacggcaccgggucguggcccgauggagccgacauuaaucugaugccuauauga

SEQ ID NO: 143498 - RNA, 1413 nt, Artificial Sequence
  derived and/or modified sequence opt3 from neuraminidase__InfluenzaA__AEX34432
augaaccccaaucagaagaucauuaccauaggcagcaucuccauugccaucgggauuaucucucugauacuccaaaucggaaacauuaucucaauuugggcuagucacagcauccagacagguucccagaaucauacuggcauaugcaaccagagaauuaucacguacgaaaauucuaccugggugaacaauacauaugucaacauuaauaacacuaauguugugguagagaaagacaagaccucggugacacuugcagggaacucaagccuguguaguaucuccggaugggccaucuacaccaaagauaauucuauuaggauaggcagcaagggugacgucuucgugauccgggagccuuuuauuuccugcucacacuuggaaugucgcacuuucuuuuuaacacaaggggcgcugcuaaacgauaaacauaguaauggaaccguuaaggaccgaagcccauaucgugcucucaugucuugcccgcugggcgaggcccccuccccuuacaacucaagauucgaaagcguggcauggagugccucugcuugucacgauggcaugggguggcuuacgaucggaauauccgguccagacaacggcgcagucgccgugcugaaguauaaugggauuaucacugagaccaucaaaagcuggaagaaaaggauuuugcggacacaggagucggaaugcguauguaugaacggaucuugcuuuacuaucaugaccgauggccccuccaaugguacagcuucauacaagauuuucaaaauagagaaggggaagguuaccaaaacgaucgaacucaacgccccuaauuuucauuaugaggaguguaguugcuacccagacacuggaacagugaugugugucugccgcgauaacuggcacggcagcaauagacccuggguguccuucaaccagaaucuggacuaccagauuggcuauaucugcucugggguguuuggagauaacccuaggccaaaggacggugaaggcagcuguaauccggucaccguugauggggcggacggagugaaaggcuucucauacaaguaugguaacgggguauggaucggccggacuaaaaguaaucgccugcgaaagggauuugagaugauuugggaccccaacggcuggacaaauaccgauuccgacuucagcgugaaacaagaugucguggcaauaacggacuggucuggguacucaggaaguuuuguucagcacccugaacucaccgguuuagauugcaucagaccauguuucuggguggagcuggucaggggccuuccccgggaaaacacaacuauuuggaccagcggguccucuaucucguucugcggagugaacagcggcacagccaauugguccuggccugacggugcugaguugccauuuacuauugauaaguga

SEQ ID NO: 143499 - RNA, 1413 nt, Artificial Sequence; identical to SEQ ID NO: 143498
  derived and/or modified sequence opt3 from neuraminidase__InfluenzaA__AEX34443

SEQ ID NO: 143500 - RNA, 1410 nt, Artificial Sequence; identical to SEQ ID NO: 138619
  derived and/or modified sequence opt3 from neuraminidase__InfluenzaA__AEX34454

SEQ ID NO: 143501 - RNA, 1413 nt, Artificial Sequence
  derived and/or modified sequence opt3 from neuraminidase__InfluenzaA__AEX34465
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaagacggcgaggggucauguaacccggucacuguugauggagccgacggcaucaaggguuucaguuacaaauaugggaauggcguguggaucggaaggacaaaguccaaccggcugcgcaaaggcuuugaaaugauuugggaccccaauggguggaccgauacugacagcgauuucucuguaaagcaagacguggucgcuauaacagauuggucaggauacagugguagcuuugugcagcauccugagcucaccggcuuagacugcaugcgaccauguuucuggguugaacuggugagagggcuucccagggagaacacgaccaucuggacauccggaucuucgauuagcuucugcggcgucaauuccgauacugccaacuggucauggccugacggugcagaauugccauuuaccaucgauaaguga

SEQ ID NO: 143502 - RNA, 1413 nt, Artificial Sequence; identical to SEQ ID NO: 143455
  derived and/or modified sequence opt3 from neuraminidase__InfluenzaA__AEX34476

SEQ ID NO: 143503 - RNA, 1413 nt, Artificial Sequence; identical to SEQ ID NO: 143457
  derived and/or modified sequence opt3 from neuraminidase__InfluenzaA__AEX34487

SEQ ID NO: 143504 - RNA, 1413 nt, Artificial Sequence; identical to SEQ ID NO: 143457
  derived and/or modified sequence opt3 from neuraminidase__InfluenzaA__AEX34498

SEQ ID NO: 143505 - RNA, 1413 nt, Artificial Sequence; identical to SEQ ID NO: 143457
  derived and/or modified sequence opt3 from neuraminidase__InfluenzaA__AEX34509

SEQ ID NO: 143506 - RNA, 1413 nt, Artificial Sequence; identical to SEQ ID NO: 143457
  derived and/or modified sequence opt3 from neuraminidase__InfluenzaA__AEX34520

SEQ ID NO: 143507 - RNA, 1413 nt, Artificial Sequence; identical to SEQ ID NO: 143457
  derived and/or modified sequence opt3 from neuraminidase__InfluenzaA__AEX34531

SEQ ID NO: 143508 - RNA, 1413 nt, Artificial Sequence; identical to SEQ ID NO: 143457
  derived and/or modified sequence opt3 from neuraminidase__InfluenzaA__AEX34542

SEQ ID NO: 143509 - RNA, 1413 nt, Artificial Sequence; identical to SEQ ID NO: 143457
  derived and/or modified sequence opt3 from neuraminidase__InfluenzaA__AEX34553

SEQ ID NO: 143510 - RNA, 1413 nt, Artificial Sequence; identical to SEQ ID NO: 143457
  derived and/or modified sequence opt3 from neuraminidase__InfluenzaA__AEX34564

SEQ ID NO: 143511 - RNA, 1413 nt, Artificial Sequence; identical to SEQ ID NO: 143457
  derived and/or modified sequence opt3 from neuraminidase__InfluenzaA__AEX34575

SEQ ID NO: 143512 - RNA, 1413 nt, Artificial Sequence; identical to SEQ ID NO: 143457
  derived and/or modified sequence opt3 from neuraminidase__InfluenzaA__AEX34586

SEQ ID NO: 143513 - RNA, 1413 nt, Artificial Sequence; identical to SEQ ID NO: 143457
  derived and/or modified sequence opt3 from neuraminidase__InfluenzaA__AEX34597

SEQ ID NO: 143514 - RNA, 1413 nt, Artificial Sequence; identical to SEQ ID NO: 143457
  derived and/or modified sequence opt3 from neuraminidase__InfluenzaA__AEX34608

SEQ ID NO: 143515 - RNA, 1413 nt, Artificial Sequence; identical to SEQ ID NO: 143457
  derived and/or modified sequence opt3 from neuraminidase__InfluenzaA__AEX34619

SEQ ID NO: 143516 - RNA, 1413 nt, Artificial Sequence; identical to SEQ ID NO: 143457
  derived and/or modified sequence opt3 from neuraminidase__InfluenzaA__AEX34630

SEQ ID NO: 143517 - RNA, 1413 nt, Artificial Sequence; identical to SEQ ID NO: 143457
  derived and/or modified sequence opt3 from neuraminidase__InfluenzaA__AEX34641

SEQ ID NO: 143518 - RNA, 1413 nt, Artificial Sequence
  derived and/or modified sequence opt3 from neuraminidase__InfluenzaA__AEX34653
augaaccccaaucagaagaucauuaccauaggcagcaucuccauugccaucgggauuaucucucugaugcuccaagugggaaacauaaucucaauuugggcuagucacagcauccagacagguucccagaaucauacuggcauuugcaaccagagaaucauaacguacgagaauagcaccugggucaaccacacauauguuaauauuaacaauacuaacgugguagcagggaaagacaagaccucgguggcccuugcgggaaauucaagccuguguaguaucuccggcugggcuauuuacacaaaagauaacucuaucaggaucgguagcaagggggacgucuucgugauucgggaaccuuuuauauccugcucacauuuggagugucgcaccuucuuuuuaacucaaggagcccugcuaaaugauaaacacaguaacggcacaguuaaggaccgaagcccauaucgugcacucaugucuugcccgcugggcgaagcccccuccccuuacaauucaaaguucgagagcguggcuuggagugcaucugccugucaugaugggcuuggauggcugaccaucgguauuuccggcccagacaacggggcugucgccguguugaaauauaacggaaucauaacggaaacuauuaagagcuggaaaaagagaauccucaggacccaggagucggagugcguauguguuaauggcucuugcuuuacaaucaugacugauggucccuccaacggggcggcaucauacaaaauuuucaagaucgaaaagggacaggugaccaaaagugucgagcugaaugccccuaacuuucacuaugaagaguguagcugcuacccagacacaggcaccgugaugugugugugccgggauaauuggcacggcuccaaccgccccugggucucuuucaaucaggaccuggauuaccaaauuggguauauaugcagcggaguuuuuggugacaacccuagaccaaaggauggcaaagggucauguaauccggugacgguagacggagcugacggcgugaaggguuucaguuacaaauaugggaacggcgucuggaucggaaggacuaaguccaaucggcuccgcaaaggcuuugagaugauuugggaucccaacggguggacagacaccgauagcgacuucucugugaagcaggauguuguggccaucacugacuggucaggauacagugguagcuuuguccagcauccugaauuaacaggccuggauugcauccgaccauguuucuggguggagcuuguaagaggguugcccagggaaaauaccacgauuuggaccuccggaucuucgauaucuuucugcggcguugacuccgauacagcaaacuggucauggccugacggugcugagcugccauuuacuaucgauaaguga

SEQ ID NO: 143519 - RNA, 1413 nt, Artificial Sequence
  derived and/or modified sequence opt3 from neuraminidase__InfluenzaA__AEX34664
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagagucgggagcucaaugcaccuaacuuucacuaugaagaguguagcugcuacccagacaccggcacggugaugugugucugccgcgauaauuggcacggcuccaacagacccugggugucuuucaaucagaaccuggacuaccagauaggguauaucugcagcggaguguuuggugauaauccuaggccaaaagacggcaaggggucauguaacccggucacugccgauggagcugacggcguuaaagguuucaguuacaaguaugggaauggcguguggauuggacggacaaaauccaaccgccugcgaaagggcuuugagaugaucugggaccccaauggguggaccgauacugacagcgauuucucuguaaagcaagacguggucgccaucacagauuggucaggauacagugguagcuuugugcagcauccugaacucaccggcuuagacugcauuagaccauguuucuggguugagcuggugagggggcuuccccgggaaaacacgaccauauggacauccggaucuucgaucagcuucugcggcgucgauuccgacacugcaaauuggucauggccugauggugcugaguugccauuuaccauugacaaauga

SEQ ID NO: 143520 - RNA, 1413 nt, Artificial Sequence; identical to SEQ ID NO: 143498
  derived and/or modified sequence opt3 from neuraminidase__InfluenzaA__AEX34686

SEQ ID NO: 143521 - RNA, 1413 nt, Artificial Sequence
  derived and/or modified sequence opt3 from neuraminidase__InfluenzaA__AEX34760
augaaccccaaucagaagaucauuaccauaggcagcaucuccauugccaucgggauuaucucucugauacuccaaaucggaaacauuaucucaauuugggcuagucacagcauccagacagguucccagaaucauacuggcauaugcaaccagagaauuaucacguacgaaaauucuaccugggugaacaauacauaugucaacauuaauaacacuaauguugugguagagaaagacaagaccucggugacacuugcagggaacucaagccuguguaguaucuccggaugggccaucuacaccaaagauaauucuauuaggauaggcagcaagggugacgucuucgugauccgggagccuuuuauuuccugcucacacuuggaaugucgcacuuucuuuuuaacacaaggggcgcugcuaaacgauaaacauaguaauggaaccguuaaggaccgaagcccauaucgugcucucaugucuugcccgcugggcgaggcccccuccccuuacaacucaagauucgaaagcguggcauggagugccucugcuugucacgauggcaugggguggcuuacgaucggaauauccgguccagacaacggcgcagucgccgugcugaaguauaaugggauuaucacugagaccaucaaaagcuggaagaaaaggauuuugcggacacaggagucggaaugcguauguaugaacggaucuugcuuuacuaucaugaccgauggccccuccaauggugcugccucauacaagauuuucaaaauagagaaggggaagguuacaaaaaccaucgaacucaacgcgccuaauuuucauuaugaggaguguaguugcuacccagacacgggaacugugaugugugucugccgcgauaacuggcacggcagcaauagacccuggguguccuucaaccagaaucuggacuaccagauuggcuauaucugcucugggguguuuggagauaacccuaggccaaaggacggugaaggcagcuguaauccggucacaguugauggggcagacggagugaaaggcuucucauacaaguaugguaacgggguauggaucggccggaccaaaaguaaucgccugcgaaagggauuugagaugauuugggaccccaacggcuggacuaauacagauuccgacuucagcgugaaacaagaugucguggccauaaccgacuggucuggguacucaggaaguuuuguucagcacccugaacucacggguuuagauugcaucagaccauguuucuggguggagcuggucaggggccuuccccgggaaaacaccacaauuuggacuagcggguccucuaucucguucugcggagugaacagcggcaccguaaauugguccuggccugacggugcugaguugccauuuacaauugauaaguga

SEQ ID NO: 143522 - RNA, 1413 nt, Artificial Sequence
  derived and/or modified sequence opt3 from neuraminidase__InfluenzaA__AEX34771
augaaccccaaucagaagaucauuaccauaggcagcaucuccauugccaucgggauuaucucucugauacuccaaaucggaaacauuaucucaauuugggcuagucacagcauccagacagguucccagaaucauacuggcauaugcaaccagagaauuaucacguacgaaaauucuaccugggugaacaauacauaugucaacauuaauaacacuaauguugugguagagaaagacaagaccucggugacacuugcagggaacucaagccuguguaguaucuccggaugggccaucuacaccaaagauaauucuauuaggauaggcagcaagggugacgucuucgugauccgggagccuuuuauuuccugcucacacuuggaaugucgcacuuucuuuuuaacacaaggggcgcugcuaaacgauaaacauaguaauggaaccguuaaggaccgaagcccauaucgugcucucaugucuugcccgcugggcgaggcccccuccccuuacaacucaagauucgaaagcguggcauggagugccucugcuugucacgauggcaugggguggcuuacgaucggaauauccgguccagacaacggcgcagucgccgugcugaaguauaaugggauuaucacugagaccaucaaaagcuggaagaaaaggauuuugcggacacaggagucggaaugcguauguaugaacggaucuugcuuuacuaucaugaccgauggccccuccaauggugcugccucauacaagauuuucaaaauagagaaggggaagguuacaaaaaccaucgaacucaacgcgccuaauuuucauuaugaggaguguaguugcuacccagacacgggaacugugaugugugucugccgcgauaacuggcacggcagcaauagacccuggguguccuucaaccagaaucuggacuaccagauuggcuauaucugcucugggguguuuggagauaacccuaggccaaaggacggugaaggcagcuguaauccggucacaguugauggggcagacggagugaaaggcuucucauacaaguaugguaacgggguauggaucggccggaccaaaaguaaucgccugcgaaagggauuugagaugauuugggaccccaacggcuggacuaauacagauuccgacuucagcgugaaacaagaugucguggccauaaccgacuggucuggguacucaggaaguuuuguucagcacccugaacucacggguuuagauugcaucagaccauguuucuggguggagcuggucaggggccuuccccgggaaaacaccacaauuuggacuagcggguccucuaucucguucugcggagugaacagcggcaccgcuaauugguccuggccugacggugccgaguugccauuuacaauugauaaguga

SEQ ID NO: 143523 - RNA, 1413 nt, Artificial Sequence; identical to SEQ ID NO: 139477
  derived and/or modified sequence opt3 from neuraminidase__InfluenzaA__AEX34782

SEQ ID NO: 143524 - RNA, 1413 nt, Artificial Sequence
  derived and/or modified sequence opt3 from neuraminidase__InfluenzaA__AEX34793
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccccuguaacacuugugggaaauucgucacuguguagcauuaguggcugggccaucuacaccaaagauaacuccaucaggauugguucuaagggggacgucuucgugauacgggagccauuuaucagcugcucccauuuggaguguaaaacuuucuuuuuaacacaaggagcgcugcuaaaugauaagcacucaaacggcaccguuaaggaccgcaguccguaucgagcucucaugagcugcccccugggcgaagccccuucuccauacaauuccaaauucgagucaguggcauggagcgccagugcuugucaugaugggauuggauggcuuacgaucgguauaucuggccccgacaacggggcagucgccgugcugaaguauaaaggaauuaucacuggcaccaucaaguccuggaaaaagcagauuuugcguacacaggaaagcgagugcguauguaugaacgguucgugcuuuacuaucaugaccgaugggccuucuaauggagcugccuccuacaagauuuucaaaauagagaagggcaaaguuacaaagucaauggaacucaacgcgccaaauuuucacuaugaggaauguaguugcuaccccgacaccggcacggugaugugugucugcagagauaacuggcacgggagcaauaggccuuggguguccuucaaccagaaucuggacuaccaaaucggauauauuugcucugguguguuuggcgauaacccacggccgaaagaccgcgaggggagcuguaaucccgucacuguugauggagcaaacggcgugaaggguuucucauacaaauaugggaauggcguauggaucggaagaacaaagaguaacaggauccggaagggcuuugagaugauuugggacccuaauggguggaccaacacugacuccgauuucagcgugaaacaggacauagucgccaucacagauuggucuggauacucagguaguuuugugcagcauccagaacugaccggccucgacugcauucgccccuguuucuggguugaguuagugcgagggcugccuagagaaaauacgaccaucuggacaagcggauccucuauuucguucugcggcgucaacggugauaucgcuaacuggagcuggccagacggggccgagcuucccuuuacuauagauaaguga

SEQ ID NO: 143525 - RNA, 1413 nt, Artificial Sequence; identical to SEQ ID NO: 143524
  derived and/or modified sequence opt3 from neuraminidase__InfluenzaA__AEX34804

SEQ ID NO: 143526 - RNA, 1413 nt, Artificial Sequence
  derived and/or modified sequence opt3 from neuraminidase__InfluenzaA__AEX34815
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuuaccggaaacucaagccuguguaguauuuccggcugggccaucuacacuaaggauaauucuaucaggauugguagcaaaggggacguguucgucauacgggagccuuuuaucuccugcucacacuuggaaugucgcacauucuuuuuaacccaaggagcgcugcuaaacgauaagcauaguaauggcacggugaaagaccgaagcccauaucgugcucucaugucuugcccgcugggcgaggcccccuccccuuacaacucaaaguucgaaagcguugcauggagugccucugcuugucacgaugggaugggauggcuuacuauugguaucuccggcccagacaacggggcaguggccguccugaaguauaauggaauaauuaccggcacaaucaaaagcuggaagaaacagaucuugagaacucaggagucggagugcguguguaugaacgguucuugcuuuaccauuaugacagaugggcccuccaauaaggcugccucauacaaaaucuucaagauugaaaagggaaaaguaaccaagaguauagagcucaacgcgccuaauuuuuauuacgaagaguguagcugcuacccagacacgggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacugucgauggagcaaacggcguuaaagguuucaguuauaaguacgggaauggcguguggaucggaagaacaaaauccaacaggcugcggaagggcuuugagaugauuugggaccccaauggguggaccaacacugacagcgauuucucuguaaaacaggacguggucgccauaacagauuggucaggauauagugguagcuuugugcagcacccugaacucaccggcuuagacugcauccgcccauguuucuggguugagcuggugcgagggcuucccagagaaaacacgaccauuuggacauccggaucuucgaucagcuucugcggcgucaauuccgauacugcuaacuggucauggccugacggugccgaguugccauuuaccauugauaaguga

SEQ ID NO: 143527 - RNA, 1413 nt, Artificial Sequence; identical to SEQ ID NO: 143524
  derived and/or modified sequence opt3 from neuraminidase__InfluenzaA__AEX34826

SEQ ID NO: 143528 - RNA, 1413 nt, Artificial Sequence; identical to SEQ ID NO: 143524
  derived and/or modified sequence opt3 from neuraminidase__InfluenzaA__AEX34837

SEQ ID NO: 143529 - RNA, 1413 nt, Artificial Sequence
  derived and/or modified sequence opt3 from neuraminidase__InfluenzaA__AEX34859
augaaccccaaucagaagaucauuaccauaggcagcacauccaucgccauugggaucauuucucugaugcuccaaaucggaaacauaaucucaauuugggcuagucacagcauccagacugguucccagaaucauacgggcauuugcaaccagagaaucauaaccuacgaaaauucuacaugggugaaccacacuuaugucaauauuaacaauaccaacguuguggcagggaaagacaagacaccuguaacccuuaucggaaauucgucacuguguagcauuaguggcugggccaucuacacuaaagauaacuccaucaggauugguucuaagggggacguguucgucauacgggagccauuuaucagcugcucccauuuggaguguaaaacauucuuuuuaacccaaggagcgcugcuaaaugauaagcacucaaacggcacggugaaggaccgcaguccguaucgagcucucaugagcugcccccugggcgaagccccuucuccauacaauuccaaauucgagucaguugcauggagcgccagugcuugucaugaugggauuggauggcuuacuaucgguauaucuggccccgacaacggggcaguggccguccugaaguauaaaggaauuaucaccggcacaaucaaguccuggaaaaagcagauuuugcguacucaggaaagcgagugcguguguaugaacgguucgugcuuuaccaucaugacagaugggccuucuaauggagcugccuccuacaagauuuucaaaauagagaagggcaaaguaaccaagucaauggaacucaacgcgccaaauuuucacuaugaggaauguaguugcuaccccgacacgggcacuguuaugugugugugcagagauaacuggcacgggagcaauaggccuugggucuccuucaaccagaaucuggacuaccaaaucggauauauuugcucugguguguuuggcgauaacccacggccgaaagaccgcgaggggagcuguaaucccgugacagucgauggagcaaacggcguuaaggguuucucauacaaauaugggaauggcguguggaucggaagaaccaagaguaacaggauccggaagggcuuugagaugauuugggacccuaauggguggacuaacacagacuccgauuucagcguaaaacaggacauaguggccaucaccgauuggucuggauacucagguaguuuuguccagcauccagaacugacgggccucgacugcauucgccccuguuucuggguggaguuaguucgagggcugccuagagaaaauaccacaaucuggacuagcggauccucuauuucguucugcggcgugaacggugauaucgcuaacuggagcuggccagacggggccgagcuucccuuuaccauagauaaguga

SEQ ID NO: 143530 - RNA, 1413 nt, Artificial Sequence
  derived and/or modified sequence opt3 from neuraminidase__InfluenzaA__AEX34870
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaauuucgguaacccuugccggaaacucaagccuguguaguaucuccggcugggcgaucuacacaaaggauaauucuauuaggauagguagcaaaggggacguguucgucauccgggagccuuuuauuuccugcucacacuuggaaugucgcaccuucuuuuuaacucaaggagcucugcuaaacgauaagcauaguaauggcacagugaaagaccgaagcccauaucgugcccucaugucuugcccgcugggcgaggcacccuccccuuacaacucaaaguucgaaagcguugccuggagugcuucugcaugucacgaugggaucggauggcuuaccauagguauuuccggcccagacaacggggccguggcuguccugaaguauaauggaaucaucacgggcacuauuaaaagcuggaagaaacagaucuugagaacccaggagucggagugcguguguaugaacgguucuugcuuuacaauuaugacugaugggcccuccaauaaggccgcgucauacaaaauauucaagaucgaaaagggaaaaguaaccaagaguauugagcucaacgcaccuaauuuuuauuacgaagaguguagcugcuacccagacacaggcaucguuaugugugugugcagggauaacuggcauggcuccaaucggcccugggucucuuucaaccagaaucuggacuaucaaaucggguacauuugcagcggaguguuuggugauaacccucgcccagaggacggcgaagggucauguaauccggugaccgucgauggagccaacggcguuaaagguuucaguuauaaguacgggaauggcguguggauaggaagaacgaaauccaacaggcugcggaagggcuuugagaugaucugggaccccaauggguggacuaacacagacagcgauuucucuguaaaacaggacguggucgcuauuaccgauuggucaggauauagugguagcuuugugcagcacccugaacucacuggcuuagacugcauccgcccauguuucuggguugagcuggugcgagggcuucccagagaaaacacaaccauuuggacguccggaucuucgaucagcuucugcggcgucaauuccgauaccgccaacuggucauggccugacggugcagaguugccauuuacaauagauaaguga

SEQ ID NO: 143531 - RNA, 1413 nt, Artificial Sequence
  derived and/or modified sequence opt3 from neuraminidase__InfluenzaA__AEX34881
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaaggccccuguaacccuuauuggaaauucgucacuguguagcaucaguggcugggcgaucuacacaaaagauaacuccauuaggauagguucuaagggggacguguucgucauccgggagccauuuauuagcugcucccauuuggaguguaaaaccuucuuuuuaacucaaggagcucugcuaaaugauaagcacucaaacggcacagugaaggaccgcaguccguaucgagcccucaugagcugcccccugggcgaagcaccuucuccauacaauuccaaauucgagucaguugccuggagcgcuagugcaugucaugaugggaucggauggcuuaccauagguauuucuggccccgacaacggggccguggcuguccugaaguauaaaggaaucaucacgggcacuauuaaguccuggaaaaagcagaucuugcguacccaggaaagcgagugcguguguaugaacgguucgugcuuuacaauuaugacugaugggccuucuaauggagccgcguccuacaagauauucaaaaucgagaagggcaaaguaaccaagucaauggaacucaacgcaccaaauuuucacuaugaggaauguaguugcuaccccgacacaggcaccguuaugugugugugcagagauaacuggcacgggagcaauaggccuugggucuccuucaaccagaaucuggacuaccaaauuggauauaucugcucugguguguuuggcgauaacccacggccgaaagaccgcgaggggagcuguaaucccgugacggucgauggagccaacggcguuaaggguuucucauacaaauaugggaauggcguguggaucggaagaacuaagaguaacaggauucggaagggcuuugagaugauaugggacccuaauggguggacaaacaccgacuccgauuucagcguaaaacaggacaucguggcuauuacugauuggucuggauacucagguaguuuuguccagcauccagaacugacaggccucgacugcauccgccccuguuucuggguggaguuaguucgagggcugccuagagaaaauaccacgauuuggaccagcggauccucuaucucguucugcggcgugaacggugauauagccaacuggagcuggccagacggggcagagcuucccuuuacaaucgauaaguga

SEQ ID NO: 143532 - RNA, 1413 nt, Artificial Sequence
  derived and/or modified sequence opt3 from neuraminidase__InfluenzaA__AEX34892
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucgauggagccaacggcguuaaagguuucaguuauaaguacgggaauggcguguggaucggaagaacuaaauccaacaggcugcggaagggcuuugagaugauuugggaccccaauggguggacaaacaccgacagcgauuucucuguaaaacagaacguggucgcuauaacugacuggucaggauauagugguagcuuugugcagcacccugaacucacaggcuuagauugcauccgcccauguuucuggguugagcuggugcgagggcuucccagagaaaauaccacgauuuggaccuccggaucuucgaucagcuucugcggcgucaacuccgacacagccaauuggucauggccugauggugcagaguugccauuuacuauugacaaguga

SEQ ID NO: 143533 - RNA, 1413 nt, Artificial Sequence
  derived and/or modified sequence opt3 from neuraminidase__InfluenzaA__AEX34903
augaaccccaaucagaagaucauuaccauaggcagcaucuccauugccaucgggauuaucucucugaugcuccaaauaggaaacaucauuucaaucugggcuaguagaagcauucagacagguucccagaaucacacuggcaucugcaaccagaggauaauuacguacgaaaauucuaccugggugaaccauacauaugucaauaucaacaauacuaacguuguggcagggaaagacaagaccccuguaacacuugugggaaauucgucacuguguagcauuaguggcugggccaucuacaccaaagauaacuccauccggauugguucuaagggggacgucuucgugauacgcgagccauuuaucagcugcucccacuuggaguguaaaacuuucuuuuuaacacaaggagcgcugcuaaaugauaagcauucaaacggcaccguuaaggaccgaaguccguaucgugcucucaugagcugcccccugggcgaagccccuucuccauacaauuccaaauucgagucaguggcauggagcgccagugcuugucacgaugggauuggauggcuuacgaucgguauaucuggccccgacaacggggcagucgccgugcugaaguauaaaggaauuaucacuggcaccaucaaguccuggaaaaagcagauuuugagaacacaggaaagcgagugcguauguaugaacgguucgugcuuuacuaucaugaccgaugggccuucuaauggagcugccuccuacaagauuuucaaaauagagaagggcaaaguuacaaagucaauggaacucaacgcgccaaauuuucauuaugaggaauguaguugcuaccccgacaccggcacggugaugugugucugcagggauaacuggcacgggagcaaucggccuuggguguccuucaaccagaaucuggacuaccaaaucggauauauuugcucugguguguuuggcgauaacccacgcccgaaagacagagaggggagcuguaaucccgucacuguugauggagcaaacggcgugaaggguuucucauacaaauaugggaauggcguauggaucggaaggacaaagaguaaccggauccgcaagggcuuugagaugauuugggacccuaauggguggaccaacacugacuccgauuucagcgugcgacaggacauagucgccaucacagauuggucuggauacucagguaguuuugugcagcacccagaacugaccggccucgacugcauuagacccuguuucuggguugaguuagugagggggcugccucgggaaaauacgaccaucuggacaagcggauccucuauuucguucugcggcgucaacggugauaucgcuaacuggagcuggccagacggggccgagcuucccuuuacuauagauaaauga

SEQ ID NO: 143534 - RNA, 1413 nt, Artificial Sequence; identical to SEQ ID NO: 139477
  derived and/or modified sequence opt3 from neuraminidase__InfluenzaA__AEX34914

SEQ ID NO: 143535 - RNA, 1413 nt, Artificial Sequence; identical to SEQ ID NO: 139477
  derived and/or modified sequence opt3 from neuraminidase__InfluenzaA__AEX34925

SEQ ID NO: 143536 - RNA, 1413 nt, Artificial Sequence; identical to SEQ ID NO: 139477
  derived and/or modified sequence opt3 from neuraminidase__InfluenzaA__AEX34936

SEQ ID NO: 143537 - RNA, 1413 nt, Artificial Sequence; identical to SEQ ID NO: 139477
  derived and/or modified sequence opt3 from neuraminidase__InfluenzaA__AEX34947

SEQ ID NO: 143538 - RNA, 1413 nt, Artificial Sequence; identical to SEQ ID NO: 139477
  derived and/or modified sequence opt3 from neuraminidase__InfluenzaA__AEX34958

SEQ ID NO: 143539 - RNA, 1413 nt, Artificial Sequence; identical to SEQ ID NO: 139477
  derived and/or modified sequence opt3 from neuraminidase__InfluenzaA__AEX34969

SEQ ID NO: 143540 - RNA, 1413 nt, Artificial Sequence; identical to SEQ ID NO: 139477
  derived and/or modified sequence opt3 from neuraminidase__InfluenzaA__AEX34980

SEQ ID NO: 143541 - RNA, 1413 nt, Artificial Sequence; identical to SEQ ID NO: 139477
  derived and/or modified sequence opt3 from neuraminidase__InfluenzaA__AEX34991

SEQ ID NO: 143542 - RNA, 1413 nt, Artificial Sequence
  derived and/or modified sequence opt3 from neuraminidase__InfluenzaA__AEX35002
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccccuguaacacuuauuggaaauucgucacuguguagcaucaguggcugggccaucuacaccaaagauaacuccauuaggauagguucuaagggggacguguucgucauccgggagccauuuauuagcugcucccauuuggaguguaaaacuuucuuuuuaacacaaggagcgcugcuaaaugauaagcacucaaacggcaccgugaaggaccgcaguccguaucgagcucucaugagcugcccccugggcgaagccccuucuccauacaauuccaaauucgagucaguugcauggagcgccagugcuugucaugaugggaucggauggcuuacgauagguauuucuggccccgacaacggggcaguggccguccugaaguauaaaggaaucaucacuggcaccauuaaguccuggaaaaagcagaucuugcguacacaggaaagcgagugcguguguaugaacgguucgugcuuuacuauuaugaccgaugggccuucuaauggagcugccuccuacaagauauucaaaaucgagaagggcaaaguaacaaagucaauggaacucaacgcgccaaauuuucacuaugaggaauguaguugcuaccccgacaccggcacgguuaugugugugugcagagauaacuggcacgggagcaauaggccuugggucuccuucaaccagaaucuggacuaccaaauuggauauaucugcucugguguguuuggcgauaacccacggccgaaagaccgcgaggggagcuguaaucccgugacugucgauggagcaaacggcguuaaggguuucucauacaaauaugggaauggcguguggaucggaagaacaaagaguaacaggauucggaagggcuuugagaugauaugggacccuaauggguggaccaacacugacuccgauuucagcguaaaacaggacaucguggccauuacagauuggucuggauacucagguaguuuuguccagcauccagaacugaccggccucgacugcauccgccccuguuucuggguggaguuaguucgagggcugccuagagaaaauacgaccauuuggacaagcggauccucuaucucguucugcggcgugaacggugauauagcuaacuggagcuggccagacggggccgagcuucccuuuacuaucgauaaguga

SEQ ID NO: 143543 - RNA, 1413 nt, Artificial Sequence; identical to SEQ ID NO: 139477
  derived and/or modified sequence opt3 from neuraminidase__InfluenzaA__AEX35013

SEQ ID NO: 143544 - RNA, 1413 nt, Artificial Sequence; identical to SEQ ID NO: 139477
  derived and/or modified sequence opt3 from neuraminidase__InfluenzaA__AEX35024

SEQ ID NO: 143545 - RNA, 1413 nt, Artificial Sequence; identical to SEQ ID NO: 139477
  derived and/or modified sequence opt3 from neuraminidase__InfluenzaA__AEX35035

SEQ ID NO: 143546 - RNA, 1413 nt, Artificial Sequence; identical to SEQ ID NO: 139477
  derived and/or modified sequence opt3 from neuraminidase__InfluenzaA__AEX35046

SEQ ID NO: 143547 - RNA, 1413 nt, Artificial Sequence; identical to SEQ ID NO: 139477
  derived and/or modified sequence opt3 from neuraminidase__InfluenzaA__AEX35057

SEQ ID NO: 143548 - RNA, 1413 nt, Artificial Sequence; identical to SEQ ID NO: 139477
  derived and/or modified sequence opt3 from neuraminidase__InfluenzaA__AEX35068

SEQ ID NO: 143549 - RNA, 1413 nt, Artificial Sequence
  derived and/or modified sequence opt3 from neuraminidase__InfluenzaA__AEX35079
augaaccccaaucagaagaucauuaccauaggcagcaucuccauugccaucgggauuaucucucugaugcuccaaauaggaaacaucauuucaaugugggcuagucacagcauccagacagguucccagaauaacacuggcauuugcaaucagagaaucauaacguacgagaacucuaccugggugaaucauacauaugucaacauuaauaacacuaauguuguggcaggggaagacaaaaccucgguaacacuugccggaaacucaagccuguguaguaucuccggcugggcgauuuacaccaaggauaauucuaucaggaucgguagcaaaggggacguguucgucauucgggagccuuuuauauccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgaucgguauuuccggcccagacaacggggccguggcuguccugaaguauaauggaaucauaacuggcaccauuaaaagcuggaagaaacagaucuugagaacacaggagucggagugcguguguaugaacgguucuugcuuuacuaucaugaccgaugggcccuccaauaaggccgcgucauacaaaauuuucaagaucgaaaagggaaaaguaacaaagaguauugagcucaacgcaccuaauuuuuauuacgaagaguguagcugcuacccagacaccggcauaguuaugugugugugcagggauaacuggcauggcuccaaucggcccugggucucuuucaaccaggaccuggauuaucaaaucggguacauuugcagcggaguguuuggugacaauccucgcccagaggauggcgaagggucauguaacccggugacggucgacggagccaauggcguuaaagguuucaguuauaaguacgggaacggcguguggaucggaagaacuaaauccaauaggcugcggaagggcuuugagaugaucugggaccccaacggguggacaaauaccgauagcgacuucucuguaaaacaggauguggucgcuauuacugacuggucaggauauagugguagcuuugugcagcacccugaacucacaggcuuagauugcauacgcccauguuucuggguugagcuggugcgagggcuucccagagaaaacaccacgaucuggaccuccggaucuucgauuagcuucugcggcgucaacuccgacacagccaauuggucauggccugauggugcagaguugccauuuacuaucgacaaguga

SEQ ID NO: 143550 - RNA, 1413 nt, Artificial Sequence; identical to SEQ ID NO: 143524
  derived and/or modified sequence opt3 from neuraminidase__InfluenzaA__AEX35090

SEQ ID NO: 143551 - RNA, 1413 nt, Artificial Sequence
  derived and/or modified sequence opt3 from neuraminidase__InfluenzaA__AEX35101
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuucauuaugaagaguguagcugcuacccagacaccggcaucguuaugugugugugcagggauaacuggcacggcuccaaucggcccugggucucuuucaaccagaaucuggacuaccaaauuggguauaucugcagcggaguguuuggugauaacccucgcccagaggacggcgaagggucauguaauccggugacggucgauggagccaacggcguuaaagguuucaguuacaaguaugacaaugggguguggaucggcagaacuaaauccaacaggcugcggaagggauuugagaugauuugggaccccaauggcuggacaaacaccgauagcguauucucugugaaacaggacgucguggcuauaacugauuggucaggguacaguggauccuuuguucagcacccugaacucacagguuuagacugcauccgcccauguuucuggguggagcugguccgaggccuucccagagaaaacaccacgauuuggaccuccgggucuucgaucagcuucugcggagugaauagcgauacagccaacuggucauggccugacggcgcagaguugccauuuacuauugauaaguga

SEQ ID NO: 143552 - RNA, 1413 nt, Artificial Sequence
  derived and/or modified sequence opt3 from neuraminidase__InfluenzaA__AEX35112
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaagcaauuuuuauuacgaagaguguuccugcuacccugacaccggcaucguuaugugugugugcagggauaacuggcauggcucuaaucggccaugggucagcuucaaccagaaucuggacuaucaaauuggguacaucugcucaggaguguuuggugauaacccccgcccugaggacggcgaagggaguuguaauccagugacggucgauggagccaacggcguuaaagguuucuccuauaaguacgggaauggcguguggaucggaagaacuaaaagcaacaggcugcggaagggcuuugagaugauuugggacccgaauggguggacaaacaccgacucugauuucucaguaaaacaggacguggucgcuauaacugauuggaguggauauagcgguuccuuugugcagcaccccgaacucacaggcuuagacugcauccgcccuuguuucuggguugagcuggugcgagggcuuccaagagaaaacaccacgauuuggaccucuggaucgagcaucuccuucugcggcgucaauucagauacagccaacuggaguuggcccgacggugcagaguugccuuuuacuauugauaaguga

SEQ ID NO: 143553 - RNA, 1413 nt, Artificial Sequence; identical to SEQ ID NO: 139477
  derived and/or modified sequence opt3 from neuraminidase__InfluenzaA__AEX35123

SEQ ID NO: 143554 - RNA, 1413 nt, Artificial Sequence
  derived and/or modified sequence opt3 from neuraminidase__InfluenzaA__AEX35145
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugugaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucgauggagccaacggcguuaaagguuucaguuauaaguacgggaauggcguguggaucggaagaacuaaauccaacaggcugcggaagggcuuugagaugauuugggaccccaauggguggacaaacaccgacagcgauuucucuguaaaacaggacauaguggcuaucacugauuggucaggauauagugguagcuuuguccagcacccugaacucacaggcuuagacugcauucgcccauguuucuggguggagcugguucgagggcuucccagagaaaacaccacgaucuggaccuccggaucuucgauuagcuucugcggcgucaauuccgauacagccaacuggucauggccugacggugcagaguugccauuuacuaucgauaaguga

SEQ ID NO: 143555 - RNA, 1413 nt, Artificial Sequence; identical to SEQ ID NO: 143524
  derived and/or modified sequence opt3 from neuraminidase__InfluenzaA__AEX35156

SEQ ID NO: 143556 - RNA, 1413 nt, Artificial Sequence; identical to SEQ ID NO: 139477
  derived and/or modified sequence opt3 from neuraminidase__InfluenzaA__AEX35167

SEQ ID NO: 143557 - RNA, 1413 nt, Artificial Sequence
  derived and/or modified sequence opt3 from neuraminidase__InfluenzaA__AEX35178
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaagagagaaucuugaggacacaggagucggaaugcguguguguaaauggcucuugcuuuacuauuaugaccgauggucccuccaacggggccgcgucauacaagaucuucaaaauugagaagggaaagguuacaaaaagucgggaacucaaugcaccuaacuuucacuaugaggaguguagcugcuacccagacaccggcacggugaugugugucugccgcgauaauuggcacggcuccaacagacccugggugucuuucaaucagaaccuggacuaccagauaggguauaucugcagcggaguguuuggugauaauccuaggccaaaggacggcaaagggucauguaacccggucacugccgauggagcugacggcguuaaggguuucaguuacaaauaugggaauggcguguggauuggacggacaaaguccaaccgccugcgaaaaggcuuugaaaugaucugggaccccaauggguggaccgauacugacagcgauuucucuguaaagcaagacguggucgccaucacagauuggucaggauacagugguagcuuugugcagcauccugagcucaccggcuuagacugcauuagaccauguuucuggguugaacuggugagggggcuuccccgggagaacacgaccauauggacauccggaucuucgaucagcuucugcggcgucgauuccgacacugcaaauuggucauggccugauggugcugaauugccauuuaccauugacaaguga

SEQ ID NO: 143558 - RNA, 1413 nt, Artificial Sequence; identical to SEQ ID NO: 143498
  derived and/or modified sequence opt3 from neuraminidase__InfluenzaA__AEX35189

SEQ ID NO: 143559 - RNA, 1413 nt, Artificial Sequence; identical to SEQ ID NO: 143498
  derived and/or modified sequence opt3 from neuraminidase__InfluenzaA__AEX35200

SEQ ID NO: 143560 - RNA, 1413 nt, Artificial Sequence; identical to SEQ ID NO: 139477
  derived and/or modified sequence opt3 from neuraminidase__InfluenzaA__AEX35211

SEQ ID NO: 143561 - RNA, 1410 nt, Artificial Sequence
  derived and/or modified sequence opt3 from neuraminidase__InfluenzaA__AEX35222
augaaccccaaucagaagaucauuaccauaggcagcgugucccugacaaucucuacuauuugcuucuuuaugcaaaucgccauucucgucacgaccguuacacuucacuucaaacaguacgaguguaacucaccuccaaauaaccaggugaugcugugcgaaccgacuaucauagagagaaauaucaccgaaauuguauauuugacaaacaccacuaucgagaaggaaauuugucccaaauuagcugaguacaggaauuggaguaagccucagugcaacaucacaggguuugcaccauucagcaaagacaauuccauacggcugucugccggaggugauauuugggugacccgcgagcccuaugucucgugugacccugauaagugcuaccaauuugcgcuaggccaggggacgacucucaacaauggacauucaaacgacaccgugcacgaucgaacaccauaucguacucugcuuaugaaugaacugggcguucccuuccauuuggguaccaaacagguguguaucgcuuggagcaguuccucuugccacgacgggaaggccuggcuccaugucugugugacaggagaugacgagaacgcaaccgccagcuuuauuuacaauggcagacugguagauuccaucggcucauggaguaagaaaauccugaggacgcaggaaagcgagugcguuuguauuaacgggacuugcacaguggucaugaccgacggaucugcuuccgguaaggcagauacuaaaauacucuucaucgaggaaggcaagauugugcacacaucaaccuuaagcgggagugcccaacacguggaggaaugcucuuguuauccucgguacccaggaguccgcugcguuuguagagacaacuggaagggcuccaauaggccgaucguggauauaaacauuaaagacuacagcaucguaucgucuuaugugugcuccggucuggucggggacacgccccggaagaaugauucaaguagcuccucucauugucuugacccuaacaaugaggaaggaggccacggcgugaaagggugggcuuuugaugacggaaacgauguuuggaugggucgcaccaucagcgagaaguugcgaucaggcuacgagacauucaaagugauugaaggguggaguaagccaaauuccaaacugcagaucaacagacaggucauuguggacaggggaaaucggagcggcuauucugguauauuuucaguagaggggaagaguugcaucaaccguuguuucuacguugaacuaauucgcggcagaaagcaggagacugaagugcucuggaccagcaauuccaucgucguguuuugcggaacaucuggcacuuaugggaccggaucguggcccgauggugccgacaucaaccugaugccuauuuga

SEQ ID NO: 143562 - RNA, 1413 nt, Artificial Sequence; identical to SEQ ID NO: 143457
  derived and/or modified sequence opt3 from neuraminidase__InfluenzaA__AEX35233

SEQ ID NO: 143563 - RNA, 1410 nt, Artificial Sequence
  derived and/or modified sequence opt3 from neuraminidase__InfluenzaA__AEX35244
augaaccccaaucagaagaucauuaccauaggcagcgugucccugacaaucucuacuauuugcuucuuuaugcaaaucgccauucucaucaacacggucacccuucacuucaaacaguacgaguuuaauucaccuccaaacaaucagguuaugcugugugaaccgacaauaaucgagagaaacauuacugaaaucguguauuugaccaauacaaccauugagaaggaaaucugccccaaauuagcugaguacaggaacuggaguaagccucaguguaauauaacuggguucgcaccauuuagcaaagacaacuccauucggcugucugccggaggugauaucuggguaacacgcgagcccuaugugucgugcgacccugauaaguguuaccaauucgcgcuaggccaggggaccacgcucaauaacguccauucaaaugacacugugcacgaucgaaccccauaucguacacugcuuaugaacgaacugggaguucccuuucauuugggcacuaaacaggugugcauugcuuggagcaguuccucuugucacgacgguaaggccuggcuccaugucugcgugaccggggaugacaagaaugcaacagccagcuucaucuacaacggaagacugguagauuccaucguuucauggaguaaaaagauucugaggacccaggagagcgaaugugugugcauaaacggcacguguacugucgugaugacagacggcucugcuuccgggaaagcagauaccaagauccucuuuauugaggagggaaagaucgugcacacuucaacauuaagcgguagugcccaacacgucgaagagugcucuugcuauccucgguacccaggcguucgcugugugugcagagacaauuggaaaggguccaacaggccgauaguagauauuaauaucaaggacuacagcaucgugucgucuuaugucuguuccggacuggugggcgacacgccccggaaaaacgauucaaguagcuccucucauugccuugacccuaauaacgaagagggugggaauggaguuaagggcugggcuuucgaugacggcaacgauguguggauggggcgcaccauuagcgaaaaauugcgaucaggauacgagaccuuuaaggucaucgaggguuggaguaauccaaacuccaaacugcagauuaauagacaggugauaguagacaggggcaaccggagcggguauucuggaaucuucucaguugaaggcaagaguuguauuaaucguugcuuuuacguggagcuaauccgcgguagaaagcaggaaaacgagguccucuggacaagcaauuccaucguggucuucugugggacuucuggcaccuauggaacaggcucguggcccgauggggccgacauuaaccugaugccuguguga

SEQ ID NO: 143564 - RNA, 1410 nt, Artificial Sequence; identical to SEQ ID NO: 137945
  derived and/or modified sequence opt3 from neuraminidase__InfluenzaA__AEX35255

SEQ ID NO: 143565 - RNA, 1413 nt, Artificial Sequence; identical to SEQ ID NO: 143457
  derived and/or modified sequence opt3 from neuraminidase__InfluenzaA__AEX35266

SEQ ID NO: 143566 - RNA, 1413 nt, Artificial Sequence; identical to SEQ ID NO: 143457
  derived and/or modified sequence opt3 from neuraminidase__InfluenzaA__AEX35277

SEQ ID NO: 143567 - RNA, 1410 nt, Artificial Sequence
  derived and/or modified sequence opt3 from neuraminidase__InfluenzaA__AEX35288
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacaaccgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaaaagauucugaggacgcaggagagcgaaugugugugcauaaacggcacuuguacagucgugaugaccgacggcucugcuuccgggaaagcagauacuaagauccucuuuauugaggagggaaagaucgugcacacaucaaccuuaagcgguagugcccaacacgucgaagagugcucuugcuauccucgguacccaggcguucgcugugugugcagagacaacuggaaaggguccaauaggccgauaguagauauuaacaucaaggacuacagcaucgugucgucuuaugucuguuccggacuggugggcgacacgccccggaaaaaugauucaaguagcuccucucauugccuugacccuaacaaugaagagggugggcacggaguuaagggcugggcuuucgaugacggcaacgauguguggauggggcgcaccauuagcgaaaaauugcgaucaggauacgagacauuuaaggucaucgaggguuggaguaauccaaacuccaaacugcagauuaauagacaggugauaguagacaggggcaaccggagcggguauucuggaaucuucucaguugaaggcaagaguuguauuaaucguugcuuuuacguggagcuaauccgcgguagaaaggaagagacugaaguccucuggaccagcaacuccaucguggucuucugugggacaucuggcacuuauggaaccggcucguggcccgauggggccgacauuaaucugaugccuauauga

SEQ ID NO: 143568 - RNA, 1410 nt, Artificial Sequence; identical to SEQ ID NO: 136730
  derived and/or modified sequence opt3 from neuraminidase__InfluenzaA__AEX35299

SEQ ID NO: 143569 - RNA, 1410 nt, Artificial Sequence
  derived and/or modified sequence opt3 from neuraminidase__InfluenzaA__AEX35310
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacgagaacgcaaccgccagcuucaucuacaauggaagacugguagauuccaucguuucauggaguaagaaaauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcgaugacguguggauggggcgcaccauuagcgagaaguugcgaucaggauacgagacauuuaaagucaucgaagguuggaguaacccaaauuccaagcugcagauuaacagacaggugauaguagauaggggcaaucggagcggguauucuggaaucuucucaguugagggcaaaaguuguauuaaccguugcuuuuacguggaacuaauccgcgguagaaaucaggagacugaaguccucuggaccagcaacuccaucguggucuucugugggacaucuggcacuuauggaaccggcucguggcccgacggggccgauauuaaucugaugccuauauga

SEQ ID NO: 143570 - RNA, 1410 nt, Artificial Sequence; identical to SEQ ID NO: 136730
  derived and/or modified sequence opt3 from neuraminidase__InfluenzaA__AEX35321

SEQ ID NO: 143571 - RNA, 1410 nt, Artificial Sequence; identical to SEQ ID NO: 137945
  derived and/or modified sequence opt3 from neuraminidase__InfluenzaA__AEX35332

SEQ ID NO: 143572 - RNA, 1410 nt, Artificial Sequence; identical to SEQ ID NO: 137945
  derived and/or modified sequence opt3 from neuraminidase__InfluenzaA__AEX35343

SEQ ID NO: 143573 - RNA, 1410 nt, Artificial Sequence
  derived and/or modified sequence opt3 from neuraminidase__InfluenzaA__AEX35354
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuuguacagucgugaugaccgauggcucuacuuccgggaaagcugacacaaagauccucuuuauugaggagggaaagaucgugcacaccucaacguuaagcgguagugcacaacacgucgaagagugcucuugcuauccucgguacccaggcguucgcugugugugcagagauaacuggaaaggguccaacaggccgauaguagacauuaauaucaaggacuacagcaucgugucgucuuaugucuguuccggacuggugggcgauacaccccggaaaaacgacucaaguagcuccucucauugccuugauccuaauaacgaagagggugggcacggaguuaagggcugggccuucgacgauggcaaugacguguggauggggcgcaccauuagcgaaaaauugcgaucaggauacgagacuuuuaaggucaucgaggguuggaguaacccaaauuccaaacugcagauuaacagacaggugauaguagauaggggcaaucggagcggguauucuggaaucuucucaguugaaggcaagaguuguauuaaccguugcuuuuacguggagcuaauccgcgguagaaaggaagagaccgaaguccucuggacaagcaauuccaucguggucuucugugggacuucuggcaccuauggaacaggcucguggcccgacggggcugauauuaaccugaugccuauauga

SEQ ID NO: 143574 - RNA, 1410 nt, Artificial Sequence; identical to SEQ ID NO: 136730
  derived and/or modified sequence opt3 from neuraminidase__InfluenzaA__AEX35365

SEQ ID NO: 143575 - RNA, 1410 nt, Artificial Sequence
  derived and/or modified sequence opt3 from neuraminidase__InfluenzaA__AEX35376
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaacgaacaccauaucguacucugcuuaugaacgagcugggaguucccuuucauuugggcaccaaacaggugugcauugcuuggagcaguuccucuugucacgacgguaaggccuggcuccaugucugcgugacaggggaugacaagaaugcaaccgccagcuucaucuacaacggaagacugguagauuccaucguuucauggaguaaaaagauucugaggacgcaggaaagcgagugugugugcauaaauggcacuuguacagucgugaugaccgacggcucugcuuccgggaaagcagauacuaagauccucuuuauugaggaaggaaagaucgugcacacaucaaccuuaagcgguagugcccaacacgucgaggaaugcucuugcuauccucgguacccaggcguucgcugugugugcagagacaacuggaaaggguccaacaggccgauaguagauauuaauaucaaggacuacagcaucgugucgucuuaugucuguuccggacuggugggcgacacgccccggaaaaacgauucaaguagcuccucucauugccuugacccuaauaacgaggaaggugggcacggaguuaagggcugggcuuucgaugacggcaaugauguguggauggggcgcaccauuagcgagaaauugcgaucaggauacgagacauuuaaggucaucgaagguuggaguaacccaaauuccaaacugcagauuaacagacaggugauaguagacaggggcaaucggagcggguauucuggaaucuucucaguugagggcaagaguuguauuaaccguugcuuuuacguggaacuaauccgcgguagaaaggaggaaacugagguccucuggaccagcaauuccaucguggucuucugugggacaucuggcacuuauggaaccggcucguggcccgauggggccgacauuaaccugaugccuauauga

SEQ ID NO: 143576 - RNA, 1410 nt, Artificial Sequence; identical to SEQ ID NO: 136730
  derived and/or modified sequence opt3 from neuraminidase__InfluenzaA__AEX35387

SEQ ID NO: 143577 - RNA, 1410 nt, Artificial Sequence
  derived and/or modified sequence opt3 from neuraminidase__InfluenzaA__AEX35398
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuugugcugucgugaugacagauggcucugcauccgggaaagccgacaccaagauccucuuuauugaggagggaaagaucgugcacacuucaacauuaagcgguagugcucaacacgucgaagagugcucuugcuauccucgguacccaggcguucgcugugugugcagagauaacuggaaaggguccaacaggccgauaguagacauuaauaucaaggacuacagcaucgugucgucuuaugucuguuccggacuggugggcgauacgccccggaaaaacgacucaaguagcuccucucauugccuugauccuaauaacgaagagggugggcacggaguuaagggcugggccuucgacgauggcaaugacguguggauggggcgcaccauuagcgaaaaauugcgaucaggauacgagaccuuuaaggucaucgaggguuggaguaacccaaauuccaaacugcagauuaacagacaggugauaguagauaggggcaaucggagcggguauucuggaaucuucucaguugaaggcaagaguuguauuaaccguugcuuuuacguggagcuaauccgcgguagaaaggaagagacagaaguccucuggacuagcaauuccaucguggucuucugugggaccucuggcacauauggaacuggcucguggcccgacggggcggauauuaaccugaugccuauauga

SEQ ID NO: 143578 - RNA, 1410 nt, Artificial Sequence; identical to SEQ ID NO: 136730
  derived and/or modified sequence opt3 from neuraminidase__InfluenzaA__AEX35409

SEQ ID NO: 143579 - RNA, 1410 nt, Artificial Sequence; identical to SEQ ID NO: 143567
  derived and/or modified sequence opt3 from neuraminidase__InfluenzaA__AEX35420

SEQ ID NO: 143580 - RNA, 1410 nt, Artificial Sequence
  derived and/or modified sequence opt3 from neuraminidase__InfluenzaA__AEX35431
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacgagaacgcaaccgccagcuucaucuacaauggaagacugguagauuccaucguuucauggaguaagaaaauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccaaacuccaagcugcagauuaauagacaggugauaguagacaggggcaaccggagcggguauucuggaaucuucucaguugagggcaaaaguuguauuaaucguugcuuuuacguggaacuaauccgcgguagaaagaaggagacugaaguccucuggaccagcaacuccaucguggucuucugugggacaucuggcacuuauggaaccggcucguggcccgauggggccgacauuaaucugaugccuauauga

SEQ ID NO: 143581 - RNA, 1410 nt, Artificial Sequence; identical to SEQ ID NO: 136728
  derived and/or modified sequence opt3 from neuraminidase__InfluenzaA__AEX35453

SEQ ID NO: 143582 - RNA, 1410 nt, Artificial Sequence; identical to SEQ ID NO: 136728
  derived and/or modified sequence opt3 from neuraminidase__InfluenzaA__AEX35464

SEQ ID NO: 143583 - RNA, 1410 nt, Artificial Sequence; identical to SEQ ID NO: 136728
  derived and/or modified sequence opt3 from neuraminidase__InfluenzaA__AEX35475

SEQ ID NO: 143584 - RNA, 1410 nt, Artificial Sequence; identical to SEQ ID NO: 136728
  derived and/or modified sequence opt3 from neuraminidase__InfluenzaA__AEX35486

SEQ ID NO: 143585 - RNA, 1410 nt, Artificial Sequence
  derived and/or modified sequence opt3 from neuraminidase__InfluenzaA__AEX35497
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaaaugccccaaguuagcugaguacaggaauuggaguaaaccucaguguaacaucacaggguucgcaccauuuagcaaggacaauuccauacggcugucugccggaggugauauuuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcaucgcuuggagcaguuccucuugucacgacgguaaggccuggcuccaugucugcgugacaggggaugacaaaaacgcaaccgccagcuucauuuacaauggaagacugguagauuccaucguuucauggaguaaggagauccugaggacgcaggaaagcgagugugugugcauuaacggcacuuguacagucgugaugaccgacggcucugcuuccgggaaagcagauacuaagauacucuuuaucgaggaaggaaagauugugcacacaucaaccuuaagcgguagugcccaacacgucgaggaaugcucuugcuauccucgguacccaggcguucgcugugugugcagagacaacuggaaaggguccaauaggccgaucguagauauaaacauuaaggacuacagcaucgugucgucuuaugucuguuccggacuggugggcgacacgccccggaaaaaugauucaaguagcuccucucauugccuugacccuaacaaugaggaaggugggcacggaguuaagggcugggcuuucgaugacggcaacgauguguggauggggcgcaccaucagcgagaaauugcgaucaggauacgagacauuuaaggucauugaagguuggaguaauccaaacuccaaacugcagaucaauagacaggugauuguagacaggggcaaccggagcggguauucuggaauauucucaguugagggcaagaguuguaucaaucguugcuuuuacguggaacuaauucgcgguagaaaggaggaaacugagguccucuggaccagcaacuccaucguggucuucugugggacaucuggcacuuauggaaccggcucguggcccgauggggccgacaucaaucugaugccuauuuga

SEQ ID NO: 143586 - RNA, 1410 nt, Artificial Sequence; identical to SEQ ID NO: 136728
  derived and/or modified sequence opt3 from neuraminidase__InfluenzaA__AEX35508

SEQ ID NO: 143587 - RNA, 1410 nt, Artificial Sequence; identical to SEQ ID NO: 143585
  derived and/or modified sequence opt3 from neuraminidase__InfluenzaA__AEX35519

SEQ ID NO: 143588 - RNA, 1410 nt, Artificial Sequence
  derived and/or modified sequence opt3 from neuraminidase__InfluenzaA__AEX35530
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcagugugaaccgacuauaaucgagagaaauauuaccgaaaucguguaucugacaaacaccacuauugagaaggaaaucugccccaaauuggcugaguacaggaauuggaguaagccucaaugugacauaacaggguucgcaccauuuagcaaagauaacuccauucgguuaucugccggaggugacaucuggguaacccgcgagcccuaugugucgugcgauccugacaaguguuaccaguucgcgcugggccaggggacgacucuaaauaacguccauucaaaugauaccgugcacgaccgaacaccauaucguacucuccugaugaacgaacuuggaguucccuuucaucugggcaccaaacaggugugcauugcuuggagcaguuccucuugucacgaugguaaggccugguugcaugucugcgugacaggggacgauaagaaugcaaccgccagcuucaucuacaacggaagacucguagacuccaucguuucauggaguaaagagauucugaggacgcaagaaagcgagugugugugcauaaauggcacuuguacagucgugaugaccgauggcucugcuuccgggaaggcagacacuaaaauccuguuuauugaggaaggaaagaucgugcacacaucaacccucagcgguagugcccagcacgucgaggaaugcucuugcuauccucgguacccaggcguucgcugugugugcagagauaacuggaagggguccaacaggccgauaguagacauuaauacgaaagacuacagcaucgugucgucuuaugucuguuccggauuagugggcgauacaccccggaagaacgacucaaguagcuccucucauugccugaauccuaacaaugaggaaggugggcacggaguuaaaggcugggcuuucgaugacggcaacgauguguggauggggcgcaccaucagcgagaaacuucgauugggauacgagacuuuuaaggucauugaagguuggucaaauccaaacaguaagcugcagaucaauagacaggugauuguagacaggggcaaccgguccggguauagcggaauauucucuguugagggcaaaucauguaucaaucguugcuuuuacguggaacuaauucgcgguagaaaggaggaaaccgagguccucuggacaaguaacagcaucguggucuucugugggacuuccggcaccuauggaacaggcucuuggcccgauggggccgacaucaaucugaugccuauuuga

SEQ ID NO: 143589 - RNA, 1410 nt, Artificial Sequence; identical to SEQ ID NO: 136728
  derived and/or modified sequence opt3 from neuraminidase__InfluenzaA__AEX35541

SEQ ID NO: 143590 - RNA, 1410 nt, Artificial Sequence
  derived and/or modified sequence opt3 from neuraminidase__InfluenzaA__AEX35552
augaaccccaaucagaagaucauuaccauaggcagcgccucccugacaaucucuacuauuugcuucuuuaugcaaaucgcuauucucaucacgaccgugacacuucacuucaaacaguacgaguuuaacccuccaccgaauaaccaggcaaugcugugugaacccacuauaaucgagagaaauauuaccgaaaucgucuauuugacaaacaccacuauugagaaggaaaucugcccuaaauuagccgaguacaggaauuggucaaagccacagugugacauaacaggguucgcgcccuuuaguaaagauaacagcauucggcuguccgcuggaggugacaucuggguuacccgcgagccuuaugugucuugcgauccagacaaguguuaccaauucgcccuaggccaggggacgacucucaauaacguacauucgaaugauaccgugcacgaccgaacacccuaucguacucugcuuaugaacgaacugggagucccuuuucauuugggcaccaaacaggugugcauugcauggucaagcaguuccugucacgaugguaaggccuggcuccauguuugcgugacaggggacgauaagaaugcuaccgcaucuuucaucuacaacggaagacuggucgacagcaucguguccuggucaaaagagauucugaggacgcaggaaagugaguguguaugcauaaauggcacuuguacaguugugaugaccgauggcagcgccucugggaaggcugacacuaaaauccucuuuauugaggaaggaaagaucguccacacauccaccuuaucagguagcgcccaacacguggaggaaugcaguugcuauccacgguacccgggcgugcgcugugucugcagagauaacuggaaggggucuaacaggcccauaguugacauuaauaucaaagacuacuccaucgcgagcucguauguguguucuggacugguaggcgauacgccucggaagaacgacuccucaaguagcucccauugccuugauccaaauaacgaggaaggugggcacggagugaaaggcugggcauucgacgauggcaaugacgucuggauggggcgcaccauuucugagaaguugcgaagcggauacgagacauuuaaagugaucgaagguuggucaaaccccaauaguaagcugcagauuaacagacagguuauaguggauaggggcaaucgguccggguauagcggaaucuucucugucgagggcaaaucauguauuaaccguugcuuuuacguggaacuaauccgcgguagaaaggaggaaacugagguacucuggaccaguaauagcaucguuguguucugugggacauccggcacuuauggaaccggcucuuggccugacggggccgauauuaaccugaugccaauauga

SEQ ID NO: 143591 - RNA, 1410 nt, Artificial Sequence
  derived and/or modified sequence opt3 from neuraminidase__InfluenzaA__AEX35563
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaacuggaagggguccaacaggccgauaguagacauuaauaucaaagacuacagcaucgugucgucuuaugucuguuccggacuggugggcgauacgccccggaagaacgacucaaguagcuccucucauugccuuaauccuaacaaugaggaaggugggcacggaguuaaaggcugggcuuucgaugacggcaacgauguguggauggggcgcaccauuagcgagaaguugcgacugggauacgagacauuuaaagucaucgaagguuggucaaauccaaacaguaagcuacagauuaauagacaggugauaguagacaggggcaaccgguccggguauagcggaaucuucucuguugagggcaaaucauguauuaaucguugcuuuuacguggaacucauccgcgguagaaaggaggaaacugagguccuguggaccaguaacagcaucguggucuucugugggacauccggcacuuauggaaccggcucuuggcccgauggggccgacauuaaucuuaugccuauauga

SEQ ID NO: 143592 - RNA, 1410 nt, Artificial Sequence; identical to SEQ ID NO: 143472
  derived and/or modified sequence opt3 from neuraminidase__InfluenzaA__AEX35585

SEQ ID NO: 143593 - RNA, 1410 nt, Artificial Sequence
  derived and/or modified sequence opt3 from neuraminidase__InfluenzaA__AEX35596
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccagacuccaagcugcagauuaacagacaggugauaguagauaggggcaaucggagcggguauucuggaaucuucucaguugagggcaaaaguuguauuaaccguugcuuuuacguggaacuaauccgcgguagaaaggaggaaacugagguccucuggaccagcaauuccaucguggucuucugugggacaucuggcacuuauggaaccggcucguggcccgacggggccgauauuaaccugaugccuauauga

SEQ ID NO: 143594 - RNA, 1410 nt, Artificial Sequence; identical to SEQ ID NO: 136728
  derived and/or modified sequence opt3 from neuraminidase__InfluenzaA__AEX35607

SEQ ID NO: 143595 - RNA, 1410 nt, Artificial Sequence
  derived and/or modified sequence opt3 from neuraminidase__InfluenzaA__AEX35618
augaaccccaaucagaagaucauuaccauaggcagcgugucccugacaaucucuacuauuugcuucuuuaugcaaaucgccauucucaucacgaccgucacacuucacuucaaacaguacgagcugaacucaccuccaaauaaccagguuauguugugugaaccgacuauaaucgagagaaauauuaccgaaaucguguauuuaacaaacaccacuauugagaaggaaacaugccccaaacuggcugaguacaggaauuggaguaagccucaguguuauaucaccggguuugcaccauucagcaaagacaacuccauacggcuaucugccggaggugauauuuggguaacgcgcgagcccuacgugucgugcgacccugauaaguguuaucaauuugcgcucggccaggggacuacccugaauaacguccauucaaaugacacagugcgagaucguacuccauacagaacccuucugaugaacgaauugggaguucccuuccaccucggcacaaaacaggugugcaucgcuuggagcaguuccucuugucaugacgguaaggccuggcugcacgucugcauuaccggggaugacaagaaugcaacggccagcuuuaucuauaacggaaggcugguggauuccaucguaucauggaguaaagagauucuccggacucaggaaagcgaguguguuugcauaaauggcacauguaccguggucaugacugacggcucugcuuccgggaaggcagauacaaaaaucuuauucauugaggaaggaaagaucgugcauaccucaacgcugagcgguagugcccaacacguggaggaaugcucuugcuacccucgcuacccaggcgucagauguguuugcagggacaacuggaagggguccaaccggccgauaguggauauuaauaucaaagaccacagcaucguaucgucuuauguguguuccggacuugucggcgacacaccccgcaagaacgauucaaguagcuccucucauugcuuggacccuaauaacgaggaaggugggcacggagugaaaggcugggcuuuugaugacggcaaugauguuuggauggggcgaaccauuagcgagaagucaagacugggauacgagacuuucaaagugaucgaagguuggaguaacccaaaguccaaacuacagauuaauaggcaggucauaguggaccgggauaaccguagcggcuauucugggaucuuuucaguagagggaaagaguuguauuaaucgcugcuucuacguugaacucaucagaggcaggaaggaggaaaccgaggugcuguggacaagcaacuccaucgucguguuuugugguacuucugggaccuauggcacaggaucguggcccgacggcgccgauauuaaucuuaugccuauauga

SEQ ID NO: 143596 - RNA, 1410 nt, Artificial Sequence
  derived and/or modified sequence opt3 from neuraminidase__InfluenzaA__AEX35640
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaaguggaguaaaccucaguguaauauaacaggguucgcaccauuuagcaaggacaacuccauucggcugucugccggaggugauaucuggguaacccgcgagcccuaugugucgugcgacccugauaaguguuaccaauucgcgcuaggccaggggacgacucucaauaacguccauucaaaugacaccgugcgagaucguacaccauauagaacucugcuuaugaacgaacugggaguucccuuucacuugggcaccaaacaggugugcauugcuuggagcaguuccucuugucaugacgguaaggccuggcuccacgucugcgugacaggggauaauaaaaacgcaaccgccagcuucaucuacaauggaaggcugguagacuccaucguuucauggaguaaggagauucugcggacgcaggaaagcgagugugugugcauaaacggcacuuguacagucgugaugaccgauggcucugcuuccgggaaagcagacacuaagauccucuuuauugaggaaggaaagaucgugcauacaucaaccuuaagcgguagugcccaacacgucgaggaaugcucuugcuauccucgcuacccaggcguuagaugugugugcagggauaacuggcggggguccaaucgcccgauaguagacauuaacaugaaagauuacagcaucgugucgucuuaugucuguuccggacuggugggcgacacgccccgaaagaaugacucaaguagcuccggucacugccuugauccuaacgacgaggaagggggacauggcguuaaaggcugggcuuucgaugacgggaaugauguguggaugggaagaaccaucucugaaaagagcaggucagguuacgagacauuuaaagucauugagggcuggaguaacccaaauuccaaguugcagaucaaccgucaggugauuguagaccgggggaaucgcagcggauauucuggcauauucucaguugaggguaaaaguuguaucaacagaugcuuuuacguggaacugauuagggggcggaaggaggaaacugagguccuauggaccagcaauuccaucguggucuucuguggcacaucuggaacuuauggcaccgggucguggcccgauggagccgacaucaaccucaugccuauuuga

SEQ ID NO: 143597 - RNA, 1410 nt, Artificial Sequence
  derived and/or modified sequence opt3 from neuraminidase__InfluenzaA__AEX35651
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaauggcacuuguacagucgugaugaccgauggcucugcuuccgggaaggcagacacuaaaauccucuuuauugaggaaggaaagaucgugcauacaucaaccuuaagcgguagugcccaacacgucgaggaaugcucuugcuauccucgcuacccaggcguuagaugugugugcagggauaacuggaagggguccaaccggccgauaguagacauuaauaucaaagaccacagcaucgugucgucuuacgucuguuccggacuggugggcgauacgccccgcaagaacgacucaaguagcuccucucauugccuugauccuaauaacgaggaaggugggcacggaguuaaaggcugggcuuucgacgauggcaaugacguguggauggggcgaaccauuagcgagaagucaagauugggauaugagacauuuaaagucaucgaagguuggaguaacccaaaguccaaacugcagauuaauaggcaagugauaguagaucggggcaaccguagcggguacucuggaaucuucucaguugaggacaagaguuguauuaaucgcugcuuuuauguggaacuaaucagaggcaggaaggaggaaacugagguccucuggaccagcaacuccaucguggucuucugugguacaucugggacuuacggcaccggaucguggcccgauggcgccgacauuaaucugaugccuauauga

SEQ ID NO: 143598 - RNA, 1410 nt, Artificial Sequence; identical to SEQ ID NO: 137900
  derived and/or modified sequence opt3 from neuraminidase__InfluenzaA__AEX36105

SEQ ID NO: 143599 - RNA, 1410 nt, Artificial Sequence
  derived and/or modified sequence opt3 from neuraminidase__InfluenzaA__AEX36116
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgaaaccguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccauuguaucauggaguaaagagauacugcggacgcaggaaagcgaguguguuugcaucaacggcacuuguacaguggucaugaccgacggcucugcuuccggggaggcagauacuaagauucucuuuaucgaagagggaaaaauagugcauacaucaaccuuaagcgguagugcccaacacguggaagagugcucuugcuauccucgcuacccaggcgucagauguguuugcagggacaacuggaagggguccaaucggccgauuguggauaucaacaucaaggaccacagcauuguaucgucuuacguguguuccggacuggucggcgacacgccccgcaaaaaugauucaaguagcuccucucauugccuugacccuaacaaugaagagggugggcacggagugaagggcugggcuuucgaugacggcaacgauguuuggauggggcgaaccaucagcgagaaaucaagauugggauaugaaacauuuaaggugauugaggguuggaguaauccaaaauccaagcugcagauaaacaggcaggucaucguggaccggggcaaucguagcggguacucuggaauuuucucaguagaaggcaaaaguuguaucaaccgcugcuuuuauguugagcuaaucagagguaggaaggaagagacugaggugcucuggaccagcaauuccauugucguguucugugggacaucuggcacuuacggaaccggcucguggcccgauggggccgacauaaaccugaugccuaucuga

SEQ ID NO: 143600 - RNA, 1410 nt, Artificial Sequence
  derived and/or modified sequence opt3 from neuraminidase__InfluenzaA__AEX36127
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggcugaagccucagugugacauaacaggguucgcaccauuuaguaaagauaacagcauucggcuauccgccggaggugacaucuggguaacccgcgagcccuaugugucuugcgauccugacaaguguuaccaauucgcgcucggccaggggacgacucugaauaacguccauucgaaugauaccgugcgagaccguacaccauauagaacucuucugaugaacgaauugggaguucccuuucaccucggcaccaaacaggugugcauugcuuggucaagcaguuccugucaugaugguaaggccuggcugcacgucugcaucacaggggacgauaagaaugcaaccgccucuuucaucuacaacggaaggcugguggacagcguaguuuccuggucaaaagagauucuccggacgcaggaaagugagugugugugcauaaauggcacuuguacagucgugaugaccgauggcagcgcuucugggaaggcagacacuaaaaucuuauuuauugaggaaggaaagaucgugcauacauccacccugucagguagcgcccaacacgucgaggaaugcaguugcuauccucgcuacccaggcguuagaugugugugcagggauaacuggaaggggucuaaccggccgauaguagacauuaauaucaaagaccacuccaucgugagcucguacgucuguucuggacuugugggcgauacgccccgcaagaacgacuccucaaguagcucccauugcuuggauccuaauaacgaggaaggugggcacggaguuaaaggcugggcuuucgacgauggcgacgauguguggauggggcgaaccauuucugaaaagagcagacugggauaugagacauuuaaagucaucgaggguuggucaaauccaaagaguaaacuacagauuaacaggcaagugauaguagaccggggcaaucguuccggguacagcggaaucuucucuguugagggcaagucauguauuaaccgcugcuuuuauguggaacucaucagagguaggaaggaggaaacugagguccuguggaccaguaauagcaucguggucuucugugggacauccggcacuuacggaaccggcucuuggcccgauggggccgacauuaaccuuaugccuauauga

SEQ ID NO: 143601 - RNA, 1410 nt, Artificial Sequence
  derived and/or modified sequence opt3 from neuraminidase__InfluenzaA__AEX36149
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaauggcacuuguacagucgugaugaccgauggcucugcuuccgggaaggcagacacuaaaauccucuuuauugaggaaggaaagaucgugcauacaucaaccuuaagcgguagugcccaacacgucgaggaaugcucuugcuauccucgcuacccaggcguuagaugugugugcagggauaacuggaagggguccaaccggccgauaguagacauuaauaucaaagaccacagcaucgugucgucuuacgucuguuccggacuggugggcgauacgccccgcaagaacgacucaaguagcuccucucauugccuugauccuaauaacgaggaaggugggcacggaguuaaaggcugggcuuucgacgauggcaaugacguguggauggggcgaaccauuagcgagaagucaagauugggauaugagacauuuaaagucaucgaagguuggaguaacccaaaguccaaacugcagauuaauaggcaagugauaguagaucggggcaaccguagcggguacucuggaaucuucucaguugaggacaagaguuguauuaaucgcugcuuuuauguggaacuaaucagaggcaggaaggaggaaacugagguccucuggaccacaaacagcaucguggucuucugugguacuuccgggaccuacggcacaggaucuuggcccgauggcgccgacauuaaucugaugccuauauga

SEQ ID NO: 143602 - RNA, 1410 nt, Artificial Sequence; identical to SEQ ID NO: 138528
  derived and/or modified sequence opt3 from neuraminidase__InfluenzaA__AEX36160

SEQ ID NO: 143603 - RNA, 1410 nt, Artificial Sequence
  derived and/or modified sequence opt3 from neuraminidase__InfluenzaA__AEX36171
augaaccccaaucagaagaucauuaccauaggcagcgugucccugacaaucucuacuauuugcuucuuuaugcaaaucgccauucucaucacgaccgucacacuucacuucaaacaguacgaguuuucaaguccuccaaacaaucagguuaugcugugugaaccgacuauaaucgagagaaacauuaccgaaaucguguauuugacaaauaccacuauugagaaggaaaucugccccaaauuagcugaguacaggaacuggagcaagccucagugugacauaacaggguucgcaccauuuuccaaagauaauucuauucggcugucggccggaggugacaucuggguaacccgcgagcccuaugugucaugcgauccugacaaguguuaccaauucgcgcuaggccaggggacgacucucaacaauguccauagcaacgauaccgugcacaaucgaacaccauaucguacucugcuuaugaacgaacugggaguucccuuucauuugggcaccaaacaggugugcauugcuuggaguuccucuagcugucacgacgguaaggccuggcuccaugucugcgugacaggggaugacaagaaugcaaccgccuccuucaucuacaacggaagacugguagauucaaucguuaguuggagcaaagagauucugaggacgcaggaaucugagugugugugcauaaauggcacuugugcugucgugaugacagacggcuccgcaucagggaaggccgauaccaaaauccucuuuauugaggaaggaaagaucgugcacacuagcacauuaagugguucugcucaacacgucgaggaaugcuccugcuauccucgguacccaggcguucgcugugugugcagagacaacuggaaggggagcaacaggccgauaguagauauuaauaucaaagacuacucgaucgugucucgguaugucuguuccggacuggugggcgacacccccaggaagaacgauucaaguagcuccucucauugccuugacccuaauaacgaggaaggugggcacggaguuaaaggcugggccuucgaugacggcgaugacguguggauggggcgaacgauuagcgagaagucaagaaguggauacgagaccuuuaaagucaucgaagguugguccaauccaaacagcaaguugcagauuaaucgccaggugauaguagaucggggcaaccguucuggguauucaggaaucuucaguguugagggcaaaagcuguauuaaucgcugcuuuuacguggaacugaucagagguaggaaggaggaaacagagguccuauggacuuccaacucuaucguggucuucugugggaccucgggcacauauggaacuggcagcuggcccgacggggcggauauuaaucucaugccuauauga

SEQ ID NO: 143604 - RNA, 1410 nt, Artificial Sequence
  derived and/or modified sequence opt3 from neuraminidase__InfluenzaA__AEX36193
augaaccccaaucagaagaucauuaccauaggcagcgugucccugacaaucucuacuauuugcuucuuuaugcaaaucgccauucucaucacgaccgucacacuucacuucaaacaguacgaguuuaacucaaguccuaauaaccagguuaugcugugugaaccaacuauaaucgagagaaauauuaccgaaaucguguauuugacaaacaccacuauugagaaggaaaucugcccgaaauuagcugaguacaggaauuggagcaagccccagugugacauaacaggguucgcaccuuuuuccaaagauaacucuauucggcugucggccggaggugacaucuggguaacccgcgagccauaugugucaugcgaucccgacaaguguuaccaauucgcgcuaggccaggggacgacucucaauaacguccauagcaauaacaccgugcgagaucguacaccuuauagaacucugcuuaugaaugaacugggaguuccauuucacuugggcaccaaacaggugugcauugcuuggaguuccucuagcugucaugacgguaaggccuggcuccacgucugcaucacaggggaugacaagaacgcaaccgccuccuucaucuacaauggaaugcugguggauucaauuguaaguuggagcaaagagauacugaggacgcaggaaucugaguguguuugcaucaacggcacuuguacaguggucaugaccgacggcuccgcuucagggaaggcagauacuaaaauucucuuuaucgaggaaggaaagauagugcauacaagcaccuuaagugguucugcccaacacguggaggaaugcuccugcuauccccgguacccuggcguccgcuguguuugcagagacaacuggaaggggagcaauaggccaauuguggauaucaacaucaaagaccacucgauuguaucuuccuacguguguucaggacuggucggcgacacgccgcggaagaaugauaguagcuccucuagccauugccuugaccccaacaaugaggaaggugggcacggagugaaaggcugggcuuucgaugacggcaacgauguuuggauggggcgcaccaucucagagaagagucgauugggauaugagacauuuaaagugauugaagguugguccaauccuaagagcaaacugcagauaaacagacaggucaucguggacaggggcaaucggucuggguacucaggaauuuucaguguagagggcaagagcuguaucaaccguugcuuuuauguugaacuaauccgcgguagaaaggaggaaacugaggugcucuggaccuccaauucuauugucguguucugugggacaucgggcacuuacggaaccggcagcuggccagauggggccgacauaaaccugaugcccaucuga

SEQ ID NO: 143605 - RNA, 1410 nt, Artificial Sequence
  derived and/or modified sequence opt3 from neuraminidase__InfluenzaA__AEX36204
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccggcuauaaucgagagaaauauuacugaaaucguguauuugaccaacacaaccauugagaaggaaaucugccccaaauuagcagaguacaggaauuggaguaagccucagugugacauaacuggguucgccccauuuagcaaagauaacuccauucggcugucugcgggaggugacaucuggguaacacgcgagcccuaugugucgugcgauccugacaaguguuaccaauucgcucuaggccaggggaccacgcucaauaacguccauucaaaugauacugugcacgaacgaaccccauaucguacacugcuuaugaacgagcugggaguucccuuucauuugggcacuaaacaggugugcauugccuggagcaguuccucuugucacgacgguaaggcauggcuccaugucugcgugaccggggaugacaagaaugccacagcuagcuucaucuacaacggaagacugguagauuccaucguuucauggaguaaagaaauucugaggacccaggagagcgagugugugugcauaaauggcacguguacugucgugaugacagacggcucugcauccgggaaggccgauaccaaaauccucuuuauugaagagggaaagaucgugcacacuucaacauuaagcgguagugcucaacacgucgaagagugcucuugcuauccucgguacccaggcguucgcugugugugcagagacaacuggaagggguccaacaggccgauaguagauauuaauaucaaagacuacagcaucgugucgcgguaugucuguucuggacuggugggcgacacccccaggaagaacgauuccucaaguagcucccauugccuugacccuaauaacgaagagggugggcacggaguuaaaggcugggccuucgaugacggcaaugauguguggauggggcgaacgauuucugaaaagagcagaucaggauacgagaccuuuaaagucaucgaggguuggaguaacccaaauuccaaguugcagauuaaccgccaggugauaguagaccggggcaaucguagcggguauucuggaaucuucucaguugaaggcaaaaguuguauuaaccgcugcuuuuacguggagcugaucagagguaggaaggaagagacagagguccuauggacuagcaauuccaucguggucuucugugggaccucuggcacauauggaacuggcucguggcccgauggggcggacauuaaccucaugccuauauga

SEQ ID NO: 143606 - RNA, 1410 nt, Artificial Sequence
  derived and/or modified sequence opt3 from neuraminidase__InfluenzaA__AEX36215
augaaccccaaucagaagaucauuaccauaggcagcgugucccugacaaucucuacuauuugcuucuuuaugcaaaucgccauucucaucacgaccgucacacuucacuucaaacaguacgaguuuucaaguccuccaaacaaucagguuaugcugugugaaccggcuauaaucgagaagaacauuacugaaaucguguauuugaccaauacaaccauugagaaagaaaucugccccaaguuagcagaguacagaaacuggagcaaaccucagugugacauaacuggguucgccccauuuuccaaggauaauucuauuaggcugucggcgggaggugacaucuggguaacacgggagcccuaugugucaugcgauccugacaaguguuaccaauucgcucuaggccaggggaccacgcucaacaauguccauagcaacgauacugugcacgaacgcaccccauaucgaacacugcuuaugaaugagcugggaguucccuuucauuugggcacuaaacaggugugcauugccuggaguuccucuagcugucacgacgguaaggcauggcuccaugucugcgugaccggggaugacaaaaacgccacagcuuccuucaucuacaauggacgucugguagauucaaucguuaguuggagcaaggaaauucugagaacccaggagucugagugugugugcauaaacggcacguguacugucgugaugacagacggcuccgcaucagggaaagccgauaccaagauccucuuuauugaagagggaaagaucgugcacacuagcacauuaagugguucugcucaacacgucgaagagugcuccugcuauccuagguacccaggcguucggugugugugccgcgacaauuggaaagggagcaacagaccgauaguagauauuaacaucaaggacuacucgaucgugucuagguaugucuguuccggacuggugggcgacacgccccggaaaaaugauucaaguagcuccucucauugccuugacccuaacaaugaagagggugggcacggaguuaagggcugggccuucgaugacggcaacgauguguggauggggcgcaccauuagcgagaaaucacgaaguggauacgaaaccuuuaaggucaucgaggguugguccaauccaaacagcaaauugcagauuaauagacaggugauaguagacaggggcaaccggucuggguauucaggaaucuucaguguugaaggcaagagcuguauuaaucguugcuuuuacguggagcugauccgcgguagaaaggaagagacagagguccuauggacuuccaacucuaucguggucuucugugggaccucgggcacauauggaacuggcagcuggcccgauggggcggacauuaaucucaugccuauauga

SEQ ID NO: 143607 - RNA, 1410 nt, Artificial Sequence
  derived and/or modified sequence opt3 from neuraminidase__InfluenzaA__AEX36226
augaaccccaaucagaagaucauuaccauaggcagcgugucccugacaaucucuacuauuugcuucuuuaugcaaaucgccauucucaucacgaccgucacacuucacuucaaacaguacgaguuuucaaguccuccaaacaaucagguuaugcugugugaaccggcuauaaucgagagaaacauuacugaaaucguguauuugaccaauacaaccauugagaaggaaaucugccccaaauuagcagaguacaggaacuggagcaagccucagugugacauaacuggguucgccccauuuuccaaagauaauucuauucggcugucggcgggaggugacaucuggguaacacgcgagcccuaugugucaugcgauccugacaaguguuaccaauucgcucuaggccaggggaccacgcucaacaauguccauagcaacgauacugugcacaaucgaaccccauaucguacacugcuuaugaacgaacugggaguucccuuucauuugggcacuaaacaggugugcauugccuggaguuccucuagcugucacgacgguaaggcauggcuccaugucugcgugaccggggaugacaagaaugccacagcuuccuucaucuacaacggaagacugguagauucaaucguuaguuggagcaaagagauucugaggacccaggaaucugagugugugugcauaaauggcacguguacugucgugaugacagacggcuccgcaucagggaaggccgauaccaaaauccucuuuauugaggaaggaaagaucgugcacacuagcacauuaagugguucugcucaacacgucgaggaaugcuccugcuauccucgguacccaggcguucgcugugugugcagagacaacuggaaggggagcaacaggccgauaguagauauuaauaucaaagacuacucgaucgugucucgguaugucuguuccggaauugugggcgacacccccaggaagaacgauucaaguagcuccucucauugccuggacccuaauaacgaggaaggugggcacggaguuaaaggcugggccuucgaugacggcaaugauguguggauggggcgaacgaucagcgagaagucaagaaguggauacgagaccuuuaaagucauugaagguugguccaacccaaauagcaaacuucagauaaaccgccaggugaucguagaccggggcaaucguucuggguauucaggaauuuucaguguugagggcaagagcuguaucaaccgcugcuuuuacguggaauugaucagagguaggaaggaggaaacagagguccuguggacuuccaauucuauuguggucuucugugggaccucgggcacauauggaacuggcagcuggcccgauggggcggacauaaaccuaaugccuaucuga

SEQ ID NO: 143608 - RNA, 1410 nt, Artificial Sequence
  derived and/or modified sequence opt3 from neuraminidase__InfluenzaA__AEX36237
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaaguggaguaaaccucaguguaauauaacaggguucgcaccauuuagcaaggacaacuccauucggcugucugccggaggugauaucuggguaacccgcgagcccuaugugucgugcgacccugauaaguguuaccaauucgcgcuaggccaggggacgacucucaauaacguccauucaaaugacaccgugcgagaacguacaccauauagaacucugcuuaugaacgagcugggaguucccuuucacuugggcaccaaacaggugugcauugcuuggagcaguuccucuugucaugaugguaaggccuggcuccacgucugcgugacaggggacgauaaaaaugcaaccgccagcuucaucuacaacggaaggcugguagacuccaucguuucauggaguaaggaaauucugcggacgcaggagagcgagugugugugcauaaauggcacuuguacagucgugaugaccgauggcucugcuuccgggaaagcagacacuaagauccucuuuauugaagagggaaagaucgugcauacaucaaccuuaagcgguagugcccaacacgucgaagagugcucuugcuauccucgcuacccaggcguuagaugugugugcagggauaacuggcggggguccaaccgcccgauaguagacauuaauaugaaagauuacagcaucgugucgucuuaugucuguuccggacuggugggcgacacgccccgaaagaacgacucaaguagcuccggucacugccuugauccuaaugacgaagaagggggacauggcguuaaaggcugggcuuucgaugacgggaacgauguguggaugggaagaaccaucucugaaaagagcaggucagguuacgagacauuuaaagucauugagggcuggaguaauccaaacuccaaguugcagaucaaucgucaggugauuguagaccgggggaaccgcagcggauauucuggcauauucucaguugaggguaaaaguuguaucaauagaugcuuuuacguggagcugauuagggggcggaaggaagagacugagguccuauggaccagcaacuccaucguggucuucuguggcacaucuggaacuuauggcaccgggucguggcccgauggagccgacaucaaucucaugccuauuuga

SEQ ID NO: 143609 - RNA, 1410 nt, Artificial Sequence
  derived and/or modified sequence opt3 from neuraminidase__InfluenzaA__AEX36248
augaaccccaaucagaagaucauuaccauaggcagcgugucccugacaaucucuacuauuugcuucuuuaugcaaaucgccauucucaucacgaccgucacacuucacuucaaacaguacgaguuuucaaguccuccaaacaaucagguuaugcugugugaaccggcuauaaucgagagaaacauuacugaaaucguguauuugaccaauacaaccauugagaaggaaaucugccccaaauuagcagaguacaggaacuggagcaagccucagugugacauaacuggguucgccccauuuuccaaagauaauucuauucggcugucggcgggaggugacaucuggguaacacgcgagcccuaugugucaugcgauccugacaaguguuaccaauucgcucuaggccaggggaccacgcucaacaauguccauagcaacgauacugugcacaaucgaaccccauaucguacacugcuuaugaacgaacugggaguucccuuucauuugggcacuaaacaggugugcauugccuggaguuccucuagcugucacgacgguaaggcauggcuccaugucugcgugaccggggaugacaagaaugccacagcuuccuucaucuacaacggaagacugguagauucaaucguuaguuggagcaaagagauucugaggacccaggaaucugagugugugugcauaaauggcacguguacugucgugaugacagacggcuccgcaucagggcgggccgauaccaagauccucuuuauugaggaaggaaaaaucgugcacacuagcacauuaagugguucugcucaacacgucgaggaaugcuccugcuauccucgcuacccaggcguuagaugugugugcagggacaacuggaaggggagcaaccggccgauaguagauauuaauaucaaggacuacucgaucgugucucgcuaugucuguuccggacuggugggcgacacgccccggaaaaacgauucaaguagcuccucucauugccuugacccuaauaacgaggaaggugggcacggaguuaagggcugggccuucgaugacggcaaugauguguggauggggagaaccauuagcgagaaaucaaggaguggauacgagaccuuuaaggucaucgaagguugguccaacccaaauagcaaauugcagauuaaccgacaggugauaguagaccguggcaaucgcucuggguauucaggaaucuucaguguugagggcaagagcuguauuaacagaugcuuuuacguggaacugaucaggggucggaaagaggaaacagagguccuauggacuuccaauucuaucguggucuucugugggaccucgggcacauauggaacuggcagcuggcccgauggggcggacauuaaccucaugccuauauga

SEQ ID NO: 143610 - RNA, 1410 nt, Artificial Sequence; identical to SEQ ID NO: 138528
  derived and/or modified sequence opt3 from neuraminidase__InfluenzaA__AEX36259

SEQ ID NO: 143611 - RNA, 1410 nt, Artificial Sequence
  derived and/or modified sequence opt3 from neuraminidase__InfluenzaA__AEX36270
augaaccccaaucagaagaucauuaccauaggcagcgugucccugacaaucucuacuauuugcuucuuuaugcaaaucgccauucucaucacgaccgucacacuucacuucaaacaguacgaguuuucaaguccuccaaacaaucagguuaugcugugugaaccggcuauaaucgagagaaacauuacugaaaucguguauuugaccaauacaaccauugagaaggaaaucugccccaaauuagcagaguacaggaacuggagcaagccucagugugacauaacuggguucgccccauuuuccaaagauaauucuauucggcugucggcgggaggugacaucuggguaacacgcgagcccuaugugucaugcgauccugacaaguguuaccaauucgcucuaggccaggggaccacgcucaacaauguccauagcaacgauacugugcacggacgaaccccauaucguacacugcuuaugaaugaacugggcguucccuuucauuuggguacuaaacaggugugcauugccuggaguuccucuagcugucacgacgggaaggcauggcuccaugucugcgugaccggagaugacaagaacgccacagcuuccuucaucuacaauggcagacugguagauucaaucguuaguuggagcaaagagauucugaggacccaggaaucugagugugugugcauaaacggcacguguacugucgugaugacagacggguccgcaucaggaaaggccgauaccaaaauccucuuuauugaggaagguaagaucgugcacacuagcacauuaaguggcucugcucaacacgucgaggaaugcuccugcuauccucgguacccagggguucgcugugugugcagagacaauuggaagggaagcaacaggccgauaguagauauuaacaucaaagacuacucgaucgugucucgguaugucuguuccggccuggugggugacacccccaggaagaaugauucaaguagcuccucucauugccuugacccuaacaaugaggaagggggacacggcguuaaaggcugggccuucgaugacgggaacgauguguggaugggacgaacgauuagcgagaagucaagaagugguuacgagaccuuuaaagucaucgaaggcugguccaauccaaacagcaaguugcagauuaaucgccaggugauaguagaccgggggaaccguucuggauauucaggcaucuucaguguugaggguaaaagcuguauuaaucgcugcuuuuacguggaacugaucagagggagggaggaagagacaaagguccuauggacuuccaacucuaucguggucuucuguggcaccucgggaacauauggcacugggagcuggcccgauggagcggacauuaaucucaugccuauauga

SEQ ID NO: 143612 - RNA, 1410 nt, Artificial Sequence
  derived and/or modified sequence opt3 from neuraminidase__InfluenzaA__AEX36281
augaaccccaaucagaagaucauuaccauaggcagcgugucccugacaaucucuacuauuugcuucuuuaugcaaaucgccauucucaucacgaccgucacacuucacuucaaacaguacgaguuuucaaguccuccaaacaaucagguuaugcugugugaaccggcuauaaucgagagaaacauuacugaaaucguguauuugaccaauacaaccauugagaaggaaaucugccccaaauuagcagaguacaggaacuggagcaagccucagugugacauaacuggguucgccccauuuuccaaagauaauucuauucggcugucggcgggaggugacaucuggguaacacgcgagcccuaugugucaugcgauccugacaaguguuaccaauucgcucuaggccaggggaccacgcucaacaauguccauagcaacgauacugugcacggacgaaccccauaucguacacugcuuaugaaugaacugggcguucccuuucauuuggguacuaaacaggugugcauugccuggaguuccucuagcugucacgacgggaaggcauggcuccaugucugcgugaccggagaugacaagaacgccacagcuuccuucaucuacaauggcagacugguagauucaaucguuaguuggagcaaagagauucugaggacccaggaaucugagugugugugcauaaacggcacguguacugucgugaugacagacggguccgcaucaggaaaggccgauaccaaaauccucuuuauugaggaagguaagaucgugcacacuagcacauuaaguggcucugcucaacacgucgaggaaugcuccugcuauccucgguacccagggguucgcugugugugcagagacaauuggaagggaagcaacaggccgauaguagauauuaacaucaaagacuacucgaucgugucucgguaugucuguuccggccuggugggugacacccccaggaagaaugauucaaguagcuccucucauugccuugacccuaacaaugaggaagggggacacggcguuaaaggcugggccuucgaugacgggaacgauguguggaugggacgaacgauuagcgagaagucaagaagugguuacgagaccuuuaaagucaucgaaggcugguccaauccaaacagcaaguugcagauuaaucgccaggugauaguagaccgggggaaccguucuggauauucaggcaucuucaguguugaggguaaaagcuguauuaaucgcugcuuuuacguggaacugaucagagggaggaaggaggaaacagagguccuauggacuuccaacucuaucguggucuucuguggcaccucgggaacauauggcacugggagcuggcccgauggagcggacauuaaucucaugccuauauga

SEQ ID NO: 143613 - RNA, 1410 nt, Artificial Sequence; identical to SEQ ID NO: 143612
  derived and/or modified sequence opt3 from neuraminidase__InfluenzaA__AEX36292

SEQ ID NO: 143614 - RNA, 1410 nt, Artificial Sequence
  derived and/or modified sequence opt3 from neuraminidase__InfluenzaA__AEX36303
augaaccccaaucagaagaucauuaccauaggcagcgugucccugacaaucucuacuauuugcuucuuuaugcaaaucgccauucucaucacgaccgucacacuucacuucaaacaguacgaguuuucaaguccuccaaacaaucagguuaugcugugugaaccggcuauaaucgagagaaacauuacugaaaucguguauuugaccaauacaaccauugagaaggaaaucugccccaaauuagcagaguacaggaacuggagcaagccucagugugacauaacuggguucgccccauuuuccaaagauaauucuauucggcugucggcgggaggugacaucuggguaacacgcgagcccuaugugucaugcgauccugacaaguguuaccaauucgcucuaggccaggggaccacgcucaacaauguccauagcaacgauacugugcacgaacgaaccccauaucguacacugcuuaugaaugagcugggaguucccuuucauuugggcacuaaacaggugugcauugccuggaguuccucuagcugucacgacgguaaggcauggcuccaugucugcgugaccggggaugacaagaacgccacagcuuccuucaucuacaauggaagacugguagauucaaucguuaguuggagcaaagaaauucugaggacccaggagucugagugugugugcauaaacggcacguguacugucgugaugacagacggcuccgcaucagggaaggccgauaccaaaauccucuuuauugaagagggaaagaucgugcacacuagcacauuaagugguucugcucaacacgucgaagagugcuccugcuauccucgguacccaggcguucgcugugugugcagagacaauuggaaggggagcaacaggccgauaguagauauuaacaucaaagacuacucgaucgugucucgguaugucuguuccggacuggugggcgacacccccaggaagaaugauucaaguagcuccucucauugccuugacccuaacaaugaagagggugggcacggaguuaaaggcugggccuucgaugacggcaacgauguguggauggggcgaacgauuagcgagaagucaagaaguggauacgaaaccuuuaaagucaucgaggguugguccaauccaaacagcaaguugcagauuaaucgccaggugauaguagaccggggcaaccguucuggguauucaggaaucuucaguguugaaggcaaaagcuguauuaaucgcugcuuuuacguggagcugaucagagguaggaaggaagagacagagguccuauggacuuccaacucuaucguggucuucugugggaccucgggcacauauggaacuggcagcuggcccgauggggcggacauuaaucucaugccuauauga

SEQ ID NO: 143615 - RNA, 1410 nt, Artificial Sequence
  derived and/or modified sequence opt3 from neuraminidase__InfluenzaA__AEX36314
augaaccccaaucagaagaucauuaccauaggcagcgugucccugacaaucucuacuauuugcuucuuuaugcaaaucgccauucucaucacgaccgucacacuucacuucaaacaguacgaguuuucaaguccuccaaacaaucagguuaugcugugugaaccgacuauaaucgagagaaacauuaccgaaaucguguauuugacaaauaccacuauugagaaggaaaucugccccaaauuagcugaguacaggaacuggagcaagccucagugugacauaacaggguucgcaccauuuuccaaagauaauucuauucggcugucggccggaggugacaucuggguaacccgcgagcccuaugugucaugcgauccugacaaguguuaccaauucgcgcuaggccaggggacgacucucaacaauguccauagcaacgauaccgugcacaaucgaacaccauaucguacucugcuuaugaacgaacugggaguucccuuucauuugggcaccaaacaggugugcauugcuuggaguuccucuagcugucacgacgguaaggccuggcuccaugucugcgugacaggggaugacaagaaugcaaccgccuccuucaucuacaacggaagacugguagauucaaucguuaguuggagcaaagagauucugaggacgcaggaaucugagugugugugcauaaauggcacuugugcugucgugaugacagacggcuccgcaucagggaaggccgauaccaaaauccucuuuauugaggaaggaaagaucgugcacacuagcacauuaagugguucugcucaacacgucgaggaaugcuccugcuauccucgguacccaggcguucgcugugugugcagagacaacuggaaggggagcaacaggccgauaguagauauuaauaucaaagacuacucgaucgugucucgguaugucuguuccggacuggugggcgacacccccaggaagaacgauucaaguagcuccucucauugccuugacccuaauaacgaggaaggugaucacgggguuaaaggaugggccuucgacgauggcaaugacguguggaugggccgaacgauuagcgagaagucaagaaguggguacgagaccuuuaaagucaucgaaggaugguccaacccaaauagcaaguugcagauuaaccgccaggugauaguagaucgggguaaucguucuggcuauucagggaucuucaguguugagggaaaaagcuguauuaaccgcugcuuuuacguggaacugaucagaggcaggaaggaggaaacagagguccuauggacuuccaauucuaucguggucuucugugguaccucggggacauauggcacuggaagcuggcccgacggcgcggagauuaaccucaugccuauauga

SEQ ID NO: 143616 - RNA, 1410 nt, Artificial Sequence; identical to SEQ ID NO: 143612
  derived and/or modified sequence opt3 from neuraminidase__InfluenzaA__AEX36336

SEQ ID NO: 143617 - RNA, 1410 nt, Artificial Sequence
  derived and/or modified sequence opt3 from neuraminidase__InfluenzaA__AEX36347
augaaccccaaucagaagaucauuaccauaggcagcgugucccugacaaucucuacuauuugcuucuuuaugcagaucgccauucucaucacgaccgucacacuucacuucaaacaguacgaguuuucaaguccuccaaacaaucagguuaugcugugugaaccgauaaucauugagagaaacaucacugaaauuguguauuugaccaauacaaccaucgagaaggaaauaugccccaaauuagcugaguacaggaacuggagcaagccucagugugacauuacuggguucgcaccauuuuccaaagauaauucuauccggcugucggccggaggugacauuuggguaacacgcgagcccuaugugucaugcgauccugacaaguguuaccaauucgcgcuaggccaggggaccacgcucaacaauguccauagcaacgauacugugcacaaucgaaccccauaucguacacugcuuaugaacgaacugggaguucccuuucauuugggcacuaaacaggugugcaucgcuuggaguuccucuagcugucacgacgguaaggccuggcuccaugucugcgugaccggggaugacaagaaugcaacagccuccuucaucuacaacggaagacugguagauucaauuguuaguuggagcaaagagauacugaggacccaggaaucugagugugugugcaucaauggcacgugugcugucgugaugacugacggcuccgcaucagggaaggccgauacaaaaauucucuuuaucgaggaaggaaagauagugcacgcuagcaccuuaagugguucugcccaacacgucgaggaaugcuccugcuauccucgguacccaggcguucgcugugugugcagagacaacuggaaggggagcaacaggccgauuguagauaucaauaucaaagacuacucgauugugucucgguaugucuguuccggacuggugggcgacacuccccgcaagaacgauucaaguagcuccucucauugccuugacccuaauaacgaggaaggugggcacggaguuaaaggcugggcguucgaugacggcaaugauguguggauggggcgaacaaucagcgagaagucaagaaguggauacgagaccuuuaaagucauugaagguugguccaacccaaauagcaaguugcagauaaacaggcaagugaucguagaccggggcaaucguucuggguauucaggaauuuucaguguugagggcaaaagcuguaucaaccgcugcuuuuacguggaacugaucagagguaggaaggaggaaacggagguccuauggaccuccaauucuauuguggucuucugugggacaucgggcacuuauggaaccggcagcuggcccgauggggcagacauaaaccucaugccuaucuga

SEQ ID NO: 143618 - RNA, 1410 nt, Artificial Sequence; identical to SEQ ID NO: 137900
  derived and/or modified sequence opt3 from neuraminidase__InfluenzaA__AEX36358

SEQ ID NO: 143619 - RNA, 1410 nt, Artificial Sequence
  derived and/or modified sequence opt3 from neuraminidase__InfluenzaA__AEX36369
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgaaaccguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccauuguaucauggaguaaagagauacugcggacgcaggaaagcgaguguguuugcaucaacggcacuuguacaguggucaugaccgacggcucugcuuccgggaaggcagauacuaaaauucucuuuaucgaggaaggaaagauagugcauacaucaaccuuaagcgguagugcccaacacguggaggaaugcucuugcuauccucgcuacccaggcgucagauguguuugcagggacaacuggaagggguccaaucggccgauuguggauaucaacaucaaagaccacagcauuguaucgucuuacguguguuccggacuggucggcgacacgccccgcaagaaugauucaaguagcuccucucauugccuugacccuaacaaugaggaaggugggcacggagugaaaggcugggcuuucgaugacggcaacgauguuuggauggggcgaaccaucagcgagaagucaagauugggauaugagacauuuaaagugauugaagguuggaguaauccaaaguccaaacugcagauaaacaggcaggucaucguggaccggggcaaucguacuggguacagcggaauuuucucuguagagggcaagucauguaucaaccgcugcuuuuauguugaacuaaucagagguaggaaggaggaaaccgaggugcucuggacaaguaauagcauugucguguucugugggacuuccggcaccuacggaacaggcucuuggcccgauggggccgacauaaaccugaugccuaucuga

SEQ ID NO: 143620 - RNA, 1410 nt, Artificial Sequence
  derived and/or modified sequence opt3 from neuraminidase__InfluenzaA__AEX36391
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauagcaggguucgccccauuuagcaaagauaacuccauucggcugucugcgggaggugacaucuggguaacacgcgagcccuaugugucgugcgauccugacaaguguuaccaauucgcucuaggccaggggaccacgcucaauaacguccauucaaaugauacugugcgaaaccguaccccauauagaacacugcuuaugaaugaacugggaguucccuuucacuugggcacuaaacaggugugcauugccuggagcaguuccucuugucaugacgguaaggcauggcuccacgucugcaucaccggggaugacaagaacgccacagcuagcuucaucuacaauggaaggcugguggauuccauuguaucauggaguaaagagauacugcggacccaggaaagcgaguguguuugcaucaacggcacguguacuguggucaugacagacggcucugcauccgggaaggccgauaccaaaauucucuuuaucgaggaaggaaagauagugcauacuucaacauuaagcgguagugcucaacacguggaggaaugcucuugcuauccucgcuacccaggcgucagauguguuugcagggacaacuggaagggguccaaucggccgauuguggauaucaacaucaaagaccacagcauuguaucgucuuacguguguuccggacuggucggcgacacgccccgcaagaaugauucaaguagcuccucucauugccuugacccuaacaaugaggaaggugggcacggagugaaaggcugggccuucgaugacggcaacgauguuuggauggggcgaaccaucagcgagaagucaagauugggauaugagaccuuuaaagugauugaagguuggaguaauccaaaguccaaacugcagauaaacaggcaggucaucguggaccggggcgaucguagcggguacucuggaauuuucucaguagagggcaagaguuguaucaaucgcugcuuuuauguugaacuaaucagagguaggaaggaggaaacagaggugcucuggacuagcaacuccauugucguguucugugggaccucuggcacauacggaacuggcucguggcccgacggggcggauauaaaucugaugccuaucuga

SEQ ID NO: 143621 - RNA, 1410 nt, Artificial Sequence
  derived and/or modified sequence opt3 from neuraminidase__InfluenzaA__AEX36402
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgaggacguacaccauauagaacucugcuuaugaacgaacugggcguucccuuucacuuggguaccaaacaggugugcauugcuuggagcaguuccucuugucaugacgggaaggccuggcuccacgucugcaucacaggagaugacaagaaugcaaccgccagcuucaucuacaacggcaggcugguggauuccauuguaucauggaguaaagagauacugcggacgcaggaaagcgaguguguuugcaucaauggcacuuguacaguggucaugaccgacgggucugcuuccggaaaggcagauacuaaaauucucuuuaucgaggaagguaagauagugcauacaucaaccuuaagcggcagugcccaacacguggaggaaugcucuugcuauccucgcuucccaggggucagauguguuugcagggacaacuggaagggauccaaccggccgauuguggauaucaauaucaaagaccacagcauuguaucgucuuacguguguuccggccuggucggugacacgccccgcaagaacgauucaaguagcuccucucauugccuugacccuaauaacgaggaagggggacacggcgugaaaggcugggcuuuugaugacgggaaugauguuuggaugggacgaaccaucagcgagaagucaagauuggguuacgagacauucaaagugauugaaggcuggaguaacccaaaguccaaacugcagauaaauaggcaggucaucguggaccgggggaaccguacuggauauagcggcaucuuuucuguagaggguaagucauguauuaaucgcugcuucuacguugaacuaaucagagggaggaaggaggaaaccgaggugcucuggacaaguaacagcauugucguguucuguggcacuuccggaaccuauggcacagggucuuggcccgauggagccgacauaaaucugaugccuaucuga

SEQ ID NO: 143622 - RNA, 1410 nt, Artificial Sequence; identical to SEQ ID NO: 137900
  derived and/or modified sequence opt3 from neuraminidase__InfluenzaA__AEX36413

SEQ ID NO: 143623 - RNA, 1410 nt, Artificial Sequence
  derived and/or modified sequence opt3 from neuraminidase__InfluenzaA__AEX36424
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugcaguaaauuagcugaguacaggaauuggagcaagccccagugugacauaacaggguucgcaccuuuuuccaaagauaacucuauucggcugucggccggaggugacaucuggguaacccgcgagccauaugugucaugcgaucccgacaaguguuaccaauucgcgcuaggccaggggacgacucucaauaacguccauagcaaugauaccauucgagaccguacaccuuauagaacucugcuuaugaacgaacugggagugccauuucacuugggcaccaagcagguuugcaucgcuuggaguuccucuagcugucaugaugguaaagccuggcuccacgugugcaucacaggggacgauaagaaugcaaccgccuccuucauuuacaacggaaggcuggucgacucagugguaaguuggagcaaagagauacugcggacgcaggaaucugaguguguuugcaucaauggcacuuguacaguggucaugaccgauggcuccgcuucagggaaggcagacacuaaaauucucuuuaucgaggaaggaaagauagugcauacaagcaccuuaagugguucugcccaacacguggaggaaugcuccugcuauccccgcuacccuggcgucagauguguuugcagggauaacuggaaggggagcaaccggccaauuguggacaucaauaucaaagaccacucgauuguaucuuccuacguguguucaggacuggucggcgauacgccgcgcaagaacgacaguagcuccucuagccauugccuugaucccaauaacgaggaaggugggcacggagugaaaggcugggcuuucgacgauggcaaugacguuuggauggggcgaaccaucucagagaagaguagauugggauaugagacauuuaaagugauugaagguugguccaacccuaagagcaaacugcagauaaauaggcaggucaucguggaucggggcaaccguucuggguacucaggaauuuucaguguagagggcaagagcuguaucaaucgcugcuuuuauguugaacuaaucagagguaggaaggaggaaacugaggugcucuggaccuccaacucuauugucguguucugugggacaucgggcacuuacggaaccggcagcuggccagacggggccgauauaaaucugaugcccaucuga

SEQ ID NO: 143624 - RNA, 1410 nt, Artificial Sequence
  derived and/or modified sequence opt3 from neuraminidase__InfluenzaA__AEX36435
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaauggcacuuguacagucgugaugaccgauggcucugcuuccgggaaggcagacacuaaaauccucuuuauuaaggagggaaagaucgugcauacaucaaccuuaagcgguagugcccaacacgucgaagagugcucuugcuauccucgcuacccaggcguuagaugugugugcagggauaacuggaaaggguccaaccggccgauaguagacauuaauaucaaggaccacagcaucgugucgucuuacgucuguuccggacuggugggcgauacgccccgcaaaaacgacucaaguagcuccucucauugccuugauccuaauaacgaagagggugggcacggaguuaagggcugggcuuucgacgauggcaaugacguguggauggggcgaaccauuagcgaaaaaucaagauugggauaugagacauuuaaggucaucgaggguuggaguaacuccaaaagcaagcugcagauuaauaggcaagugauaguagaucggggcaaccguucuggguacucaggaaucuucaguguugaaggcaagagcuguauuaaucgcugcuuuuauguggagcuaaucagagguaggaaagaagagacugaaguccucuggaccuccaacucuaucguggucuucugugggacaucgggcacuuacggaaccggcagcuggccagacggggccgauauuaaucugaugcccauauga

SEQ ID NO: 143625 - RNA, 1410 nt, Artificial Sequence; identical to SEQ ID NO: 138082
  derived and/or modified sequence opt3 from neuraminidase__InfluenzaA__AEX36446

SEQ ID NO: 143626 - RNA, 1410 nt, Artificial Sequence; identical to SEQ ID NO: 138082
  derived and/or modified sequence opt3 from neuraminidase__InfluenzaA__AEX36457

SEQ ID NO: 143627 - RNA, 1410 nt, Artificial Sequence
  derived and/or modified sequence opt3 from neuraminidase__InfluenzaA__AEX36468
augaaccccaaucagaagaucauuaccauaggcagcgugucccugacaaucucuacuauuugcuucuuuaugcagaucgccauucucaucacgaccgucacacuucacuucaaacaguacgaguuuucaaguccuccaaacaaucagguuaugcugugugaaccgacuauaaucgagagaaacauuaccgaaaucguguauuugacaaauaccacuauugagaaggaaaucugccccaaauuagcugaguacaggaacuggagcaagccucagugugacauaacaggguucgcaccauuuuccaaagauaauucuauucggcugucggccggaggugacaucuggguaacccgcgagcccuaugugucaugcgauccugacaaguguuaccaauucgcgcuaggccaggggacgacucucaacaauguccauagcaacgauaccgugcacaaucgaacaccauaucguacucugcuuaugaacgaacugggaguucccuuucauuugggcaccaaacaggugugcauugcuuggaguuccucuagcugucacgacgguaaggccuggcuccaugucugcgugacaggggaugacaagaaugcaaccgccuccuucaucuacaacggaagacugguagauucaaucguuaguuggagcaaagagauucugaggacgcaggaaucugagugugugugcauaaauggcacuuguacagucgugaugaccgacggcuccgcuucagggaaggcagauacuaaaauccucuuuauugaggaaggaaagaucgugcacacaagcaccuuaagugguaacgcccaacacgucgaggaaugcucuugcuauccucgguacccaggcguucgcugugugugcagagacaacuggaagggguccaauaggccgauaguagauauuaacaucaaagacuacagcaucgugucgcgguaugucuguucuggacuggugggcgacacgccccgcaagaaugauuccucaaguagcucccauugccuugacccuaacaaugaggaaggugggcacggaguuaaaggcugggcuuucgaugacggcaacgauguguggauggggcgaaccauuucugaaaagagcagaucaggauacgagacauuuaaagucaucgaggguuggaguaauccaaacuccaaguugcagauuaauaggcaagugauaguagaccggggcaaccguagcggguauucuggaaucuucucaguugagggcaaaaguuguauuaaucgcugcuuuuacguggaacugaucagagguaggaaggaggaaacuaagguccuauggaccagcaacuccaucguggucuucugugggacaucuggcacuuauggaaccggcucguggcccgauggggccgacauuaaucucaugccuauauga

SEQ ID NO: 143628 - RNA, 1410 nt, Artificial Sequence
  derived and/or modified sequence opt3 from neuraminidase__InfluenzaA__AEX36479
augaaccccaaucagaagaucauuaccauaggcagcgugucccugacaaucucuacuauuugcuucuuuaugcagaucgccauucucaucacgaccgucacacuucacuucaaacaguacgaguuuucaaguccuccaaacaaucagguuaugcugugugaaccgacuauaaucgagagaaacauuaccgaaaucguguaucccacaaauaccacuacagagaaggaaauuugcccuaaauuggcugaguacaggaacuggagcaagccacagugugacaucaccggguucgcacccuuuuccaaagauaauucuauacgguuaucggccggaggugacauuuggguaacgcgcgagccuuaugugucaugcgauccagacaaguguuaccaauucgcgcugggccaggggacuacccuaaacaauguccauagcaacgauacagugcacgaccgaacucccuaucguacccuccugaugaaugaacuuggaguuccuuuucaucugggcacaaaacaggugugcaucgcuuggaguuccucuagcugucacgaugguaaggccugguugcaugucugcgugaccggggacgauaagaacgcaacggccuccuucauuuacaauggaagacucguagacucaaucguuaguuggagcaaagagauccugaggacucaggaaucugagugugugugcauuaacggcacauguaccgucgugaugacugauggcuccgcuucagggaaggcagacacaaaaauacuguuuaucgaggaaggaaagauugugcacaccagcacgcucagugguucugcccaacacgucgaggaaugcuccugcuauccacgguacccgggcguucgcugugugugcagagauaauuggaaggggagcaacaggcccaucguagacauaaacauuaaagacuacucgaucgugucucgguaugucuguuccggauuagugggcgauaccccucgcaagaaugacucaaguagcuccucucauugccuggauccaaacaaugaggaaggugggcacggaguuaaaggcugggcuuucgacgauggcaacgacguguggauggggcgaacaaucagcgagaaacuuagaucaggauacgagacuuuuaaggucauugaagguuggaguaaucccaacuccaaguugcagaucaauaggcaagugauuguagaucggggcaaccguagcggguauucuggaauauucucaguugagggcaaaaguuguaucaaucgcugcuuuuacguggaacugauuagagguaggaaggaggaaaccgagguccuauggacaagcaacuccaucguggucuucugugggacuucuggcaccuauggaacaggcucguggccugacggggccgauaucaaucucaugccaauuuga

SEQ ID NO: 143629 - RNA, 1410 nt, Artificial Sequence
  derived and/or modified sequence opt3 from neuraminidase__InfluenzaA__AEX36490
augaaccccaaucagaagaucauuaccauaggcagcgugucccugacaaucucuacuauuugcuucuuuaugcagaucgccauucucaucacgaccgucacacuucacuucaaacaguacgaguuuucauauccuccaaacaaucagguuaugcugugugaaccgacuauaaucgagagaaacauuaccgaaaucguguacuugacaaauaccacuauugagaaggaaaucugccccaaauuagcugaguauaggaacuggaguaagccucagugugacauaacaggguucgcaccauuuagcaaagauaauuccauucggcugucugccggaggugacaucuggguaacccgcgagcccuacgugucgugcgauccugacaaguguuaucaauucgcgcuaggccaggggacgacucucaacaauguccauucaaacgauaccgugcacgaccgaacaccauaccguacucugcuuaugaaugaacugggaguucccuuucauuugggcaccaaacaggugugcauugcuuggagcaguuccucuugucacgaugguaaggccuggcuccaugucugcgugacaggggacgauaagaacgcaaccgccagcuucaucuauaauggaagacugguagacuccaucguuucauggaguaaagagauucugaggacgcaggaaagcgagugugugugcauaaacggcacuuguacagucgugaugaccgauggcucugcuuccgggaaggcagacacuaaaauccucuuuauugaggaaggaaagaucgugcacacaucaaccuuaagcgguaaugcccaacacgucgaggaaugcaguugcuacccucgguacccaggcguucgcugugugugcagagauaacuggaaggggucuaacaggccgauaguagacauuaauaucaaagacuauuccaucgugagccgguacgucuguucgggacuggugggcgauacgccccgcaagaacgacucuuccucaaguagccauugccuugauccuaauaacgaggaaggugggcacggaguuaaaggcugggcuuucgacgauggcaaugacguguggauggggcgaaccauuuccgagaagucuagaagcggauaugagacauuuaaagucaucgaagguuggucaaacccaaauaguaaguugcagauuaacaggcaagugauaguagaucggggcaaucguuccggguacagcggaaucuucucuguugagggcaaaucauguauuaaccgcugcuuuuauguggaacugaucagagguaggaaggaggaaacuaagguccuauggaccaguaauagcaucguggucuucugugggacauccggcacuuacggaaccggcucuuggcccgacggggccgauauuaaccucaugccuauauga

SEQ ID NO: 143630 - RNA, 1410 nt, Artificial Sequence
  derived and/or modified sequence opt3 from neuraminidase__InfluenzaA__AEX36501
augaaccccaaucagaagaucauuaccauaggcagcgugucccugacaaucucuacuauuugcuucuuuaugcaaaucgccauucucaucacgaccgucacacuucacuucaaacaguacgaguuuucaaguccuccaaacaaucagguuaugcugugugaaccggcuauaaucgagagaaacauuacugaaaucguguauuugaccaauacaaccauugagaaggaaaaaugccccaaguuagcagaguacaggaacuggagcaaaccucagugugacaucacuggguucgccccauuuuccaaggauaauucuauacggcugucggcgggaggugacauuuggguaacacgcgagcccuaugugucaugcgauccugacaaguguuaccaauucgcucuaggccaggggaccacgcucaacaauguccauagcaacgauacugugcacggacgaaccccauaucguacacugcuuaugaaugaacugggcguucccuuucauuuggguacuaaacaggugugcaucgccuggaguuccucuagcugucacgacgggaaggcauggcuccaugucugcgugaccggagaugacaaaaacgccacagcuuccuucauuuacaauggcagacugguagauucaaucguuaguuggagcaaggagauccugaggacccaggaaucugagugugugugcauuaacggcacguguacugucgugaugacagacggguccgcaucaggaaaagccgauaccaagauacucuuuaucgaggaagguaagauugugcacacuagcacauuaaguggcucugcucaacacgucgaggaaugcuccugcuauccucgguacccagggguucgcugugugugcagagacaauuggaaaggaagcaacaggccgaucguagauauaaacauuaaggacuacucgaucgugucucgguaugucuguuccggccuggugggugacacccccaggaaaucagauaguagcuccucuagccauugccuugacccuaauaacgaggaagggggacacggcguuaagggcugggccuucgaugacgggaaugauguguggaugggacgaacgaucucagagaaaaguagauccgguuacgagaccuuuaaggucauugaaggcuggagcaacccaaauucuaaauugcagaucaaccgccaggugauuguagaccgggggaaucguucaggauauaguggcauauucagcguugaggguaaguccuguaucaaccgcugcuuuuacguggaacugauuagagggaggaaggaggaaacagagguccuauggacuucuaauucgaucguggucuucuguggcaccagcggaacauauggcacuggguccuggcccgauggagcggacaucaaccucaugccuauuuga

SEQ ID NO: 143631 - RNA, 1410 nt, Artificial Sequence
  derived and/or modified sequence opt3 from neuraminidase__InfluenzaA__AEX36512
augaaccccaaucagaagaucauuaccauaggcagcgugucccugacaaucucuacuauuugcuucuuuaugcaaaucgccauucucaucacgaccgucacacuucacuucaaacaguacgaguuuucaaguccuccaaacaaucagguuaugcugugugaaccggcuauaaucgagagaaacauuacugaaaucguguauuugaccaauacaaccauugagaaggaaaucugccccaaauuagcagaguacaggaacuggagcaagccucagugugacauaacuggguucgccccauuuuccaaagauaauucuauucggcugucggcgggaggugacaucuggguaacacgcgagcccuaugugucaugcgauccugacaaguguuaccaauucgcucuaggccaggggaccacgcucaacaauguccauagcaacgauacugugcacgaccgaaccccauaucguacacugcuuaugaaugaacugggaguucccuuucauuugggcacuaaacaggugugcauugccuggaguuccucuagcugucacgaugguaaggcauggcuccaugucugcgugaccggggacgauaagaacgccacagcuuccuucaucuacaauggaagacugguagacucaaucguuaguuggagcaaagagauucugaggacccaggaaucugagugugugugcauaaacggcacguguacugucgugaugacagauggcuccgcaucagggaaggccgacaccaaaauccucuuuauugaggaaggaaagaucgugcacacuagcacauuaagugguucugcucaacacgucgaggaaugcuccugcuauccucgguacccaggcguucgcugugugugcagagauaauuggaaggggagcaacaggccgauaguagacauuaacaucaaagacuacucgaucgugucucgguaugucuguuccggacuggugggcgauacccccaggaagaaugacucaaguagcuccucucauugccuugauccuaacaaugaggaaggugggcacggaguuaaaggcugggccuucgacgauggcaacgacguguggauggggcgaacgauuagcgagaagucaagaaguggauacgagaccuuuaaagucaucgaagguugguccaauccaaacagcaaguugcagauuaaucgccaggugauaguagaucggggcaaccguucuggguauucaggaaucuucaguguugagggcaaaagcuguauuaaucgcugcuuuuacguggaacugaucagagguaggaaggaggaaacagagguccuauggacuuccaacucuaucguggucuucugugggaccucgggcacauauggaacuggcagcuggcccgacggggcggauauuaaucucaugccuauauga

SEQ ID NO: 143632 - RNA, 1410 nt, Artificial Sequence
  derived and/or modified sequence opt3 from neuraminidase__InfluenzaA__AEX36523
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaauggcacuuguacagucgugaugaccgauggcucugcuuccggggaggcagacacuaagauccucuuuauugaagagggaaaaaucgugcauacaucaaccuuaagcgguagugcccaacacgucgaagagugcucuugcuauccucgcuacccaggcguuagaugugugugcagggauaacuggaagggguccaaccggccgauaguagacauuaauaucaaggaccacagcaucgugucgucuuacgucuguuccggacuggugggcgauacgccccgcaaaaacgacucaaguagcuccucucauugccuugauccuaauaacgaagagggugggcacggaguuaagggcugggcuuucgacgauggcaaugacguguggauggggcgaaccauuagcgagaaaucaagauugggauaugaaacauuuaaggucaucgaggguuggaguaacccaaaauccaagcugcagauuaauaggcaagugauaguagaucggggcaaccguagcggguacucuggaaucuucucaguugaaggcaaaaguuguauuaaucgcugcuuuuauguggagcuaaucagagguaggaaggaagagacugagguccucuggaccagcaacuccaucguggucuucugugggacaucuggcacuuacggaaccggcucguggcccgacggggccgauauuaaucugaugccuauauga

SEQ ID NO: 143633 - RNA, 1410 nt, Artificial Sequence; identical to SEQ ID NO: 138615
  derived and/or modified sequence opt3 from neuraminidase__InfluenzaA__AEX36534

SEQ ID NO: 143634 - RNA, 1410 nt, Artificial Sequence
  derived and/or modified sequence opt3 from neuraminidase__InfluenzaA__AEX36545
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaauggcacuuguacagucgugaugaccgauggcucugcucucgggaaggcagacacuaaaaucuuauuuauugaggaaggaaagaucgugcauacauccacccugucagguagcgcccaacacgucgaggaaugcaguugcuauccucgcuacccaggcguuagaugugugugcagggauaacuggaaggggucuaaccggccgauaguagacauuaauaucaaagaccacuccaucgugagcucguacgucuguucuggacuugugggcgauacgccccgcaagaacgacuccucaaguagcucccauugcuuggauccuaauaacgaggaaggugggcacggaguuaaaggcugggcuuucgacgauggcaaugacguguggauggggcgaaccauuucugaaaagagcagacugggauaugagacauuuaaagucaucgaggguuggucaaacccaaagaguaaacuacagauuaauaggcaagugauaguagaucggggcaaccguuccggguacagcggaaucuucucuguugagggcaagucauguauuaaucgcugcuuuuauguggaacucaucagagguaggaaggaggaaacugagguccuguggaccaguaacagcaucguggucuucugugggacauccggcacuuacggaaccggcucuuggcccgacggggccgauauuaaucuuaugccuauauga

SEQ ID NO: 143635 - RNA, 1410 nt, Artificial Sequence; identical to SEQ ID NO: 138528
  derived and/or modified sequence opt3 from neuraminidase__InfluenzaA__AEX36556

SEQ ID NO: 143636 - RNA, 1410 nt, Artificial Sequence; identical to SEQ ID NO: 138528
  derived and/or modified sequence opt3 from neuraminidase__InfluenzaA__AEX36567

SEQ ID NO: 143637 - RNA, 1410 nt, Artificial Sequence
  derived and/or modified sequence opt3 from neuraminidase__InfluenzaA__AEX36578
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaauggcacuuguacagucgugaugaccgauggcucugcuuccgggaaggcagacacuaaaauccucuuuauuaaggagggaaagaucgugcauacaucaaccuuaagcgguagugcccaacacgucgaagagugcucuugcuauccucgcuacccaggcguuagaugugugugcagggauaacuggaaaggguccaaccggccgauaguagacauuaauaucaaggaccacagcaucgugucgucuuacgucuguuccggacuggugggcgauacgccccgcaaaaacgacucaaguagcuccucucauugccuugauccuaauaacgaagagggugggcacggaguuaagggcugggcuuucgacgauggcaaugacguguggauggggcgaaccauuagcgaaaaaucaagauugggauaugagacauuuaaggucaucgaggguuggaguaacccaaaauccaagcugcagauuaauaggcaagugauaguagaucggggcaaccguagcggguacucuggaaucuucucaguugaaggcaagaguuguauuaaucgcugcuuuuauguggagcuaaucagagguaggaaagaagagacugaaguccucuggaccagcaacuccaucguggucuucugugggacaucuggcacuuacggaaccggcucguggcccgacggggccgauauuaaucugaugccuauauga

SEQ ID NO: 143638 - RNA, 1410 nt, Artificial Sequence; identical to SEQ ID NO: 143637
  derived and/or modified sequence opt3 from neuraminidase__InfluenzaA__AEX36589

SEQ ID NO: 143639 - RNA, 1410 nt, Artificial Sequence
  derived and/or modified sequence opt3 from neuraminidase__InfluenzaA__AEX36600
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaauggcacuuguacagucgugaugaccgauggcucugcuuccgggaaggcagacacuaaaauccucuuuauuaaggagggaaagaucgugcauacaucaaccuuaagcgguagugcccaacacgucgaagagugcucuugcuauccucgcuacccaggcguuagaugugugugcagggauaacuggaaaggguccaaccggccgauaguagacauuaauaucaaggaccacagcaucgugucgucuuacgucuguuccggacuggugggcgauacgccccgcaaaaacgacucaaguagcuccucucauugccuugauccuaauaacgaagagggugggcacggaguuaagggcugggcuuucgacgauggcaauaacguguggauggggcgaaccauuagcgaaaaaucaagauugggauaugagacauuuaaggucaucgaggguuggaguaauccaaaauccaagcugcagauuaacaggcaagugauaguagaccggggcaaucguagcggguacucuggaaucuucucaguugaaggcaagaguuguauuaaccgcugcuuuuauguggagcuaaucagagguaggaaagaagagacugaaguccucuggaccagcaauuccaucguggucuucugugggacaucuggcacuuacggaaccggcucguggcccgauggggccgacauuaaccugaugccuauauga

SEQ ID NO: 143640 - RNA, 1410 nt, Artificial Sequence; identical to SEQ ID NO: 136730
  derived and/or modified sequence opt3 from neuraminidase__InfluenzaA__AEX36622

SEQ ID NO: 143641 - RNA, 1410 nt, Artificial Sequence
  derived and/or modified sequence opt3 from neuraminidase__InfluenzaA__AEX63619
augaaccccaaucagaagaucauuaccauaggcagcaucugcaugacaauugggaucgccucccugauucuccaaaucggaaacauaaucucuauuuggaucucacacaguauucagacugagaaucagaaccagccugaaaucuguaaucaaaacgugauaacguacgagaauaacaccugggucaaucagacauauguuaacgugagcaauacuaacuucguagcugaacaggcaguggccuccgucaaacuugcggguaauucuucgcugugcccagugucaggcugggcuauuuacagcaaggacaacaguguuagaaucggguccaaaggagauguguuugucauuagggagccguucaucucuuguagccauuccgaaugccggaccuuuuucuugacacagggcgccuuacugaaugacaagcacucaaacgguaccaucaaagaucgcagucccuaucgaacucuaaugagcuguccuauuggggaggugccaucucccuacaacucccguuuugagucaguagcauggagcgccagugcuugccaugacggaacaucuuggcucaccauaggcaucuccggcccugauaauggggcaguugccgugcugaaguauaacggaauuaucacggacacuauaaagagcuggaggaaaaauauucuuagaacccaagaaucggagugugcuugcgucaacgguucuuguuucacagugaugacugauggcccauccaaugggcaggccucauacaagguguuuaaaaucgaacggggaaaggucguuaaaaguguggagcugaacgcgcccaauuaucacuacgaggaaugcagcuguuacccugaguccucugaaauuaccugcguaugccgcgacaacuggcauggcagcaauagaccaugggugucauucaaccagaauuuggaguaucagauggguuacaucuguagugggaucuuuggagauaacccgaggcccaaugacaagacaggcuccugcggcccugucuucagcaacggggcaaauggagugaaggguuuuucuuucaaauauggcaacgggguuuggauuggacggaccaagucaacgaguagccgcaugggcuuugaaaugauaugggauccagacgguuggacuaaaacagaugacaaguucuccgugaaacaagacaucauugggaucaccgauuggucuggcuacucgggcagcuucguccagcaccccgagcucacuggacuggacuguaugcgaccuugcuuuuggguggagcugaucagagggaggccaaaggaaaacacaauuuggaccuccggaucaaguauaucuuucugugguguaaauagcgauacgguuggcugguccuggcccgacggggccgagcucccguuuaccaucgauaaauga

SEQ ID NO: 143642 - RNA, 1365 nt, Artificial Sequence; identical to SEQ ID NO: 137735
  derived and/or modified sequence opt3 from neuraminidase__InfluenzaA__AEX92876

SEQ ID NO: 143643 - RNA, 1365 nt, Artificial Sequence; identical to SEQ ID NO: 137735
  derived and/or modified sequence opt3 from neuraminidase__InfluenzaA__AEX92887

SEQ ID NO: 143644 - RNA, 1365 nt, Artificial Sequence; identical to SEQ ID NO: 137735
  derived and/or modified sequence opt3 from neuraminidase__InfluenzaA__AEX92904

SEQ ID NO: 143645 - RNA, 1365 nt, Artificial Sequence; identical to SEQ ID NO: 137735
  derived and/or modified sequence opt3 from neuraminidase__InfluenzaA__AEX96924

SEQ ID NO: 143646 - RNA, 1410 nt, Artificial Sequence; identical to SEQ ID NO: 140485
  derived and/or modified sequence opt3 from neuraminidase__InfluenzaA__AEY69091

SEQ ID NO: 143647 - RNA, 1410 nt, Artificial Sequence; identical to SEQ ID NO: 138615
  derived and/or modified sequence opt3 from neuraminidase__InfluenzaA__AEY69101

SEQ ID NO: 143648 - RNA, 1410 nt, Artificial Sequence; identical to SEQ ID NO: 138615
  derived and/or modified sequence opt3 from neuraminidase__InfluenzaA__AEY69112

SEQ ID NO: 143649 - RNA, 1410 nt, Artificial Sequence
  derived and/or modified sequence opt3 from neuraminidase__InfluenzaA__AEY69145
augaacaccaaucagaagaucauuacaauaggcagcgugucccugacuaucucuacgauuugcuucuuuaugcagaucgccauucucaucaccacagucacucuucacuucaaacaguacgaguuuaacucacccccuaauaaccagguuaugcugugugaaccaaccauaaucgagagaaauauuacagaaaucguguauuugaccaacacuacaauugagaaggaaaucugcccgaaauuagcugaguacaggaauuggaguaagccccagugugacauaaccggguucgcaccuuuuagcaaagauaacuccauucggcugucugccggaggugacaucuggguaacgcgcgagccauaugugucgugcgaucccgacaaguguuaccaauucgcgcuaggccaggggacuaccauuaauaacguccauucaaauaacacagugcgagaucguacuccuuauagaacccuccugaugaaugaacuuggaguuccauuucaccugggcacaaaacaggugugcaucgcuuggagcaguuccucuugucaugacgguaaggccugguugcacgucugcaucaccggggaugacaagaacgcaacggccagcuucauuuacaauggaaggcucguggauuccguaguuucauggaguaaagagauacugcggacucaggaaagcgagugugugugcaucaacggcacauguaccgucgugaugacugacggcucugcuuccgggaaggcagauacaaaaauucuguuuaucgaggaaggaaagauagugcauaccucaacgcucagcgguagugcccaacacgucgaggaaugcucuugcuauccccgcuacccuggcguuagaugugugugcagggacaacuggaagggguccaaucggccaauuguagauaucaacaugaaagaccacagcaucgugucgucuuacgucuguuccggauuagugggcgacaccccgcgcaagaaugauucaaguagcuccucucauugccuggaccccaacaaugaggaaggugggcacggaguuaaaggcugggcuuucgaugacggcaacgauguguggauggggcgaacaauuagcgagaagucaagacuuggauaugagacuuuuaaagucaucgaagguuggaguaauccuaaguccaaauugcagauuaacaggcaagugauaguagaccggggcaaucguagcggguacucuggaaucuucucaguugagggcaagaguuguauuaaccgcugcuuuuauguggaacugaucagagguaggaaggaggaaaccgagguccuauggacaagcaauuccguggucguguucugugggacuucuggcaccuacggaacaggcucguggccagauggggccgacaucaaccucaugcccauuuga

SEQ ID NO: 143650 - RNA, 1410 nt, Artificial Sequence; identical to SEQ ID NO: 138615
  derived and/or modified sequence opt3 from neuraminidase__InfluenzaA__AEY69156

SEQ ID NO: 143651 - RNA, 1410 nt, Artificial Sequence
  derived and/or modified sequence opt3 from neuraminidase__InfluenzaA__AEY69167
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaagucaagauugggauaugagacauuuaaagucaucgaagguuggaguaauccaaaguccaaacugcagauuaacaggcaagugauaguagaccggggcaaucguagcggguacucuggaaucuucucaguugagggcaagaguuguauuaaccgcugcuuuuauguggaacuaaucagagguaggaaggaggaaacugagguccucuggaccagcaauuccaucguggucuucugugggacaucuggcacuuacggaaccggcucguggcccgauggggccgacauuaaccugaugccuguguga

SEQ ID NO: 143652 - RNA, 1410 nt, Artificial Sequence; identical to SEQ ID NO: 143651
  derived and/or modified sequence opt3 from neuraminidase__InfluenzaA__AEY69178

SEQ ID NO: 143653 - RNA, 1410 nt, Artificial Sequence; identical to SEQ ID NO: 143651
  derived and/or modified sequence opt3 from neuraminidase__InfluenzaA__AEY69189

SEQ ID NO: 143654 - RNA, 1410 nt, Artificial Sequence
  derived and/or modified sequence opt3 from neuraminidase__InfluenzaA__AEY69211
augaaccccaaucagaagaucauuaccauaggcagcgugucccugacaaucucuacuauuugcuucuuuaugcagaucgccauucucaucacgaccgucacacuucacuucaaacaguacaaguuuaacucaccuccaaauaaccagguuaugcugugugagccgacuauaaucgaaagaaauauuaccgagaucguguauuugacaaacaccacuauugaaaaagagaucugccccaaguuagcugaauacaggaauuggaguaaaccucagugugacauaacaggguucgcaccauuuagcaaggauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugagcugggaguucccuuucacuugggcaccaaacaggugugcauugcuuggagcaguuccucuugucaugacgguaaggccuggcuccacgucugcaucacaggggaugacaaaaacgcaaccgccagcuucaucuacaauggaaggcugguggauuccguaguuucauggaguaaggaaauucugcggacgcaggagagcgaaugugugugcauaaacggcacuuguacagucgugaugaccgacggcucugcuuccgggaaagcagauacuaagauccucuuuauugaggagggaaagaucgugcauacaucaaccuuaagcgguagugcccaacacgucgaagagugcucuugcuauccucgcuacccaggcguuagaugugugugcagggacaacuggaaaggguccaaucggccgauaguagauauuaacaucaaggaccacagcaucgugucgucuuacgucuguuccggacuggugggcgacacgccccgcaaaaaugauucaaguagcuccucucauugccuugacccuaacaaugaagagggugggcacggaguuaagggcugggcuuucgaugacggcaacgauguguggauggggcgaaccauuagcgaaaaaucaagauugggauaugagacauuuaaggucaucgaggguuggaguaauccaaaauccaagcugcagauuaacaggcaagugauaguagaccggggcaaucguagcggguacucuggaaucuucucaguugaaggcaagaguuguauuaaccgcugcuuuuauguggagcuaaucagagguaggaaagaagagacugaaguccucuggaccagcaauuccaucguggucuucugugggacaucuggcacuuacggaaccggcucguggcccgauggggccgacauuaaccugaugccuguguga

SEQ ID NO: 143655 - RNA, 1410 nt, Artificial Sequence; identical to SEQ ID NO: 143651
  derived and/or modified sequence opt3 from neuraminidase__InfluenzaA__AEY69233

SEQ ID NO: 143656 - RNA, 1410 nt, Artificial Sequence; identical to SEQ ID NO: 143651
  derived and/or modified sequence opt3 from neuraminidase__InfluenzaA__AEY69272

SEQ ID NO: 143657 - RNA, 1410 nt, Artificial Sequence; identical to SEQ ID NO: 143651
  derived and/or modified sequence opt3 from neuraminidase__InfluenzaA__AEY69283

SEQ ID NO: 143658 - RNA, 1410 nt, Artificial Sequence
  derived and/or modified sequence opt3 from neuraminidase__InfluenzaA__AEY69294
augaaccccaaucagaagaucauuaccauaggcagcgugucccugacaaucucuacuauuugcuucuuuaugcaaacggccauccucauuaccacagucacucuucacuucaaacagugugaguuuaacucaccuccaaauaaccagguuaugcugugcgaaccgaccaucauagagagaaauaucacagaaauuguguacuugaccaacacuacaaucgagaaggaaauuugucccaaauuagcugaguauaggaauuggaguaagccucagugcgacaucaccggguucgcaccauuuagcaaagauaacuccauacggcugucugccggaggugacauuuggguaacgcgcgagcccuacgugucgugugauccugacaagugcuaucaauucgcgcuaggccaggggacuacccucaauaacguccauucaaauaacacagugcgagaucguacuccauacagaacccugcuuaugaaugaacugggaguucccuuucacuugggcacaaaacagguguguaucgcuuggagcaguuccucuugccaugacgguaaggccuggcuccacgucuguauuaccggggaugacaagaacgcaacggccagcuucaucuauaauggaaggcugguggauuccguaguuucauggaguaaagagauccugcggacucaggaaagcgagugcguguguauuaacggcacaugcaccgucgugaugacugacggcucugcuuccgggaaggcagauacaaaaauacucuuuaucgaggaaggaaagauugugcauaccucaacguuaagcgguagugcccaacacgucgaggaaugcucuuguuacccucgcuauccaggcguuagaugcguguguagggacaacuggaagggguccaaucggccgaucguagauauaaacauuaaagaccacagcaucgugucgucuuacgucugcuccggacuggugggcgacacccccaggaagaaugauucaaguagcuccucucauugucuugacccuaacaaugaggaaggugggaacggaguuaaaggcugggcuuucgaugacggcaaugauguguggauggggcgaacaaucagcgagaagucaagauugggauacgagacuuuuaaagucauugaagguuggaguaacccaaaguccaaacugcagaucaaucgccaggugauuguagaccggggcaaccguagcggguauucuggaauauucucaguugagggcaagaguugcaucaaucgcuguuuuuacguggaacuaauuagagguaggaaggaggaaaccgagguccucuggacaagcaacuccaucguggucuucugcgggacuucuggcaccuauggaacaggcucguggcccgauggggccgacaucaaucugaugccuauuuga

SEQ ID NO: 143659 - RNA, 1410 nt, Artificial Sequence; identical to SEQ ID NO: 143658
  derived and/or modified sequence opt3 from neuraminidase__InfluenzaA__AEY69305

SEQ ID NO: 143660 - RNA, 1410 nt, Artificial Sequence; identical to SEQ ID NO: 143658
  derived and/or modified sequence opt3 from neuraminidase__InfluenzaA__AEY69316

SEQ ID NO: 143661 - RNA, 1410 nt, Artificial Sequence; identical to SEQ ID NO: 143658
  derived and/or modified sequence opt3 from neuraminidase__InfluenzaA__AEY69788

SEQ ID NO: 143662 - RNA, 1410 nt, Artificial Sequence; identical to SEQ ID NO: 138615
  derived and/or modified sequence opt3 from neuraminidase__InfluenzaA__AEY69799

SEQ ID NO: 143663 - RNA, 1410 nt, Artificial Sequence; identical to SEQ ID NO: 138615
  derived and/or modified sequence opt3 from neuraminidase__InfluenzaA__AEY69810

SEQ ID NO: 143664 - RNA, 1410 nt, Artificial Sequence; identical to SEQ ID NO: 143651
  derived and/or modified sequence opt3 from neuraminidase__InfluenzaA__AEY69832

SEQ ID NO: 143665 - RNA, 1410 nt, Artificial Sequence
  derived and/or modified sequence opt3 from neuraminidase__InfluenzaA__AEY69843
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucgcaggggaugacaagaacgccacagcuagcuucaucuacaauggaaggcugguggauuccguaguuucauggaguaaagagauucugcggacccaggaaagcgagugugugugcauaaacggcacguguacugucgugaugacagacggcucugcauccgggaaggccgauaccaaaauccucuuuauugaggaaggaaagaucgugcauacuucaacauuaagcgguagugcucaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacccccaggaagaaugauucaaguagcuccucucauugccuugacccuaacaaugaggaaggugggcacggaguuaaaggcugggccuucgaugacggcaacgauguguggauggggcgaacgauuagcgagaagucaagauugggauaugagaccuuuaaagucaucgaagguuggaguaauccaaaguccaaacugcagauuaaccgccaggugauaguagaccggggcaaucguagcggguacucuggaaucuucucaguugagggcaagaguuguauuaaccgcugcuuuuauguggaacuaaucagagguaggaaggaggaaacagagguccucuggacuagcaauuccaucguggucuucugugggaccucuggcacauacggaacuggcucguggcccgauggggcggacauuaaccugaugccuguguga

SEQ ID NO: 143666 - RNA, 1410 nt, Artificial Sequence; identical to SEQ ID NO: 143651
  derived and/or modified sequence opt3 from neuraminidase__InfluenzaA__AEY69854

SEQ ID NO: 143667 - RNA, 1410 nt, Artificial Sequence; identical to SEQ ID NO: 143651
  derived and/or modified sequence opt3 from neuraminidase__InfluenzaA__AEY69876

SEQ ID NO: 143668 - RNA, 1410 nt, Artificial Sequence; identical to SEQ ID NO: 143651
  derived and/or modified sequence opt3 from neuraminidase__InfluenzaA__AEY69887

SEQ ID NO: 143669 - RNA, 1410 nt, Artificial Sequence; identical to SEQ ID NO: 143651
  derived and/or modified sequence opt3 from neuraminidase__InfluenzaA__AEY69898

SEQ ID NO: 143670 - RNA, 1410 nt, Artificial Sequence; identical to SEQ ID NO: 138615
  derived and/or modified sequence opt3 from neuraminidase__InfluenzaA__AEY69909

SEQ ID NO: 143671 - RNA, 1410 nt, Artificial Sequence
  derived and/or modified sequence opt3 from neuraminidase__InfluenzaA__AEY69942
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugacggaggugauaucuggguaacccgcgagcccuaugugucgugcgacccugauaaguguuaccaauucgcccuaggccaggggacgacucucaauaacauucauucaaauaacaccguccgagaccguacaccauauagaacucugcuuaugaaugaacugggagugcccuuucacuugggcaccaagcagguuugcaucgcguggagcaguuccucuugucaugaugguaaagcauggcuccacgugugcaucacaggggacgauaagaacgccaccgcuagcuucauuuacaauggaaggcuggucgacuccgugguaucauggaguaaagagauacugcggacgcaggaaagcgaguguguuugcaucaacggcacuuguacaguggucaugaccgauggcucugccuccgggaaggcugacacuaaaauucucuuuaucgaggaaggaaagauagugcauacaucaaccuuaagcgguagugcacaacacguggaggaaugcucuugcuauccucgcuacccaggcgucagauguguuugcagggauaacuggaagggguccaaucggccgauuguggacaucaacaucaaagaccacagcauuguaucgucuuacguguguuccggacuggucggcgauacgccccgcaagaaugacucaaguagcuccucucauugccuugauccuaacaaugaggaaggugggcacggagugaaaggcugggccuucgacgauggcaacgacguuuggauggggcgaaccaucagcgagaagucaagauugggauaugagacauuuaaagugauugaagguuggaguaauccaaaguccaaacugcagauaaacaggcaggucaucguggaucggggcaaucguagcggguacucuggaauuuucucaguagagggcaagaguuguaucaaccgcugcuuuuauguugaacuaaucagagguaggaaggaggaaacugaggugcucuggaccagcaauuccauugucguguucugugggacaucuggcacuuacggaaccggcucguggcccgacggggcugauauaaaccugaugccugucuga

SEQ ID NO: 143672 - RNA, 1410 nt, Artificial Sequence; identical to SEQ ID NO: 143671
  derived and/or modified sequence opt3 from neuraminidase__InfluenzaA__AEY69953

SEQ ID NO: 143673 - RNA, 1410 nt, Artificial Sequence; identical to SEQ ID NO: 143671
  derived and/or modified sequence opt3 from neuraminidase__InfluenzaA__AEY69964

SEQ ID NO: 143674 - RNA, 1410 nt, Artificial Sequence; identical to SEQ ID NO: 143651
  derived and/or modified sequence opt3 from neuraminidase__InfluenzaA__AEY69975

SEQ ID NO: 143675 - RNA, 1410 nt, Artificial Sequence; identical to SEQ ID NO: 143651
  derived and/or modified sequence opt3 from neuraminidase__InfluenzaA__AEY69986

SEQ ID NO: 143676 - RNA, 1410 nt, Artificial Sequence; identical to SEQ ID NO: 143651
  derived and/or modified sequence opt3 from neuraminidase__InfluenzaA__AEY69997

SEQ ID NO: 143677 - RNA, 1410 nt, Artificial Sequence; identical to SEQ ID NO: 143651
  derived and/or modified sequence opt3 from neuraminidase__InfluenzaA__AEY70008

SEQ ID NO: 143678 - RNA, 1410 nt, Artificial Sequence; identical to SEQ ID NO: 143651
  derived and/or modified sequence opt3 from neuraminidase__InfluenzaA__AEY70019

SEQ ID NO: 143679 - RNA, 1410 nt, Artificial Sequence; identical to SEQ ID NO: 143651
  derived and/or modified sequence opt3 from neuraminidase__InfluenzaA__AEY70259

SEQ ID NO: 143680 - RNA, 1410 nt, Artificial Sequence; identical to SEQ ID NO: 143651
  derived and/or modified sequence opt3 from neuraminidase__InfluenzaA__AEY70270

SEQ ID NO: 143681 - RNA, 1410 nt, Artificial Sequence; identical to SEQ ID NO: 143651
  derived and/or modified sequence opt3 from neuraminidase__InfluenzaA__AEY70281

SEQ ID NO: 143682 - RNA, 1410 nt, Artificial Sequence; identical to SEQ ID NO: 138615
  derived and/or modified sequence opt3 from neuraminidase__InfluenzaA__AEY70303

SEQ ID NO: 143683 - RNA, 1410 nt, Artificial Sequence; identical to SEQ ID NO: 138615
  derived and/or modified sequence opt3 from neuraminidase__InfluenzaA__AEY70314

SEQ ID NO: 143684 - RNA, 1410 nt, Artificial Sequence
  derived and/or modified sequence opt3 from neuraminidase__InfluenzaA__AEY70325
augaaccccaaucagaagaucauuaccauaggcagcgugucccugacaaucucuacuauuugcuucuuuaugcagaucgccauucucaugacgaccgucacacuucacuucaaacaguacgaguuuaacccuccaccgaauaaccagguuaugcugugugaacccacuaucauagagagaaauaucaccgaaauuguguauuugacaaacaccacuaucgagaaggaaauuugcccuaaauuagcugaguacaggaauuggucaaagccacagugugacaucacaggguucgcacccuuuaguaaagauaacagcauacggcuguccgccggaggugacauuuggguaacccgcgagccuuaugugucuugcgauccagacaaguguuaccaauucgcgcuaggccaggggacgacucucaauaacguccauucgaauaacaccgugcgagaucguacacccuauagaacucugcuuaugaaugaacugggaguuccuuuucacuugggcaccaaacaggugugcaucgcuuggucaagcaguuccugucaugacgguaaggccuggcuccacgucugcauuacaggggaugacaagaacgcaaccgccucuuucaucuacaauggaaggcugguggauagcguaguuuccuggucaaaagagauccugcggacgcaggaaagugagugugugugcauuaacggcacuuguacagucgugaugaccgacggcagcgcuucugggaaggcagauacuaaaauacucuuuaucgaggaaggaaagauugugcauacauccaccuuaucagguagcgcccaacacgucgaggaaugcaguugcuauccacgcuacccgggcguuagaugugugugcagggacaacuggaaggggucuaaucggcccaucguagauauaaacauuaaagaccacuccaucgugagcucguacgucuguucuggacuggugggcgacacgccucgcaagaaugauuccucaaguagcucccauugccuugacccaaacaaugaggaaggugggcacggaguuaaaggcugggcuuucgaugacggcaacgauguguggauggggcgaaccaucucugaaaagagcagauugggauaugagacauuuaaagucauugaggguuggucaaaucccaagaguaaacugcagaucaacaggcaagugauuguagaccggggcaaucguuccggguacagcggaauauucucuguugagggcaagucauguaucaaccgcugcuuuuauguggaacuaauuagagguaggaaggaggaaacugagguccucuggaccaguaauagcaucguggucuucugugggacauccggcacuuacggaaccggcucuuggccugauggggccgacaucaaccugaugccaguguga

SEQ ID NO: 143685 - RNA, 1410 nt, Artificial Sequence
  derived and/or modified sequence opt3 from neuraminidase__InfluenzaA__AEY70336
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagauguauaugcagggacaacuggaagggguccaaucggccgauuguggauaucaacaucaaagaccacagcauuguaucgucuuacguguguuccggacuggucggcgacacgccccgcaagaaugauucaaguagcuccucucauugccuugacccuaacaaugaggaaggugggcacggagugaaaggcugggcuuucgaugacggcaacgauguuuggauggggcgaaccaucagcgagaagucaagauugggauaugagacauuuaaagugauugaagguuggaguaauccaaaguccaaacugcagauaaacaggcaggucaucguggaccggggcaaucguagcggguacucuggaauuuucucaguagaggauaagaguuguaucaaccgcugcuuuuauguugaacuaaucagaggcaggaaggaggaaacugaggugcucuggaccagcaauuccauugucguguucugugguacaucugggacuuacggcaccggaucguggcccgacggcgccgauauaaaccugaugccugucuga

SEQ ID NO: 143686 - RNA, 1410 nt, Artificial Sequence; identical to SEQ ID NO: 138754
  derived and/or modified sequence opt3 from neuraminidase__InfluenzaA__AEY70358

SEQ ID NO: 143687 - RNA, 1410 nt, Artificial Sequence; identical to SEQ ID NO: 138615
  derived and/or modified sequence opt3 from neuraminidase__InfluenzaA__AEY70379

SEQ ID NO: 143688 - RNA, 1410 nt, Artificial Sequence; identical to SEQ ID NO: 140377
  derived and/or modified sequence opt3 from neuraminidase__InfluenzaA__AFB70139

SEQ ID NO: 143689 - RNA, 1410 nt, Artificial Sequence; identical to SEQ ID NO: 138754
  derived and/or modified sequence opt3 from neuraminidase__InfluenzaA__AFB70141

SEQ ID NO: 143690 - RNA, 1410 nt, Artificial Sequence; identical to SEQ ID NO: 140377
  derived and/or modified sequence opt3 from neuraminidase__InfluenzaA__AFB70147

SEQ ID NO: 143691 - RNA, 1410 nt, Artificial Sequence; identical to SEQ ID NO: 138754
  derived and/or modified sequence opt3 from neuraminidase__InfluenzaA__AFB70153

SEQ ID NO: 143692 - RNA, 1410 nt, Artificial Sequence; identical to SEQ ID NO: 138754
  derived and/or modified sequence opt3 from neuraminidase__InfluenzaA__AFB70155

SEQ ID NO: 143693 - RNA, 1410 nt, Artificial Sequence; identical to SEQ ID NO: 139724
  derived and/or modified sequence opt3 from neuraminidase__InfluenzaA__AFB70157

SEQ ID NO: 143694 - RNA, 1410 nt, Artificial Sequence; identical to SEQ ID NO: 138754
  derived and/or modified sequence opt3 from neuraminidase__InfluenzaA__AFB70159

SEQ ID NO: 143695 - RNA, 1410 nt, Artificial Sequence
  derived and/or modified sequence opt3 from neuraminidase__InfluenzaA__AFB70161
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccacuaagcaagacauagucggcaucaaugaauggucuggguacucggggagcuucgugcagcaucccgagcugacaggucuggauuguauucgaccuugcuucuggguugaacucaucagaggcaggccaaaagagaacaccauuuggacuuccgggucaaguaucucuuuuuguggagugaauagcgacacagucggcugguauuggcccgauggugcagaguuaccguucaccauagacaaguga

SEQ ID NO: 143696 - RNA, 1410 nt, Artificial Sequence
  derived and/or modified sequence opt3 from neuraminidase__InfluenzaA__AFB70163
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacgcaaucuggacauccgggucaaguauaucuuuuuguggagugaauagcgacaccgucggcugguccuggcccgauggugccgaguuaccguucacuaucgacaaguga

SEQ ID NO: 143697 - RNA, 1410 nt, Artificial Sequence
  derived and/or modified sequence opt3 from neuraminidase__InfluenzaA__AFB70169
augaaccccaaucagaagaucauuaccauaggcagcgugugcaugacaaucgggauggccaaccugauucuccaaaucggaaauauuaucuccauauggaucaaccacucuauucagcuugguaaucagaaccagaucgagacuuguaaucaaucagucauuacguacgaaaacaauaccuggguuaaccagacauaugugaauaucaguaacacuaauuucgcugcaggccagagcguaguguccgucaaacuggccgggaacucuucguugugcccugugucaggaugggcgauauacagcaaggacaauaguauuagaaucggcuccaaaggugauguuuuugugauuagggagccauucaucucuuguagcccguuagaaugccggaccuuuuuccugacacagggggcucuacucaacgacaagcauuccaacggaaccaucaaagaucgcucacccuaucgaacucugaugaguuguccuauuggcgaggucccaagccccuacaauucucguuuugaauccguggccuggucagcaagcgccugccacgacggcauaaacuggcuuacaaucgggauuaguggaccugauaauggugcuguagcaguucugaaguauaacggcaucauaaccgacacgauuaagucuuggagaaauaacaucuugaggacucaagaguccgagugugccugcgugaaugggagcuguuucaccgucaugacagauggaccaucggacggccaggcuucuuacaaaaucuuucggauugaaaaggguaaaaucgugaaguccguggagaugaacgcccccaauuaucauuacgaagagugcucauguuacccugauaguagcgagauuacuugcgucugccgcgacaacuggcacggguccaauagaccauggguuucuuucaaccagaaucucgaauaucagauaggauacaucuguagcggcauuuuuggcgauaacccgaggcccaaugacaaaaccgggucaugcggaccugugaguuccaacggugcgaacggcguaaagggguucagcuuuaaguauggaaauggcguguggaucggucggacaaaaucuaucucaagucgcaacggguucgagaugauuugggauccaaauggcuggaccggaacggacaacaauuuuagcauaaagcaagacaucgucggcauuaacgaaugguccggguacucuggaucguucgugcagcaucccgagcugacuggucuggauuguauccgaccuugcuucuggguugaacucauuagaggcaggccaaaagagaauacaaucuggaccagcggguccucaauaaguuuuuguggagugaacucugacacugucggcuggagcuggcccgauggugcagaguuaccguucacaaucgacaaguga

SEQ ID NO: 143698 - RNA, 1410 nt, Artificial Sequence; identical to SEQ ID NO: 138754
  derived and/or modified sequence opt3 from neuraminidase__InfluenzaA__AFB70199

SEQ ID NO: 143699 - RNA, 1410 nt, Artificial Sequence; identical to SEQ ID NO: 138754
  derived and/or modified sequence opt3 from neuraminidase__InfluenzaA__AFB70209

SEQ ID NO: 143700 - RNA, 1410 nt, Artificial Sequence; identical to SEQ ID NO: 138754
  derived and/or modified sequence opt3 from neuraminidase__InfluenzaA__AFB70219

SEQ ID NO: 143701 - RNA, 1410 nt, Artificial Sequence; identical to SEQ ID NO: 138754
  derived and/or modified sequence opt3 from neuraminidase__InfluenzaA__AFB70229

SEQ ID NO: 143702 - RNA, 1410 nt, Artificial Sequence; identical to SEQ ID NO: 138754
  derived and/or modified sequence opt3 from neuraminidase__InfluenzaA__AFB70239

SEQ ID NO: 143703 - RNA, 1410 nt, Artificial Sequence; identical to SEQ ID NO: 138754
  derived and/or modified sequence opt3 from neuraminidase__InfluenzaA__AFB70249

SEQ ID NO: 143704 - RNA, 1410 nt, Artificial Sequence; identical to SEQ ID NO: 138754
  derived and/or modified sequence opt3 from neuraminidase__InfluenzaA__AFB70259

SEQ ID NO: 143705 - RNA, 1410 nt, Artificial Sequence; identical to SEQ ID NO: 139724
  derived and/or modified sequence opt3 from neuraminidase__InfluenzaA__AFB70269

SEQ ID NO: 143706 - RNA, 1410 nt, Artificial Sequence; identical to SEQ ID NO: 138754
  derived and/or modified sequence opt3 from neuraminidase__InfluenzaA__AFB70279

SEQ ID NO: 143707 - RNA, 1410 nt, Artificial Sequence; identical to SEQ ID NO: 138754
  derived and/or modified sequence opt3 from neuraminidase__InfluenzaA__AFB70289

SEQ ID NO: 143708 - RNA, 1410 nt, Artificial Sequence; identical to SEQ ID NO: 138754
  derived and/or modified sequence opt3 from neuraminidase__InfluenzaA__AFB70299

SEQ ID NO: 143709 - RNA, 1410 nt, Artificial Sequence; identical to SEQ ID NO: 138754
  derived and/or modified sequence opt3 from neuraminidase__InfluenzaA__AFB70309

SEQ ID NO: 143710 - RNA, 1410 nt, Artificial Sequence; identical to SEQ ID NO: 140377
  derived and/or modified sequence opt3 from neuraminidase__InfluenzaA__AFB70319

SEQ ID NO: 143711 - RNA, 1410 nt, Artificial Sequence; identical to SEQ ID NO: 138754
  derived and/or modified sequence opt3 from neuraminidase__InfluenzaA__AFB70329

SEQ ID NO: 143712 - RNA, 1410 nt, Artificial Sequence; identical to SEQ ID NO: 138754
  derived and/or modified sequence opt3 from neuraminidase__InfluenzaA__AFB70349

SEQ ID NO: 143713 - RNA, 1410 nt, Artificial Sequence; identical to SEQ ID NO: 138754
  derived and/or modified sequence opt3 from neuraminidase__InfluenzaA__AFB70359

SEQ ID NO: 143714 - RNA, 1410 nt, Artificial Sequence; identical to SEQ ID NO: 138754
  derived and/or modified sequence opt3 from neuraminidase__InfluenzaA__AFB70369

SEQ ID NO: 143715 - RNA, 1410 nt, Artificial Sequence; identical to SEQ ID NO: 138754
  derived and/or modified sequence opt3 from neuraminidase__InfluenzaA__AFB70379

SEQ ID NO: 143716 - RNA, 1410 nt, Artificial Sequence; identical to SEQ ID NO: 138754
  derived and/or modified sequence opt3 from neuraminidase__InfluenzaA__AFB70389

SEQ ID NO: 143717 - RNA, 1410 nt, Artificial Sequence; identical to SEQ ID NO: 138754
  derived and/or modified sequence opt3 from neuraminidase__InfluenzaA__AFB70399

SEQ ID NO: 143718 - RNA, 1410 nt, Artificial Sequence; identical to SEQ ID NO: 138754
  derived and/or modified sequence opt3 from neuraminidase__InfluenzaA__AFB70409

SEQ ID NO: 143719 - RNA, 1410 nt, Artificial Sequence
  derived and/or modified sequence opt3 from neuraminidase__InfluenzaA__AFB77614
augcaccccaaccaggaggugaucagcauugucuccguuugcaugaccauaggcauggccaaucugauccuccaaauugggaacaucauuucuaucuggauaucacauaguauccagcuuggaaaucagaaccagauugaaacauguaaucaaagcgugaucacuuacgagaacaauacguggguaaaccagaccuaugugaauauuuccaacacaaauuucgcugcaggucagucugucgugucgguuaagcuggccggcaacagcagcuugugcccugugagugggugggcgaucuacuccaaagacaauucuauaagaauuggaagcaagggcgaugucuuugugaucagggaaccauucauuuccuguucaccguuagagugccggaccuuuuuccugacucagggugcucuacucaacgacaaacacaguaaugggacaaucaaggaucgcagccccuaucgaacccugaugucuuguccuaucggagaaguaccaucccccuacaacucacguuuugagagcguugccuggagugcaucugccugccaugacggcauuaacuggcuuacuauaggcaucuccgggccugauaauggagcuguggcaguccugaaauauaacgguauuaucacagacaccauaaagagcuggagaaauaacauuuugaggacgcaagagucggaaugugccugcgugaauggcucuuguuucacuaucaugaccgaugggccauccgacggacaggcuucauacaagaucuuucggauugagaaaggcaagaucgugaaaagugucgaaaugaacgcccccaauuaucacuacgaggagugcagcuguuacccugauuccucugaaauuacaugcguuugccgcgacaacuggcaugguagcaauagaccaugggugucauucaaccagaaucucgaguaucagauaggguacaucuguaguggaauuuuuggcgauaacccgaggcccaaugacaagacuggcuccugcgggccuguaagcucuaacggagcgaauggugugaaaggcuucucauuuaaguaugggaacggagucuggaucggccggaccaagaguaucagcucccgcaaagguuucgaaaugauuugggauccaaacggguggacaggcaccgacaauaacuuuucuauaaagcaagacaucgugggaauuaaugaguggucgggcuacagcggguccuucguucagcaccccgaacugacgggacuggauuguauccgaccuugcuucuggguggagcucauuagagguaggccaaaagagaacacuaucuggacaucaggcaguucuauaucauuuuguggggucaauuccgacaccgugggaugguucuggcccgauggcgcagaauuaccguuuacuaucgacaaguga

SEQ ID NO: 143720 - RNA, 1410 nt, Artificial Sequence
  derived and/or modified sequence opt3 from neuraminidase__InfluenzaA__AFB77615
augcaccccaaccaggagaucauuaccuucgugagcgucugcaugacaauaggcauggccaaucugauccuccaaauugggaacaucauuuccaucuggauaucucauucaauccagcuuggaaaucagaaccagauugaaacuuguaaucaaaguguuaucacguacgagaacaauaccugggugaaccagacauauguaaauauuagcaacacuaauuuugcugcaggucaguccguggucucugugaagcuggccggcaacucgucauugugcccuguuagcgggugggcgaucuacaguaaagacaauuccauaagaauuggaucuaagggcgauguguucgucaucagggaaccauuuauuagcuguuccccguuagagugccggaccuucuuucugacacagggugcucuacucaacgacaaacacucaaaugggaccaucaaggaucgcagucccuaucgaacucugaugagcuguccuaucggagaagugccaucucccuacaacucccguuucgagucaguagccuggagcgcaagugccugccaugacggcauuaacuggcuuacaauaggcaucucugggccugauaauggagcuguugcagugcugaaauauaacgguauuaucaccgacacgauaaaguccuggagaaauaacauuuugaggacucaagagagcgaaugugccugcgucaauggcucguguuuuaccaucaugacagaugggccaucugacggacaggcuuccuacaagaucuuccggauugagaaaggcaagaucgugaaaucaguggaaaugaacgcccccaauuaucacuacgaggagugcaguuguuacccugauagcuccgaaauuacuugcgucugccgcgacaacuggcaugguucuaauagaccauggguuagcuuuaaccagaaucucgaguaucagauaggguacaucuguucaggaauuuucggcgauaacccgaggcccaaugacaagaccggcaguugcgggccuguguccagcaacggagcgaaugguguaaaaggcuuuucuuucaaguaugggaacggaguguggaucggccggacaaagucaaucaguagccgcaaagguuuugaaaugauuugggauccaaacggguggaccggcacggacaauaacuucuccauaaagcaagacaucgucggaauuaaugaguggucuggcuacucggggagcuucgugcagcaccccgaacugacuggacuggauuguauccgaccuugcuuuuggguugagcucauuagagguaggccaaaagagaacacaaucuggaccuccggcucaaguauaucuuucuguggggugaauagcgacacugucggaugguccuggcccgauggcgcagaauuaccguuuacaaucgacaaguga

SEQ ID NO: 143721 - RNA, 1410 nt, Artificial Sequence
  derived and/or modified sequence opt3 from neuraminidase__InfluenzaA__AFB78128
augaaccccaaucagaagaucauuaccauaggcagcgugucccugacaaucgccacuauuugcuuccucaugcaaaucgucauucuuguuacgaccgugacacugcacuuuaaacagcaugaguguaacucuccuccaaauaaccagguaauguugugcgaaccgacuaucauagagagaaauaucaccgaaauuguguacuuaacaaacaccacuaucgagaaggaaauuugucccaaacuggcugaguauaggaauuggucaaagccucagugcaaaaucacaggguucgcaccauuuaguaaggacaacagcauacggcuauccgccggaggugauauuugggucacccgcgagcccuacgugucuugugacccugauaagugcuaucaauucgcgcucggccaggggacgacucugaauaaccgacacucgaaugacaccguucaugaucguacaccauacagaacucuucugaugaacgaauugggagugcccuuucaccucggcaccaaacaggucuguaucgcuuggucaagcaguuccugccaugacgguaaggccuggcugcacguguguguaacagggcacgaugagaaugcaaccgccucuuucauuuaugacggaaggcugguugauagcaucggcuccuggaguaaaaagauccuccggacgcaggaaucagagugcguguguauuaacggcacuugcacagucgugaugaccgacgggagcgcuucuggacgcgcagauacuaaaauauuauuuaucgaggaagguaagauugugcauacauccaagcugucaggcagcgcccaacacgucgaggaaugcaguuguuacccuagauauccagggguuaggugcgugugucgggacaauuggaaaggaucuaaccgcccgaucguagauauaaacgugaaggacuacuccauugucagcucguacgugugcucuggccuuguuggugacacccccagaaagaaugauuccucaaguagcucccauuguuuggacccuaacaaugaggaagggggacacggcgugaaaggcugggcuuucgaugacgggaacgaugucuggaugggacgaacgaucucugagaaaagcaggucagguuaugagaccuuuaaggugaucgaaggcuggaguaaaccaaauuccaagcugcagauuaaccggcagguaaucguugagcgugggaauaugagcggauacucuggcauuuucucaguggaagguaagaguugcauaaaccgcuguuuuuaugucgagcuaaucagagggaggaaacaggaaacagaggugugguggacuagcaauuccauugucguguucugcggcaccucuggaacauacggcacugggucguggcccgacggagccgauaucaaccucaugccuaucuga

SEQ ID NO: 143722 - RNA, 1410 nt, Artificial Sequence
  derived and/or modified sequence opt3 from neuraminidase__InfluenzaA__AFC62078
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggaguuauucaucuccuguucaccacuggaaugccggaccuuuuuccuaacacagggggcucuccugaacgacaagcauaguaauggaaccaucaaagaucgcagcccguaucgaacucuuaugucuugucccauuggcgaggucccuuccccauacaacucacguuuugaaagcguggccuggagugcaucugccugccacgacggcauaaacuggcugacaaucgggauuuccggacccgauaauggugcuguagcaguuuugaaguauaacggcaucauaaccgacacgauuaagagcuggagaaaugauauccucaggacucaagagucggagugugccugcgugaacgggucuuguuucaccaucaugacagacggaccuuccgauggccaggcuucauacaaaauuuuucggaucgaaaaggguaaaauugucaagaguguggagaugaaugccccaaacuaucauuacgaagagugcagcuguuaccccgacuccucugagauaacuugcgugugccgcgauaauuggcacgggagcaacagaccuugggucucauucaaucagaaccuggaauaucagaucggauacauuuguaguggcaucuuuggcgacaauccaaggccgaacgauaaaaccggguccugcggacccguuagcucuaauggugcgaacggcgugaagggguucucauuuaaguauggaaauggcguauggaucggucggacaaaaaguauuagcucccgcaagggguucgagaugauaugggacccuaacggcuggaccggaacggacaacaauuuuucuaucaaacaagauauugugggcaucaacgaauggucgggguacagcggauccuucguccagcauccagagcugacugguauggacuguauucgacccugcuucuggguggaacucaucagaggcaggccuaaggagaauacaauauggaccucagggaguucuaucagcuuuuguggaguuaacuccgauacugugggcuggucauggccagacggugcagaguuacccuucacaauugauaaauga

SEQ ID NO: 143723 - RNA, 1410 nt, Artificial Sequence
  derived and/or modified sequence opt3 from neuraminidase__InfluenzaA__AFC62079
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucauuaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcauccugggcgauaauccgaggcccaacgacaaaaccgggaguugcggaccuguuuccagcaauggugcgaacggcgugaagggguuuucuuucaaguauggaaacggcguaugggugggucggacaaaaucaaucaguagccgcaauggguuugagaugauuugggauccaaacggcuggaccggaacggacaauaacuucuccauaaagcaagacaucgucggcauuaaagaauggucuggguacucggggagcuuugugcagcaucccgagcugacuggucucgauuguauccgaccuugcuucuggguugaauuaauuagaggcaggccaaaggagaauacaaucuggaccuccgggucaauaaucaguuucuguggagugaacucugacacugucggcuggagcuggcccgauggugcagagcugccguuuacaauugacaaauga

SEQ ID NO: 143724 - RNA, 1410 nt, Artificial Sequence
  derived and/or modified sequence opt3 from neuraminidase__InfluenzaA__AFC62080
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuauuacuacgaagagugcagcuguuauccugauuccucugagauaacuugcgugugccgcgacaacuggcaugggagcaauagaccaugggucucauucaaccagaaucucgaauaccagaucggauauauuuguaguggcaucuuuggcgauaacccgaggcccaaugacaaaaccggguccugcggaccuguuagcucuaacggugcgaauggcgugaagggguucucauuuaaguacggaaacggcguauggaucggucggacaaaaaguauuagcucccgcaagggguucgagaugauaugggauccaaacggcuggaccggaacggacaauaacuuuucuaucaaacaagacauugugggcaucaaugaauggucgggguauagcggauccuucguccagcaccccgagcugacugguaugggcuguauucgaccuugcuucuggguggaacugaucagagggaggccaaaggagaacacaauauggaccucaggaaguucuaucagcuuuuguggcguuaauuccgauacuguggguuggucauggcccgacggggcagagcucccguucacaauugauaaauga

SEQ ID NO: 143725 - RNA, 1410 nt, Artificial Sequence
  derived and/or modified sequence opt3 from neuraminidase__InfluenzaA__AFC62082
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgaggacguacaccauauagaacucugcuuaugaacgaacugggcguucccuuucacuuggguaccaaacaggugugcauugcuuggagcaguuccucuugucaugacgggaaggccuggcuccacgucugcaucacaggagaugacaagaaugcaaccgccagcuucaucuacaacggcaggcugguggauuccguaguuucauggaguaaagagauucugcggacgcaggaaagcgagugugugugcauaaacggcacuuguacagucgugaugaccgacgggucugcuuccggaaaggcagauacuaaaauccucuuuauugaggaagguaagaucgugcauacaucaaccuuaagcggcagugcccaacacgucgaggaaugcucuugcuauccucgcuacccagggguuagaugugugugcagggacaauuggaagggauccaaccggccgauaguagauauuaauaugaaagaccacagcaucgugucgucuuacgucuguuccggccuggugggugauacgccccgcaagaacgacucaaguagcuccucucauugcuucgacccuaaugaugaggaagggggacacggcguuaaaggcugggcuuuugacgaugggaacgacguguggaugggacgaaccaucagcgagaagucaagacuugguuaugagacauucaaagucauugaaggcuggaguaauccaaaguccaaauugcagaucaacaggcaagugauuguagaucguggggaccggagcggauacucuggcauauuuucaguugaggguaagaguuguaucaaucgcugcuucuauguggaacugauuagagggagcaaggaggaaacugagguccuauggaccuccaacucuaucguggucuucuguggcacaucgggaacuuacggcaccgggagcuggcccgauggagccgacaucaaucucaugccuauuuga

SEQ ID NO: 143726 - RNA, 1410 nt, Artificial Sequence; identical to SEQ ID NO: 136241
  derived and/or modified sequence opt3 from neuraminidase__InfluenzaA__AFD63529

SEQ ID NO: 143727 - RNA, 1410 nt, Artificial Sequence; identical to SEQ ID NO: 136241
  derived and/or modified sequence opt3 from neuraminidase__InfluenzaA__AFD63540

SEQ ID NO: 143728 - RNA, 1410 nt, Artificial Sequence
  derived and/or modified sequence opt3 from neuraminidase__InfluenzaA__AFD63551
augaaccccaaucagaagaucauuaccauaggcagcgugucccugacaaucgccgcuauuugcuuccucaugcagaucgcaauucuugucacuacgguuacccugcacuuuaaacagcaugaguguaacccuccaccgaauaaccaggugauguugugcgaacccacaaucauagagagaaauaucacugaaauuguauacuuaaccaacacaaccaucgagaaggaaauuuguccuaaacuggccgaguauaggaauuggucuaagccacagugcaacaucacuggguucgcgcccuuuucaaaagacaauaguauacggcuaagcgcuggaggugauauuugggugacacgcgagccuuacgucuccugugacccagauaagugcuaucaauucgcccucggccaggggaccacgcugaacaauggacacucuaacgacacugugcauggccgaacccccuaccguacacuucugaugaaugaauuggguguuccuuuucaccucgggacuagacagguguguaucgcauggucgucaagcaguugccaugauggaaaggccuggcugcacgucugugugaccggcgacgauaaaaacgcuacagcauccuucauuuauaauggcaggcugguagacucuaucgggagcugguccaagaaaauccuccggacccaggagucagaaugcguuuguauuaacggaacgugcacuguggucaugacagaugguagugccagcggcaaggcugacaccaaaauauuauuuaucgaggaggggaagauugugcacaucucuacucuguccggaucagcccaacauguggaagagugcagcuguuacccacgcuauccgggcgucagaugcguuuguagggauaacuggaaggguaguaaucggcccauaguggacauuaacguaaaagauuacucuaucguguccagcuacgucugcucggggcuugugggagacacaccucgcaagaaugacucuuucuccucaagucacuguuuggauccaaacaaugaagagggcggccaugggguuaaaggaugggcguuugacgaugguaacgacguguggaugggccgaaccaucagcgaaaagcugagauccggguaugagacguucaaagucauugagggauggucuaagcccaauagcaaacuacagaucaacaggcaagugauuguagaacggggcaaucguucagguuacagugggauauuuuccguugagggcaagagcugcaucaaccgcuguuucuauguggaacucauuagaggaaggaaggaggaaaccgaggucugguggacaucuaauucaaucguggucuuuugcggcaccagugggacuuacggaacagguagcuggccugauggcgcagacaucaaccugaugccaauuuga

SEQ ID NO: 143729 - RNA, 1410 nt, Artificial Sequence; identical to SEQ ID NO: 136241
  derived and/or modified sequence opt3 from neuraminidase__InfluenzaA__AFD63562

SEQ ID NO: 143730 - RNA, 1410 nt, Artificial Sequence
  derived and/or modified sequence opt3 from neuraminidase__InfluenzaA__AFD63573
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagggagaaauaucaccgagauuguauacuuaacaaacaccacuaucgaaaaggagauuugucccaaacuggcagaauauaggaauuggucaaagccucagugcaacaucacaggauucgccccauuuaguaaagacaauagcauacggcuauccgcggguggcgauauuugggugacccgcgagcccuacgucucuugugacccugauaagugcuaucaauucgcucucgggcagggaacgacucugaacaauggccacucgaacgacaccgugcaugaucgaacaccauaccguacucuucugaugaaugaguuggguguucccuuucaccucgggaccagacagguguguaucgccuggucaagcaguuccugccaugacggaaaggcauggcugcacgucugugugacaggcgaugacaaaaacgccaccgcuucuuucauuuauaauggcaggcugguagauagcaucggguccuggucaaagaaaauccuccggacgcaggaaagugagugcguuuguauuaacggaacuugcacaguggucaugaccgacgguagcgcaucuggcaaggccgauacuaaaauauuauuuaucgaagaggggaagauugugcacaucuccacacugucaggaagcgcucaacauguggaggaaugcaguuguuacccucgcuauccaggcgucagaugcguuuguagggacaacuggaaggguucuaaucggccgauaguggauauuaacguaaaagacuacuccaucgugagcucguacgucugcucugggcuugugggagacacccccaggaagaaugauuccuucucaaguagccacuguuuggacccuaacaaugaggaaggcggccaugggguuaaaggaugggccuuugaugacgguaacgauguguggaugggccgaacgaucuccgagaagcugagaucuggguaugaaaccuucaaagucauugagggauggagcaagccaaauucaaaacuacagaucaaccgccaggugauuguagagcggggcaaucguagugguuacuccgggauauuuagcguugaaggcaagucuugcaucaaccgcuguuucuauguggagcucauuagaggaaggaaggaagagacagaagucugguggacuucaaauaguaucguggucuuuugcggcaccagcgggacauacggaacugguuccuggcccgacggcgcggauaucaaccugaugccuauuuga

SEQ ID NO: 143731 - RNA, 1410 nt, Artificial Sequence
  derived and/or modified sequence opt3 from neuraminidase__InfluenzaA__AFD63584
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaacgaacaccauaucguacucuucugaugaaugaguugggcguucccuuucaucucgguaccagacagguguguaucgccuggucaagcaguuccugccacgaugggaaggcauggcugcaugucugugugacaggagacgauaaaaacgccaccgcuucuuucauuuacaauggcaggcugguagacagcaucggcuccuggucaaagaaaauccuccggacgcaggaaagugagugcguuuguauuaacgggacuugcacaguggucaugaccgauggaagcgcaucugguaaggccgacacuaaaauauuauuuaucgaggaaggcaagauuauccacauauccacacugucagggagcgcucaacacguggaggaaugcaguuguuauccucgcuacccaggagugagaugcgucuguagggauaacuggaagggcucuaaucggccgauuguugacaucaacgugaaagauuacuccaucguaagcucguaugugugcucuggucuugucggggacacuccccgcaagaaugacuccucaaguagcucccauuguuuggauccuaacaaugaggaaggaggccacggcgugaaagggugggccuucgacgauggaaacgacguuuggaugggucgaacgauuucugagaagcugagaagcggcuacgagaccuuuaaagugaucgaaggguggucaaagccaaauaguaaacuacagauuaacaggcaggucauaguggagcggggaaaucguuccggcuauagcgguaucuucucuguagaagggaagucaugcauuaaccgcuguuuuuacguugagcucaucagaggcaggaaggaagagacagaggugugguggaccaguaauagcaucgucguguucugcggaaccuccggcacauaugggacuggaucuuggcccgauggugcggacauuaaccugaugccuauauga

SEQ ID NO: 143732 - RNA, 1410 nt, Artificial Sequence
  derived and/or modified sequence opt3 from neuraminidase__InfluenzaA__AFD63595
augaaccccaaucagaagaucauuaccauaggcagcgugucccugacaaucgccgcuauuugcuuccucaugcaaaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugcacaucuccacucugucagggagcgcccaacauguggaagagugcaguuguuacccucgcuauccaggagucagaugcguuuguaaggacaacuggaaaggcucuaauaggccgauaguggauauuaacguaaaggacuacuccaucgugagcucguacgucugcucuggucuugugggggacacaccccggaaaaaugauuccuucucaaguagccacuguuuggacccuaacaaugaagagggaggccauggcguuaaggggugggcguuugaugacggaaacgauguguggaugggucgcaccaucuccgaaaaacugcgaucuggcuaugagacguucaaggucauugagggguggagcaaaccaaauucaaagcuacagaucaacagacaggugauuguagaaaggggaaaucggaguggcuacuccgguauauuuagcguugaggggaagucuugcaucaaccguuguuucuauguggaacucauucgcggcagaaaagaggaaaccgaggucugguggacaucaaauaguaucguggucuuuugcggaacuagcggcaccuacgggacaggauccuggcccgacggugcagauaucaaccugaugccuauuuga

SEQ ID NO: 143733 - RNA, 1410 nt, Artificial Sequence; identical to SEQ ID NO: 136241
  derived and/or modified sequence opt3 from neuraminidase__InfluenzaA__AFD63606

SEQ ID NO: 143734 - RNA, 1410 nt, Artificial Sequence; identical to SEQ ID NO: 136161
  derived and/or modified sequence opt3 from neuraminidase__InfluenzaA__AFD63628

SEQ ID NO: 143735 - RNA, 1410 nt, Artificial Sequence; identical to SEQ ID NO: 136241
  derived and/or modified sequence opt3 from neuraminidase__InfluenzaA__AFD63639

SEQ ID NO: 143736 - RNA, 1410 nt, Artificial Sequence; identical to SEQ ID NO: 136241
  derived and/or modified sequence opt3 from neuraminidase__InfluenzaA__AFD63650

SEQ ID NO: 143737 - RNA, 1410 nt, Artificial Sequence
  derived and/or modified sequence opt3 from neuraminidase__InfluenzaA__AFD63661
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacucaacaaucgagaaggaaauuugucccaaacuggccgaguauaggaauuggaguaagccucagugcaacaucaccggguucgcgccauuuagcaaagacaauuccauacggcuaucugcuggaggugauauuugggugacucgcgagcccuacgucucgugugacccugauaagugcuaucaauucgcccucggccaggggacaacccugaacaauggacacucaaacgacacggugcaugaucgaacuccauaccguacccuucugaugaaugaauugggcguucccuuucaccucgguacaagacagguguguaucgcauggagcaguuccucuugccaugacgggaaggccuggcugcacgucugugugacuggagaugacaaaaacgcuaccgccagcuucauuuauaauggcaggcugguagauuccaucggcucauggaguaagaaaauccuccggacacaggagagcgaaugcguuuguauuaacgggaccugcacgguggucaugacugacggaucugcauccgguaaggcugauacaaaaauauuauuuaucgaggagggcaagauugugcacaucucaacccugagcgggagugcccaacauguggaagagugcucuuguuacccucgcuauccaggagucagaugcguuuguagggacaacuggaagggcuccaaucggccgauaguggauauuaacguaaaagacuacagcaucgugucgucuuacgucugcuccggucuugugggggacacuccccgcaagaaugauucauucaguagcucccacuguuuggacccuaacaaugaagagggaggccauggcguuaaagggugggcguuugaugacggaaacgauguguggaugggucgaacaaucucugaaaagcugagaagcggcuaugagaccuucaaagucauugagggguggucaaagccaaauaguaaacuacagaucaacaggcaagugauuguagaacggggaaaucguuccggcuacagcgguauauuuucuguugaggggaagucaugcaucaaccgcuguuucuauguggaacucauuagaggcaggaaggaggaaacggaggucugguggaccaguaauagcaucguggucuuuugcggaacauccggcacuuacgggaccggaucuuggcccgacggugcagauaucaaccugaugccuauuuga

SEQ ID NO: 143738 - RNA, 1410 nt, Artificial Sequence; identical to SEQ ID NO: 137947
  derived and/or modified sequence opt3 from neuraminidase__InfluenzaA__AFD63672

SEQ ID NO: 143739 - RNA, 1410 nt, Artificial Sequence
  derived and/or modified sequence opt3 from neuraminidase__InfluenzaA__AFD63683
augaaccccaaucagaagaucauuaccaugggcagcgugucccugacaauagccacuaucugcuuccucaugcaaauugcuauccuugucacgaccguuacacugcacuuuaaacaguacgaguguaacucuccuccaaauaaccaggugauguugugcgaaccgacuauuaucgagagaaauauaaccgaaaucguauauuuaacaaacaccacuauugagaaggaaaucugucccaaacuggcagaguacaggaauuggucaaagccucagugcaacauuacaggguucgccccauuuaguaaagacaauagcauccggcuauccgcgggaggugauauaugggugacccgcgagcccuaugucucuugugacccugauaagugcuaccaauucgcucucggccaggggacgacucugaacaauggacauucgaacgacaccgugcacggccgaacaccauaucguacucuucugaugaaugaauuggguguucccuuucaucucgggaccagacagguguguauugccuggucaagcaguuccugccacgauggaaaggcauggcugcaugucugugugacaggcgacgauaaaaacgccaccgcuucuuucaucuacaauggcaggcugguagacagcauuggguccuggucaaagaaaauccuccggacgcaggagagugaaugcguuuguaucaacggaacuugcacaguggucaugaccgaugguagcgcaucuggcaaggccgacacuaaaauuuuauuuauagaggaggggaagaucauucacaucuccacacugucaggaagcgcucaacacguggaagagugcaguuguuauccucgcuacccaggcgugagaugcgucuguagggauaacuggaaggguucuaaucggccgauaguugacauuaacgugaaagauuacuccaucguaagcucguaugugugcucugggcuugucggagacacuccccgcaagaaugacuccucaaguagcucccauuguuuggauccuaacaaugaagagggcggccacggggugaaaggaugggccuucgacgaugguaacgacguuuggaugggccgaacgaucucugaaaagcugagaagcggguacgagaccuuuaaagugauugagggauggucaaagccaaauaguaaacuacagaucaacaggcaggucauuguggaacggggcaaucguuccgguuauagcgggauauucucuguagagggcaagucaugcaucaaccgcuguuuuuacguugaacucauuagaggaaggaaggaggaaacagaggugugguggaccaguaauagcaucgucguguucugcggcaccuccgggacauauggaacugguucuuggcccgauggcgcggacaucaaccugaugccuauuuga

SEQ ID NO: 143740 - RNA, 1410 nt, Artificial Sequence
  derived and/or modified sequence opt3 from neuraminidase__InfluenzaA__AFD63694
augaaccccaaucagaagaucauuaccauaggcagcgugucccugacaaucgccacuauuugcuuccucaugcaaaucgcuauucuugucacgaccaucacacugcacuuuaaacagcaugaguguaacucuccuccaaauaaccagguuauguugugcgaaccgacuauaaucgagagaaauauuaccgaaaucguguacuuaacaaacaccacuauugagaaggaaaucugucccaaacuggcagaguauaggaauuggucaaagccucagugcaacauaacaggguucgccccauuuaguaaagacaauagcauucggcuauccgcgggaggugauaucuggguaacccgcgagcccuacgugucuugugacccugauaagugcuaucaauucgcucucggccaggggacgacucugaacaauggacacucgaacgacaccguccaugaucgaacaccauaccguacucuucugaugaaugaauugggcgugcccuuucaccucgguaccagacagguuuguauugccuggucaagcaguuccugccaugacgggaaggcauggcugcacgugugugucacaggagaugacaaaaacgccaccgcuucuuucaucuauaauggcaggcugguggauagcaucggcuccuggucaaagaaaauucuccggacgcaggagagugaaugcguauguauaaacgggacuugcacaguugugaugaccgacggaagcgcaucugguaaggccgauacuaaaaucuuauuuauugaggagggcaagaucguccacauauccacacugucagggagcgcucaacauguggaagagugcaguuguuacccucgcuauccaggagugagaugcgucuguagggacaacuggaagggcucuaaucggccgauuguugauaucaacgugaaagacuacuccaucguaagcucguacgugugcucuggucuugucggggacacgccccgcaagaaugauuccuucucaaguagccacuguuuggacccuaacaaugaagagggaggccauggcgugaaagggugggccuuugaugacggaaacgauguuuggaugggucgaaccauuuccgaaaagcugagaucuggcuaugagaccuucaaagugaucgagggguggagcaagccaaauucaaaacuacagauuaacaggcaggucauaguggaacggggaaaucguaguggcuacuccgguaucuuuagcguagaggggaagucuugcauuaaccgcuguuucuauguugaacucaucagaggcaggaaggaggaaacagaggugugguggacuucaaauaguaucgucguguuuugcggaaccagcggcacauacgggacuggauccuggcccgacggugcggauauuaaccugaugccuauauga

SEQ ID NO: 143741 - RNA, 1410 nt, Artificial Sequence
  derived and/or modified sequence opt3 from neuraminidase__InfluenzaA__AFD63705
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggcaaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaagccuggcugcacgucugugugaccggagaugacaagaacgcuacagcaucuuucauuuauaauggcaggcugguagauagcaucggcuccuggaguaaaaagauccuccggacccaggagucagaaugcguuuguauuaacgggacgugcacuguggucaugacagacggaagcgccucugguaaagcugauaccaagauauuauuuaucgaggagggcaagauugugcacaucuccacucugucagggagcgcccagcauguggaagagugcaguuguuacccucgcuauccaggagucagaugcguuuguagggacaacuggaaaggcucuaaucggccgauaguggauauuaacguaaaggacuacuccaucgugagcucguacgucugcucuggucuugugggggacacaccccgcaaaaaugauuccuucucaaguagccacuguuuggacccuaacaaugaagagggaggccauggcguuaaggggugggcguuugaugacggaaacgauguguggaugggucgaaccaucuccgaaaaacugagaucuggcuaugagacguucaaggucauugagggguggagcaaaccaaauucaaagcuacaaaucaacaggcaagugauuguagaacggggaaaucguaguggcuacuccgguauauuuagcguugaggggaagucuugcaucaaccgcuguuucuauguggaacucauuagaggcaggaaagaggaaaccgaggucugguggacaucaaauaguaucguggucuuuugcggaacuagcggcaccuacgggacaggauccuggcccgacggugcagauaucaaccugaugccuauuuga

SEQ ID NO: 143742 - RNA, 1410 nt, Artificial Sequence
  derived and/or modified sequence opt3 from neuraminidase__InfluenzaA__AFD63716
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugccaccaauucgcccucggccaggggaccacgcugaacaauggacauucgaacgacacugugcacgaucgaaccccauaucguacacuucugaugaaugaauugggcguucccuuucaucucgguacuagacagguguguaucgcauggucaagcaguuccugccacgacgggaaggccuggcugcacgucugugugaccggagaugacaaaaacgcuacagcaucuuucauuuacaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugcauaucuccacucugucagggagcgcccaacacguggaagagugcaguuguuauccucgcuacccaggagucagaugcguuuguagggacaacuggaagggcucuaaucggccgauaguggauauuaacguaaaagacuauuccaucgugagcucguacgucugcucuggucuugugggggacacaccccgcaagaaugauuccuucucaaguagccauuguuuggacccuaacaaugaagagggaggccacggcguuaaagggugggcguuugaugacggaaacgauguguggaugggucgaaccaucuccgaaaagcugagaucuggcuacgagacguucaaagucauugagggguggagcaagccaaauucaaaacuacagaucaacaggcaagugauuguagaacggggaaaucguaguggcuauuccgguauauuuagcguugaggggaagucuugcaucaaccgcuguuucuacguggaacucauuagaggcaggaaggaggaaaccgaggucugguggacaucaaauaguaucguggucuuuugcggaacuagcggcaccuaugggacaggauccuggcccgacggugcagauaucaaccugaugccuauuuga

SEQ ID NO: 143743 - RNA, 1410 nt, Artificial Sequence; identical to SEQ ID NO: 136241
  derived and/or modified sequence opt3 from neuraminidase__InfluenzaA__AFD63727

SEQ ID NO: 143744 - RNA, 1410 nt, Artificial Sequence; identical to SEQ ID NO: 136241
  derived and/or modified sequence opt3 from neuraminidase__InfluenzaA__AFD63738

SEQ ID NO: 143745 - RNA, 1410 nt, Artificial Sequence
  derived and/or modified sequence opt3 from neuraminidase__InfluenzaA__AFD63749
augaaccccaaucagaagaucauuaccauaagcuccgugucucugacaaucgccacuauuugcuuccucaugcaaaucgcuauucuugucacgaccguuacacugcacuuuaaacagcaugaguguaacucaccuccaaauaaccaggugauguugugcgaaccgacuaucauagagagaaauaucaccgaaauuguauacuuaacaaacaccacuaucgagaaggaaauuugucccaaacuggcagaguauaggaauuggaguaagccucagugcaacaucacaggcuucgccccauuuagcaaagacaauuccauacggcuaucugcugggggagauauuugggugacccgcgagcccuacgucucgugugacccugauaagugcuaucaauucgcgcucggucagggcacgacucugaacaaugggcacucaaacgacaccgugcaugaucgaacaccauaccguacucuucugaugaaugaauugggaguucccuuucaccucggcaccagacagguguguaucgccuggagcaguuccucuugccaugacgguaaggcauggcugcacgucugugugacaggggaugacaaaaacgccaccgcuagcuucauuuauaauggaaggcugguagauuccaucggcucauggaguaagaaaauccuccggacgcaggagagcgaaugcguuuguauuaacggcacuugcacaguggucaugaccgacgggucugcauccggaaaggccgauacuaaaauauuauuuaucgaggaggguaagauugugcacaucucaacacugagcggcagugcucaacauguggaagagugcucuuguuacccucgcuauccaggggucagaugcguuuguagggacaacuggaagggauccaaucggccgauaguggauauuaacguaaaagacuacagcaucgugucgucuuacgucugcuccggccuugugggugacacccccaggaagaaugauucauucaguagcucccacuguuuggacccuaacaaugaagaagggggacauggcguuaaaggcugggccuuugaugacgggaacgauguguggaugggacgaacgaucucugagaagcugagaagcgguuaugagaccuucaaagucauugagggcuggucaaagccaaauaguaaacuacagaucaaccgccaggugauuguagaacgggggaaucguuccggauacagcggcauauuuucuguugaggguaagucaugcaucaaccgcuguuucuauguggaacucauuagagggaggaaggaggaaacagaggucugguggaccaguaauagcaucguggucuuuugcggcacuuccggaacauacggcacugggucuuggcccgacggagcggauaucaaccugaugccuauuuga

SEQ ID NO: 143746 - RNA, 1410 nt, Artificial Sequence
  derived and/or modified sequence opt3 from neuraminidase__InfluenzaA__AFD63760
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacaaaaacgccaccgcuucuuucauuuacaauggcaggcugguagauagcaucggcuccuggucaaagaaaauccuccggacgcaggagagugaaugcguuuguauuaacgggacuugcacaguggucaugaccgacggaagcgcaucugguaaggccgauacuaaaauauuauuuaucgaggagggcaagauuauccacauauccacacugucagggagcgcucaacacguggaagagugcaguuguuauccucgcuacccaggagugagaugcgucuguagggacaacuggaagggcucuaaucggccgauuguugauaucaacgugaaagacuacuccaucguaagcucguaugugugcucuggucuugucggggacacuccccgcaagaaugauuccucaaguagcucccauuguuuggacccuaacaaugaagagggaggccacggcgugaaagggugggccuucgaugacggaaacgauguuuggaugggucgaacgauuucugaaaagcugagaagcggcuacgagaccuuuaaagugaucgagggguggucaaagccaaauaguaaacuacagauuaacaggcaggucauaguggaacggggaaaucguuccggcuauagcgguaucuucucuguagaggggaagucaugcauuaaccgcuguuuuuacguugaacucaucagaggcaggaaggaggaaacagaggugugguggaccaguaauagcaucgucguguucugcggaaccuccggcacauaugggacuggaucuuggcccgacggugcggauauuaaccugaugccuauauga

SEQ ID NO: 143747 - RNA, 1410 nt, Artificial Sequence; identical to SEQ ID NO: 136241
  derived and/or modified sequence opt3 from neuraminidase__InfluenzaA__AFD63771

SEQ ID NO: 143748 - RNA, 1410 nt, Artificial Sequence; identical to SEQ ID NO: 136241
  derived and/or modified sequence opt3 from neuraminidase__InfluenzaA__AFD63782

SEQ ID NO: 143749 - RNA, 1410 nt, Artificial Sequence; identical to SEQ ID NO: 143746
  derived and/or modified sequence opt3 from neuraminidase__InfluenzaA__AFD63793

SEQ ID NO: 143750 - RNA, 1410 nt, Artificial Sequence; identical to SEQ ID NO: 136241
  derived and/or modified sequence opt3 from neuraminidase__InfluenzaA__AFD63804

SEQ ID NO: 143751 - RNA, 1410 nt, Artificial Sequence; identical to SEQ ID NO: 136241
  derived and/or modified sequence opt3 from neuraminidase__InfluenzaA__AFD63815

SEQ ID NO: 143752 - RNA, 1410 nt, Artificial Sequence; identical to SEQ ID NO: 136241
  derived and/or modified sequence opt3 from neuraminidase__InfluenzaA__AFD63826

SEQ ID NO: 143753 - RNA, 1410 nt, Artificial Sequence; identical to SEQ ID NO: 143746
  derived and/or modified sequence opt3 from neuraminidase__InfluenzaA__AFD63837

SEQ ID NO: 143754 - RNA, 1410 nt, Artificial Sequence
  derived and/or modified sequence opt3 from neuraminidase__InfluenzaA__AFD63848
augaaccccaaucagaagaucauuaccauaggcagcgugucccugacaaucgccgcuauuugcuuccucaugcaaaucgcaauucuugucacuacgguuacccugcacuuuaaacagagagaguguaacucuccuccaaauaaccaggugauguugugcgaaccgacaaucauagagaggaauaucacugaaauuguauacuuaaccaacacaaccaucgagaaggaaauuugucccaaacuggccgaguaucggaauuggucaaagccucagugcaacaucacuggguucgcgccauuuaguaaagacaauagcauacgccuauccgcuggaggugauauuugggugacacgagagcccuacgucucuugugacccugauaagugcuaucaauucgcccucggccaggggaccacgcugaacaauggacauucgaacgacacugugcacgaucguaccccauacagaacacuucugaugaaugaauugggcguucccuuucaucucgguacuaggcaaguguguaucgcauggucaagcaguuccugccacgacgggaaggccuggcugcaugucugugugaccggagaugacaaaaacgcuacagcaucuuucauuuauaauggccggcugguagauagcaucggcuccuggucaaagaaaauccuccgcacccaggagagugaaugcguuuguauuaacgggacgugcacuguggucaugacagacggaagcgccucugguaaggcugauaccaaaauauuauuuaucgaggagggcaagauugugcacaucuccacucugucagggagcgcccagcacguggaagagugcaguuguuacccuagauauccaggagucaggugcguuugucgggacaacuggaagggcucuaaucgcccgauaguggauauuaacguaaaagacuacuccaucgugagcucguacgucugcucuggucuugugggggacacaccccgaaagaaugauuccuucucaaguagccauuguuuggacccuaacaaugaagagggaggccacggcguuaaagggugggcguuugaugacggaaacgauguguggauggguagaaccaucuccgaaaagcugaggucuggcuaugagacguucaaagucauugagggguggagcaagccaaauucaaaacuacagaucaaccgucaggugauuguagaacggggaaaucgcaguggcuacuccgguauauuuagcguugaggggaagucuugcaucaacagauguuucuauguggaacucauuaggggccggaaggagaaaaccgaagucugguggacaucaaauaguaucguggucuuuugcggaacuagcggcaccuacgggacaggauccuggcccgacggugcagauaucaaccugaugccuauuuga

SEQ ID NO: 143755 - RNA, 1410 nt, Artificial Sequence; identical to SEQ ID NO: 136161
  derived and/or modified sequence opt3 from neuraminidase__InfluenzaA__AFD63859

SEQ ID NO: 143756 - RNA, 1410 nt, Artificial Sequence; identical to SEQ ID NO: 136161
  derived and/or modified sequence opt3 from neuraminidase__InfluenzaA__AFD63870

SEQ ID NO: 143757 - RNA, 1410 nt, Artificial Sequence; identical to SEQ ID NO: 136241
  derived and/or modified sequence opt3 from neuraminidase__InfluenzaA__AFD63881

SEQ ID NO: 143758 - RNA, 1410 nt, Artificial Sequence; identical to SEQ ID NO: 136241
  derived and/or modified sequence opt3 from neuraminidase__InfluenzaA__AFD63892

SEQ ID NO: 143759 - RNA, 1410 nt, Artificial Sequence
  derived and/or modified sequence opt3 from neuraminidase__InfluenzaA__AFD63903
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugggauuguauacuuaaccaacacaaccaucgaaaaggagauuugucccaaacuggccgaauauaggaauuggucaaagccucagugcaacaucacuggauucgcgccauuuaguaaagacaauagcauacggcuauccgcugguggcgauauuugggugacacgcgagcccuacgucucuugugacccugauaagugcuaucaauucgcccucgggcagggaaccacgcugaacaauggccacucgaacgacacugugcaugaucgaaccccauaccguacacuucugaugaaugaguuggguguucccuuucaccucgggacuagacagguguguaucgcauggucaagcaguuccugccaugacggaaaggccuggcugcacgucugugugaccggcgaugacaaaaacgcuacagcaucuuucauuuauaauggcaggcugguagauagcaucggguccuggucaaagaaaauccuccggacccaggaaagugagugcguuuguauuaacggaacgugcacuguggucaugacagacgguagcgccucuggcaaggcugauaccaaaauauuauuuaucgaagaggggaagauugugcacaucuccacucugucaggaagcgcccaacauguggaggaaugcaguuguuacccucgcuauccaggcgucagaugcguuuguagggacaacuggaaggguucuaaucggccgauaguggauauuaacguaaaagacuacuccaucgugagcucguacgucugcucugggcuugugggagacacaccccgcaagaaugauuccuucucaaguagccacuguuuggacccuaacaaugaggaaggcggccaugggguuaaaggaugggcguuugaugacgguaacgauguguggaugggccgaaccaucuccgagaagcugagaucuggguaugaaacguucaaagucauugagggauggagcaagccaaauucaaaacuacagaucaacaggcaagugauuguagagcggggcaaucguagugguuacuccgggauauuuagcguugaaggcaagucuugcaucaaccgcuguuucuauguggagcucauuagaggaaggaaggaagagaccgaagucugguggacaucaaauaguaucguggucuuuugcggcacuagcgggaccuacggaacagguuccuggcccgacggcgcagauaucaaccugaugccuauuuga

SEQ ID NO: 143760 - RNA, 1410 nt, Artificial Sequence
  derived and/or modified sequence opt3 from neuraminidase__InfluenzaA__AFD63914
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugcacaucuccacucugucagggagcgcccaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacaccccgcaagaaugauuccuucucaaguagccacuguuuggacccuaacaaugaagagggaggccauggcguuaaagggugggcguuugaugacggaaacgauguguggaugggucgaaccaucuccgaaaagcugagaucuggcuaugagacguucaaagucauugagggguggagcaagccaaauucaaaacuacagaucaacaggcaagugauuguagaacggggaaaucguaguggcuacuccgguauauuuagcguugaggggaagucuugcaucaaccgcuguuucuauguggaacucauuagaggcaggaaggagaaaaccgaagucugguggacaucaaauaguaucguggucuuuugcggaacuagcggcaccuacgggacaggauccuggcccgacggugcagauaucaaccugaugccuauuuga

SEQ ID NO: 143761 - RNA, 1410 nt, Artificial Sequence; identical to SEQ ID NO: 143746
  derived and/or modified sequence opt3 from neuraminidase__InfluenzaA__AFD63925

SEQ ID NO: 143762 - RNA, 1410 nt, Artificial Sequence
  derived and/or modified sequence opt3 from neuraminidase__InfluenzaA__AFD63936
augaaccccaaucagaagaucauuaccauaggcagcgugucccugacaaucgccacuauuugcuuccucaugcagaucgcuauucuugucacgaccguuacacugcacuuuaaacagcaugaguguaacccuccaccgaauaaccaggugauguugugcgaacccacuaucauagagagaaauaucaccgaaauuguauacuuaacaaacaccacuaucgagaaggaaauuuguccuaaacuggcagaguauaggaauuggucuaagccacagugcaacaucacaggguucgcccccuuuucaaaagacaauaguauacggcuaagcgcgggaggugauauuugggugacccgcgagccuuacgucuccugugacccagauaagugcuaucaauucgcucucggccaggggacgacucugaacaauggacacucuaacgacaccgugcaugaucgaacacccuaccguacucuucugaugaaugaauugggcguuccuuuucaccucgguaccagacagguguguaucgccuggucgucaagcaguugccaugacgggaaggcauggcugcacgucugugugacaggagaugacaaaaacgccaccgcuuccuucauuuauaauggcaggcugguagauucuaucggcagcugguccaagaaaauccuccggacgcaggagucagaaugcguuuguauuaacgggacuugcacaguggucaugaccgacggaagugcaagcgguaaggccgauacuaaaauauuauuuaucgaggagggcaagauugugcacaucucuacacuguccgggucagcucaacauguggaagagugcagcuguuacccacgcuauccgggagucagaugcguuuguagggacaacuggaagggcaguaaucggcccauaguggauauuaacguaaaagacuacucuaucguguccagcuacgucugcucgggucuugugggggacaccccucgcaagaaugauucuuucuccucaagucacuguuuggacccaaacaaugaagagggaggccauggcguuaaagggugggccuuugaugacggaaacgauguguggaugggucgaacgaucagcgaaaagcugagauccggcuaugagaccuucaaagucauugagggguggucuaagcccaauagcaaacuacagaucaacaggcaagugauuguagaacggggaaaucguucaggcuacagugguauauuuuccguugagggcaagagcugcaucaaccgcuguuucuauguggaacucauuagagggaggaaggaggaaacagaggucugguggacuucuaauucaaucguggucuuuugcggaaccaguggcacauacgggacuggaagcuggccugacggugcggauaucaaccugaugccaauuuga

SEQ ID NO: 143763 - RNA, 1410 nt, Artificial Sequence; identical to SEQ ID NO: 136241
  derived and/or modified sequence opt3 from neuraminidase__InfluenzaA__AFD63947

SEQ ID NO: 143764 - RNA, 1410 nt, Artificial Sequence; identical to SEQ ID NO: 136241
  derived and/or modified sequence opt3 from neuraminidase__InfluenzaA__AFD63958

SEQ ID NO: 143765 - RNA, 1410 nt, Artificial Sequence; identical to SEQ ID NO: 136241
  derived and/or modified sequence opt3 from neuraminidase__InfluenzaA__AFD63969

SEQ ID NO: 143766 - RNA, 1410 nt, Artificial Sequence; identical to SEQ ID NO: 136241
  derived and/or modified sequence opt3 from neuraminidase__InfluenzaA__AFD63980

SEQ ID NO: 143767 - RNA, 1410 nt, Artificial Sequence
  derived and/or modified sequence opt3 from neuraminidase__InfluenzaA__AFD64002
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugcacaucuccacucugucagggagcgcccaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacaccccgcaagaccgauuccuucucaaguagccacuguuuggacccuaauaacgaagagggaggccauggcguuaaagggugggcguuugaugacggaaaugauguguggaugggucgaacgaucuccgaaaagcugagaucuggcuaugagaccuucaaagucauugagggguggagcaagccaaacucaaaacuacagaucaauaggcaagugauuguagaacggggaaaccguaguggcuacuccgguauauuuagcguugaggggaagucuugcaucaaucgcuguuucuauguggaacucauuagaggcaggaaggaggaaacagaggucugguggacuucaaacaguaucguggucuuuugcggaaccagcggcacauacgggacuggauccuggcccgacggugcagauaucaaucugaugccuauuuga

SEQ ID NO: 143768 - RNA, 1410 nt, Artificial Sequence; identical to SEQ ID NO: 136151
  derived and/or modified sequence opt3 from neuraminidase__InfluenzaA__AFD64013

SEQ ID NO: 143769 - RNA, 1410 nt, Artificial Sequence
  derived and/or modified sequence opt3 from neuraminidase__InfluenzaA__AFD64024
augaaccccaaucagaagaucauuaccauaggcagcgugucccugacaaucgccgcuauuugcuuccucaugcaaaucgcaauucuugucacuacgguuacccugcacuuuaaacagcaugaguguaacucuccuccaaauaaccaggugauguugugcgaaccgacaaucauagagaagaauaucacugaaauuguauacuuaaccaacacaaccaucgagaaagaaauuugucccaagcuggccgaguauagaaauuggucaaaaccucagugcaacaucacuggguucgcgccauuuaguaaggacaauagcauaaggcuauccgcuggaggugauauuugggugacacgggagcccuacgucucuugugacccugauaagugcuaucaauucgcccucggccaggggaccacgcugaacaauggacacucgaacgacacugugcaugaucgcaccccauaccgaacacuucugaugaaugaauugggcguucccuuucaccucgguacucgucagguguguaucgcauggucaagcaguuccugccaugacgggaaagccuggcugcacgucugugugaccggagaugacaagaacgcuacagcaucuuucauuuauaauggcagacugguagauagcaucggcuccuggaguaaaaagauccucaggacccaggagucagaaugcguuuguauuaacgggacgugcacuguggucaugacagacggaagcgccucugguaaagcugauaccaagauauuauuuaucgaggagggcaagauugugcacaucuccacucugucagggagcgcccaacauguggaagagugcaguuguuacccucgguauccaggaguccgcugcguuuguagagacaacuggaaaggcucuaauaggccgauaguggauauuaacguaaaggacuacuccaucgugagcucguacgucugcucuggucuugugggggacacaccccggaaaaaugauuccuucucaaguagccacuguuuggacccuaacaaugaagagggaggccauggcguuaaggggugggcguuugaugacggaaacgauguguggaugggucgcaccaucuccgaaaaacugcgaucuggcuaugagacguucaaggucauugagggguggagcaaaccaaauucaaagcuacagaucaacagacaggugauuguagaaaggggaaaucggaguggcuacuccgguauauuuagcguugaggggaagucuugcaucaaccguuguuucuauguggaacucauucgcggcagaaaagaggaaaccgaggucugguggacaucaaauaguaucguggucuuuugcggaacuagcggcaccuacgggacaggauccuggcccgacggugcagauaucaaccugaugccuauuuga

SEQ ID NO: 143770 - RNA, 1410 nt, Artificial Sequence
  derived and/or modified sequence opt3 from neuraminidase__InfluenzaA__AFD64035
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugcacaucuccacucugucagggagcgcccaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacaccccgcaagaaugauuccuucucaaguagccacuguuuggacccuaacaaugaagagggaggccauggcguuaaagggugggcguuugaugacggaaacgauguguggaugggucgaaccaucuccgaaaagcugagaucuggcuaugagacguucaaagucauugagggguggagcaagccaaauucaaaacuacagaucaacaggcaagugauuguagaacggggaaaucguaguggcuacuccgguauauuuagcguugaggggaagucuugcaucaaccgcuguuucuauguggaacucauuagaggcaggaaggaggaaaccgaggucugguggacaucaaauaguguggucguguuuugcggaacuagcggcaccuacgggacaggauccuggcccgacggugcagauaucaaccugaugccuaucuga

SEQ ID NO: 143771 - RNA, 1410 nt, Artificial Sequence
  derived and/or modified sequence opt3 from neuraminidase__InfluenzaA__AFD64046
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaacgaacaccauaccguacucuucugaugaaugaguugggcguucccuuucaccucgguaccagacagguguguaucgccuggucaagcaguuccugccaugaugggaaggcauggcugcacgucugugugacaggagacgauaaaaacgccaccgcuucuuucauuuauaauggcaggcugguagacagcaucggcuccuggucaaagaaaauccuccggacgcaggaaagugagugcguuuguauuaacgggacuugcacaguggucaugaccgauggaagcgcaucugguaaggccgacacuaaaauauuauuuaucgaggaaggcaagauugugcacaucuccacacugucagggagcgcucaacauguggaggaaugcaguuguuacccucgcuauccaggagucagaugcguuuguagggauaacuggaagggcucuaaucggccgauaguggacauuaacguaaaagauuacuccaucgugagcucguacgucugcucuggucuugugggggacacccccaggaagaaugacuccuucucaaguagccacuguuuggauccuaacaaugaggaaggaggccauggcguuaaagggugggccuuugacgauggaaacgacguguggaugggucgaacgaucuccgagaagcugagaucuggcuaugagaccuucaaagucauugaaggguggagcaagccaaauucaaaacuacagaucaaccgccaggugauuguagagcggggaaaucguaguggcuacuccgguauauuuagcguugaagggaagucuugcaucaaccgcuguuucuauguggagcucauuagaggcaggaaggaagagacagaggucugguggacuucaaauaguaucguggucuuuugcggaaccagcggcacauacgggacuggauccuggcccgauggugcggacaucaaccugaugccuauuuga

SEQ ID NO: 143772 - RNA, 1410 nt, Artificial Sequence; identical to SEQ ID NO: 143746
  derived and/or modified sequence opt3 from neuraminidase__InfluenzaA__AFD64057

SEQ ID NO: 143773 - RNA, 1410 nt, Artificial Sequence
  derived and/or modified sequence opt3 from neuraminidase__InfluenzaA__AFD64068
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacaaccgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaaaagauucugaggacgcaggagagcgaaugugugugcauaaacggcacuuguacagucgugaugaccgacggcucugcuuccgggaaagcagauacuaagauccucuuuauugaggagggaaagaucgugcacacaucaaccuuaagcgguagugcccaacacgucgaagagugcucuugcuauccucgguacccaggcguucgcugugugugcagagacaacuggaaaggguccaauaggccgauaguagauauuaacaucaaggacuacagcaucgugucgucuuaugucuguuccggacuggugggcgacacgccccggaaaaaugauucaaguagcuccucucauugccuugacccuaacaaugaagagggugggcacggaguuaagggcugggcuuucgaugacggcaacgauguguggauggggcgcaccauuagcgaaaaaucacgaaguggauacgagacauuuaaggucaucgaggguugguccaauccaaacagcaaauugcagauuaauagacaggugauaguagacaggggcaaccggucuggguauucaggaaucuucaguguugaaggcaagagcuguauuaaucguugcuuuuacguggagcugauccgcgguagaaaggaagagacugaaguccuauggaccuccaacucuaucguggucuucugugggacaucgggcacuuauggaaccggcagcuggcccgauggggccgacauuaaucucaugccuauauga

SEQ ID NO: 143774 - RNA, 1410 nt, Artificial Sequence
  derived and/or modified sequence opt3 from neuraminidase__InfluenzaA__AFD64079
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggauuuccgcuggaggugauaucugggugacacgcgagcccuacgucucuugugacccugauaagugcuaucaauucgcccuaggccaggggaccacgcucaacaauggacacucgaacgacacugugcaugaucgaaccccauaccguacacugcuuaugaaugaacugggcguucccuuucacuuggguacuagacagguguguauugcauggucaagcaguuccugccaugacgggaaggccuggcuccacgucugugugaccggagaugacaaaaacgcuacagcaucuuucaucuauaauggcaggcugguagauagcaucggcuccuggucaaagaaaauucugcggacccaggagagugaaugcguuuguauaaacgggacgugcacuguggucaugacagacggaagcgccucugguaaggcugauaccaaaauccucuuuauugaggagggcaagaucgugcacauauccacuuuaucagggagcgcccaacauguggaagagugcaguuguuacccucgcuauccaggagucagaugcguuuguagggacaacuggaagggcucuaaucggccgauuguggauaucaacguaaaagacuacuccaucgugagcucguacgucugcucuggucuggugggggacacaccccgcaagaaugauuccuucucaaguagccacugucuugacccuaacaaugaagagggaggccauggcguuaaagggugggcguuugaugacggaaacgauguguggaugggucgaaccauuuccgaaaaguugagaucuggcuaugagacguucaaagucaucgagggguggagcaagccaaauucaaaacugcagauuaacaggcaagugauaguagaacggggaaaucguaguggcuacuccgguaucuuuagcguugaggggaagucuugcauuaaccgcuguuucuauguggaacuaaucagaggcaggaaggaggaaaccgaggucugguggacaucaaauaguaucguggucuuuugcggaacuagcggcaccuacgggacaggauccuggcccgacggugcagauauuaaccucaugccuauauga

SEQ ID NO: 143775 - RNA, 1410 nt, Artificial Sequence; identical to SEQ ID NO: 136241
  derived and/or modified sequence opt3 from neuraminidase__InfluenzaA__AFD64090

SEQ ID NO: 143776 - RNA, 1410 nt, Artificial Sequence
  derived and/or modified sequence opt3 from neuraminidase__InfluenzaA__AFD64101
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcauggccgaaccccauaccguacacuucugaugaaugaauuggguguucccuuucaccucgggacuagacagguguguaucgcauggucaagcaguuccugccaugauggaaaggccuggcugcacgucugugugaccggcgacgauaaaaacgcuacagcaucuuucauuuauaauggcaggcugguagacagcaucggguccuggucaaagaaaauccuccggacccaggagagugaaugcguuuguauuaacggaacgugcacuguggucaugacagaugguagcgccucuggcaaggcugacaccaaaauauuauuuaucgaggaggggaagauugugcacaucuccacucugucaggaagcgcccaacauguggaagagugcaguuguuacccucgcuauccaggcgucagaugcguuuguagggauaacuggaaggguucuaaucggccgauaguggacauuaacguaaaagauuacuccaucgugagcucguacgucugcucugggcuugugggagacacaccccgcaagaaugacuccuucucaaguagccacuguuuggauccuaacaaugaagagggcggccaugggguuaaaggaugggcguuugacgaugguaacgacguguggaugggccgaaccaucuccgaaaagcugagaucuggguaugagacguucaaagucauugagggauggagcaagccaaauucaaaacuacagaucaacaggcaagugauuguagaacggggcaaucguagugguuacuccgggauauuuagcguugagggcaagucuugcaucaaccgcuguuucuauguggaacucauuagaggaaggaaggaggaaaccgaggucugguggacaucaaauaguaucguggucuuuugcggcacuagcgggaccuacggaacagguuccuggcccgauggcgcagacaucaaccugaugccuauuuga

SEQ ID NO: 143777 - RNA, 1410 nt, Artificial Sequence
  derived and/or modified sequence opt3 from neuraminidase__InfluenzaA__AFD64112
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacaaaaacgccaccgcuucuuucauuuacaauggcaggcugguagauagcaucggcuccuggucaaagaaaauccuccggacgcaggagagugaaugcguuuguauuaacgggacuugcacaguggucaugaccgacggaagcgcaucugguaaggccgauacuaaaauauuauuuaucgaggagggcaagauuauccacauauccacacugucagggagcgcucaacacguggaagagugcaguuguuauccucgcuacccaggagugagaugcgucuguagggacaacuggaagggcucuaaucggccgauuguugauaucaacgugaaagacuacuccaucguaagcucguaugugugcucuggucuugucggggacacuccccgcaagaaugauuccucaaguagcucccauuguuuggacccuaacaaugaagagggaggccacggcgugaaagggugggccuucgaugacggaaacgauguuuggaugggucgaacgauuucugaaaagcugagaagcggcuacgagaccuuuaaagugaucgagggguggucaaagccaaauaguaaacuacagauuaacaggcaggucauaguggaacgggacaaucguuccggauauagcggcaucuucucuguagaggguaagucaugcauuaaccgcuguuuuuacguugaacucaucagagggaggaaggaggaaacagaggugugguggaccaguaauagcaucgucguguucugcggcaccuccggaacauauggcacugggucuuggcccgauggagcggacauuaaccugaugccuauauga

SEQ ID NO: 143778 - RNA, 1410 nt, Artificial Sequence; identical to SEQ ID NO: 137947
  derived and/or modified sequence opt3 from neuraminidase__InfluenzaA__AFD64123

SEQ ID NO: 143779 - RNA, 1410 nt, Artificial Sequence; identical to SEQ ID NO: 136241
  derived and/or modified sequence opt3 from neuraminidase__InfluenzaA__AFD64134

SEQ ID NO: 143780 - RNA, 1410 nt, Artificial Sequence; identical to SEQ ID NO: 136241
  derived and/or modified sequence opt3 from neuraminidase__InfluenzaA__AFD64145

SEQ ID NO: 143781 - RNA, 1410 nt, Artificial Sequence; identical to SEQ ID NO: 136241
  derived and/or modified sequence opt3 from neuraminidase__InfluenzaA__AFD64156

SEQ ID NO: 143782 - RNA, 1410 nt, Artificial Sequence; identical to SEQ ID NO: 136161
  derived and/or modified sequence opt3 from neuraminidase__InfluenzaA__AFD64167

SEQ ID NO: 143783 - RNA, 1410 nt, Artificial Sequence; identical to SEQ ID NO: 136241
  derived and/or modified sequence opt3 from neuraminidase__InfluenzaA__AFD64181

SEQ ID NO: 143784 - RNA, 1410 nt, Artificial Sequence
  derived and/or modified sequence opt3 from neuraminidase__InfluenzaA__AFD64192
augaaccccaaucagaagaucauuaccauaggcagcgugucccugacaaucgccgcuauuugcuuccucaugcaaaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugcacguguccacucugucagggagcgcccaacaugucgaagagugcaguuguuacccucgcuauccaggaguuagaugcguguguagggacaacuggaagggcucuaaucggccgaucguagauauaaacgugaaagacuacuccauugucagcucguacgugugcucuggucuuguuggggacacaccccgcaagaaugauuccuucucaaguagccacuguuuggacccuaacaaugaagagggaggccauggcgugaaagggugggcguuugaugacggaaacgaugucuggaugggucgaaccaucuccgaaaagcugagaucuggcuaugagacguucaaagugaucgagggguggagcaagccaaauucaaaacuacagauuaacaggcagguaaucguugaacggggaaaucguaguggcuacuccgguauuuuuagcguggaggggaagucuugcauaaaccgcuguuucuaugucgaacucaucagaggcaggaaggaggaaaccgaggugugguggacaucaaauaguauugucguguuuugcggaacuagcggcaccuacgggacaggauccuggcccgacggugcagauaucaaccugaugccuaucuga

SEQ ID NO: 143785 - RNA, 1410 nt, Artificial Sequence
  derived and/or modified sequence opt3 from neuraminidase__InfluenzaA__AFD64203
augaaccccaaucagaagaucauuaccauaggcagcgugucccugacaaucgccgcuauuugcuuccucaugcaaaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaaucgacacucgaacgacacugugcaugaucguaccccauacagaacacuucugaugaaugaauugggaguucccuuucaccucggcacuaggcaaguguguaucgcauggucaagcaguuccugccaugacgguaaggccuggcugcacgucugugugaccggggaugacaaaaacgcuacagcaucuuucauuuauaauggacggcugguagauagcaucggcuccuggucaaagaaaauccuccgcacccaggagagugaaugcguuuguauuaacggcacgugcacuguggucaugacagacgggagcgccucuggaaaggcugauaccaaaauauuauuuaucgaggaggguaagauugugcacaucuccacucugucaggcagcgcccagcauguggaagagugcaguuguuacccuagauauccaggggucaggugcguuugucgggacaacuggaagggaucuaaucgcccgauaguggauauuaacguaaaagacuacuccaucgugagcucguacgucugcucuggccuugugggugacacaccccgaaagaaugauuccuucucaaguagccacuguuuggacccuaacaaugaagaagggggacauggcguuaaaggcugggcguuugaugacgggaacgauguguggaugggaagaacccuguccgagaagcuaaggucugguuaugagacguucaaagucaucgagggcuggagcaagccaaauucaaaacuccagauuaaccgucaggugaucguagaacgggggaaucgcaguggauacuccggcauuuuuagcguugaggguaagucuugcauaaacagauguuucuauguggaacugaucagggggcggaaggaggaaaccgaggucugguggacaucaaauaguauuguggucuuuugcggcacuagcggaaccuacggcacaggguccuggcccgacggagcagauaucaaccuuaugccuaucuga

SEQ ID NO: 143786 - RNA, 1410 nt, Artificial Sequence; identical to SEQ ID NO: 143746
  derived and/or modified sequence opt3 from neuraminidase__InfluenzaA__AFD64214

SEQ ID NO: 143787 - RNA, 1410 nt, Artificial Sequence; identical to SEQ ID NO: 137945
  derived and/or modified sequence opt3 from neuraminidase__InfluenzaA__AFD64225

SEQ ID NO: 143788 - RNA, 1410 nt, Artificial Sequence; identical to SEQ ID NO: 136241
  derived and/or modified sequence opt3 from neuraminidase__InfluenzaA__AFD64317

SEQ ID NO: 143789 - RNA, 1410 nt, Artificial Sequence; identical to SEQ ID NO: 137947
  derived and/or modified sequence opt3 from neuraminidase__InfluenzaA__AFD64328

SEQ ID NO: 143790 - RNA, 1410 nt, Artificial Sequence; identical to SEQ ID NO: 143746
  derived and/or modified sequence opt3 from neuraminidase__InfluenzaA__AFD64339

SEQ ID NO: 143791 - RNA, 1410 nt, Artificial Sequence; identical to SEQ ID NO: 136241
  derived and/or modified sequence opt3 from neuraminidase__InfluenzaA__AFD64350

SEQ ID NO: 143792 - RNA, 1410 nt, Artificial Sequence; identical to SEQ ID NO: 143746
  derived and/or modified sequence opt3 from neuraminidase__InfluenzaA__AFD64361

SEQ ID NO: 143793 - RNA, 1410 nt, Artificial Sequence; identical to SEQ ID NO: 143746
  derived and/or modified sequence opt3 from neuraminidase__InfluenzaA__AFD64372

SEQ ID NO: 143794 - RNA, 1410 nt, Artificial Sequence; identical to SEQ ID NO: 136241
  derived and/or modified sequence opt3 from neuraminidase__InfluenzaA__AFD64383

SEQ ID NO: 143795 - RNA, 1410 nt, Artificial Sequence; identical to SEQ ID NO: 143746
  derived and/or modified sequence opt3 from neuraminidase__InfluenzaA__AFD64394

SEQ ID NO: 143796 - RNA, 1410 nt, Artificial Sequence; identical to SEQ ID NO: 136241
  derived and/or modified sequence opt3 from neuraminidase__InfluenzaA__AFD64405

SEQ ID NO: 143797 - RNA, 1410 nt, Artificial Sequence; identical to SEQ ID NO: 136241
  derived and/or modified sequence opt3 from neuraminidase__InfluenzaA__AFD64416

SEQ ID NO: 143798 - RNA, 1410 nt, Artificial Sequence; identical to SEQ ID NO: 136241
  derived and/or modified sequence opt3 from neuraminidase__InfluenzaA__AFD64427

SEQ ID NO: 143799 - RNA, 1410 nt, Artificial Sequence
  derived and/or modified sequence opt3 from neuraminidase__InfluenzaA__AFD64438
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaucuggccgaguauaggaacuggucaaaaccucagugcaauaucacuggguucgcgccauuuaguaaggacaacagcauacggcuauccgcuggaggugauauuugggugacacgcgagcccuacgucucuugugacccugauaaaugcuaucaauucgcccucggccaggggaccacgcugaauaacggacacucgaaugacacugugcaugaucgaaccccauaccguacacuucugaugaacgaauugggcguucccuuucaccucgguacuagacagguguguaucgcauggucaagcaguuccugccaugacgggaaggccuggcugcacgucugugugaccggagaugacaagaaugcuacagcaucuuucauuuauaacggcaggcugguagauagcaucggcuccuggaguaaaaagauccuccggacccaggagucagaaugcguuuguauuaacgggacgugcacuguggucaugacagacggaagcgccucugguaaagcugauaccaagauauuauuuaucgaggagggcaaaauugugcacaucuccacucugucagggagcgcccaacauguggaagagugcaguuguuacccucgcuauccaggagucagaugcguuuguagggacaauuggaagggcucuaaccggccgauaguggauauuaauguaaaggacuacuccaucgugagcucguacgucugcucuggucuugugggggacacaccccgcaaaaacgauuccuucucaaguagccacuguuuggacccuaauaacgaagagggaggccauggcguuaaggggugggcguuugaugacggaaaugauguguggaugggucgaaccaucuccgaaaaacugagaucuggcuaugagacguucaaggucauugagggguggagcaaaccaaacucaaagcuacagaucaauaggcaagugauuguagaacggggaaaccguaguggcuacuccgguauauuuagcguugaggggaaaucuugcaucaaucgcuguuucuauguggaacucauuagaggcaggaaggaggaaaccgaggucugguggacaucaaacaguaucguggucuuuugcggaacuagcggcaccuacgggacaggauccuggcccgacggugcagauaucaaucugaugccuauuuga

SEQ ID NO: 143800 - RNA, 1410 nt, Artificial Sequence; identical to SEQ ID NO: 136241
  derived and/or modified sequence opt3 from neuraminidase__InfluenzaA__AFD64449

SEQ ID NO: 143801 - RNA, 1410 nt, Artificial Sequence; identical to SEQ ID NO: 136161
  derived and/or modified sequence opt3 from neuraminidase__InfluenzaA__AFD64460

SEQ ID NO: 143802 - RNA, 1410 nt, Artificial Sequence; identical to SEQ ID NO: 143159
  derived and/or modified sequence opt3 from neuraminidase__InfluenzaA__AFD98098

SEQ ID NO: 143803 - RNA, 1410 nt, Artificial Sequence
  derived and/or modified sequence opt3 from neuraminidase__InfluenzaA__AFD98120
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuaaugagacaagcagauugggauaugagacuuuuaaggucaucgaagguuggucaaacccaaaaaguaagcugcagauuaauaggcaagugauaguagacaaaggcaaccgguccggguacagcggaaucuucucuguugagggcaagucauguauuaaucguugcuuuuauguggaacuaauccgcgguagaaaggaggaaaccgagguccucuggacaaguaacagcaucguggucuucugugggacuuccggcaccuacggaacaggcucuuggcccgauggggccgaccugaaucuuaugccuauuuga

SEQ ID NO: 143804 - RNA, 1410 nt, Artificial Sequence; identical to SEQ ID NO: 141534
  derived and/or modified sequence opt3 from neuraminidase__InfluenzaA__AFD98131

SEQ ID NO: 143805 - RNA, 1410 nt, Artificial Sequence; identical to SEQ ID NO: 143159
  derived and/or modified sequence opt3 from neuraminidase__InfluenzaA__AFD98142

SEQ ID NO: 143806 - RNA, 1410 nt, Artificial Sequence; identical to SEQ ID NO: 143803
  derived and/or modified sequence opt3 from neuraminidase__InfluenzaA__AFD98164

SEQ ID NO: 143807 - RNA, 1410 nt, Artificial Sequence
  derived and/or modified sequence opt3 from neuraminidase__InfluenzaA__AFD98175
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcaucacaggggaugacaagaacgcaaccgccagcuucaucuacaauggaagacugguggauuccguaguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagaccauagcaucgugucgucuuacgucuguuccggacuggugggcgacacgccccggaagaaugauucaaguagcuccucucacugccuugacccuaacaaugaggaaggugggcauggaguuaaaggcugggcuuucgaugacggcaacgauguguggauggggcgcaccauuaaugagacaagccgauugggauaugagacuuuuaaggucaucgaagguuggucaaacccaaaaaguaagcugcagauuaauagacaggugauaguagacaaaggcaacagguccggguacagcggaaucuucucuguugagggcaagucauguauuaaucggugcuuuuauguggaacuaauccguggucgcaaggaggaaaccgagguccucuggacaaguaacagcaucguggucuucugugggacuuccggcaccuacggaacaggcucuuggcccgauggggccgaccugaaucuuaugccuauuuga

SEQ ID NO: 143808 - RNA, 1410 nt, Artificial Sequence
  derived and/or modified sequence opt3 from neuraminidase__InfluenzaA__AFD98186
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaaacugguggauuccguaguuucauggaguaaggagauucugaggacgcaggaaagcgagugugugugcauaaacggcacuuguacagucgugaugaccgacggcucugcuuccgggaaagcagauacuaagauccucuuuguggaggaaggaaagauuguccauacaucaaccuuaagcgguagugcccaacacguugaggaaugcucuugcuauccucgguacccaggcgugcgcuguguaugcagagacaacuggaaaggguccaauaggccgaucguggauauaaacauuaaggaccacagcaucaucucgucuuacgucuguuccggacuggugggcgacacgccccggaaaaaugauucaaguagcuccucucauugccuugacccuaacaaugaggaaggugggcacggaguuaagggcugggcuuucgaugacggcaacgauguguggauggggcgcaccauuaaugagacaagccgauugggauaugagacuuuuaaagucaucgaagguuggucaaacccaaagaguaaacugcagauuaauagacaggugauaguagacaggggcaaccgguccggguacagcggaaucuucucuguugagggcaagucauguauuaaucguugcuuuuauguggaacuaauccgcgguagaaaggaggaaaccgagguccucuggacaaguaacagcaucguggucuucugugggacuuccggcaccuacggaacaggcucuuggcccgauggggccgaccugaaucuuaugccuauuuga

SEQ ID NO: 143809 - RNA, 1410 nt, Artificial Sequence; identical to SEQ ID NO: 141534
  derived and/or modified sequence opt3 from neuraminidase__InfluenzaA__AFD98197

SEQ ID NO: 143810 - RNA, 1410 nt, Artificial Sequence; identical to SEQ ID NO: 142271
  derived and/or modified sequence opt3 from neuraminidase__InfluenzaA__AFD98208

SEQ ID NO: 143811 - RNA, 1410 nt, Artificial Sequence
  derived and/or modified sequence opt3 from neuraminidase__InfluenzaA__AFD98218
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccauugacgagacaagcagacuuggauaugagacuuuuaaggucaucgaagguuggucaaaucccaaaaguaaguugcagauuaacaggcaagugauaguagauaaaggcaaucgguccggguacagcggaaucuucucuguugagggcaagucauguauuaaccguugcuuuuauguggaacugauccgcgguagaaaggaggaaaccgagguccuauggacaaguaauagcaucguggucuccugugggacuucuggcaccuacggaacaggcucguggccugacggggccgaucucaaccugaugccaauuuga

SEQ ID NO: 143812 - RNA, 1410 nt, Artificial Sequence; identical to SEQ ID NO: 141534
  derived and/or modified sequence opt3 from neuraminidase__InfluenzaA__AFD98229

SEQ ID NO: 143813 - RNA, 1410 nt, Artificial Sequence; identical to SEQ ID NO: 141534
  derived and/or modified sequence opt3 from neuraminidase__InfluenzaA__AFD98240

SEQ ID NO: 143814 - RNA, 1410 nt, Artificial Sequence; identical to SEQ ID NO: 143803
  derived and/or modified sequence opt3 from neuraminidase__InfluenzaA__AFD98251

SEQ ID NO: 143815 - RNA, 1410 nt, Artificial Sequence; identical to SEQ ID NO: 143803
  derived and/or modified sequence opt3 from neuraminidase__InfluenzaA__AFD98262

SEQ ID NO: 143816 - RNA, 1410 nt, Artificial Sequence; identical to SEQ ID NO: 142725
  derived and/or modified sequence opt3 from neuraminidase__InfluenzaA__AFD98273

SEQ ID NO: 143817 - RNA, 1410 nt, Artificial Sequence; identical to SEQ ID NO: 142273
  derived and/or modified sequence opt3 from neuraminidase__InfluenzaA__AFD98283

SEQ ID NO: 143818 - RNA, 1410 nt, Artificial Sequence; identical to SEQ ID NO: 141534
  derived and/or modified sequence opt3 from neuraminidase__InfluenzaA__AFD98293

SEQ ID NO: 143819 - RNA, 1410 nt, Artificial Sequence; identical to SEQ ID NO: 142725
  derived and/or modified sequence opt3 from neuraminidase__InfluenzaA__AFD98313

SEQ ID NO: 143820 - RNA, 1410 nt, Artificial Sequence; identical to SEQ ID NO: 142273
  derived and/or modified sequence opt3 from neuraminidase__InfluenzaA__AFD98323

SEQ ID NO: 143821 - RNA, 1410 nt, Artificial Sequence; identical to SEQ ID NO: 142725
  derived and/or modified sequence opt3 from neuraminidase__InfluenzaA__AFD98333

SEQ ID NO: 143822 - RNA, 1410 nt, Artificial Sequence; identical to SEQ ID NO: 143803
  derived and/or modified sequence opt3 from neuraminidase__InfluenzaA__AFD98343

SEQ ID NO: 143823 - RNA, 1410 nt, Artificial Sequence
  derived and/or modified sequence opt3 from neuraminidase__InfluenzaA__AFD98354
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcaacgcuucugggaaggcagauacuaaaauccucuuuauugaggaaggaaagaucgugcauacauccaccuuacuggguucagcccaacacgucgaggaaugcagcugcuauccucgcuacccaggcguuagaugugugugcagggacaauuggaaggggaguaaccggccgauaguagauauuaauaucaaagaccacucuaucguguccagcuacgucuguucgggacuugugggcgacacgccccgcaagaacgauucuuccucaaguagccauugcuuggacccuaauaacgaggaaggugggcacggaguuaaaggcugggcuuucgaugacggcaaugauguguggauggggcgaaccauuaacgagacauccagacugggauaugagacuuuuaaggucaucgaagguuggucuaauccaaaaagcaagcuacagauuaacaggcaagugauaguagacaaaggcaaucggucaggguacaguggaaucuucuccguugagggcaagagcuguauuaaccguugcuuuuauguggaacucauccgcgguagaaaggaggaaaccgagguccuguggacaucuaauucaaucguggucuucugugggaccaguggcacuuacggaacaggcagcuggcccgauggggccgaccuuaaccugaugccuauuuga

SEQ ID NO: 143824 - RNA, 1410 nt, Artificial Sequence
  derived and/or modified sequence opt3 from neuraminidase__InfluenzaA__AFD98365
augaaccccaaucagaagaucauuaccauaggcagcgugucccugacaaucucuacuauuugcuucuuuaugcagaucgccauucucaucacgaccgucacacuucacuucaaacaguacgaguuuuauucaccuccaaacaaucagguuaugcugugugaaccgacuauaaucgagagaaacauuaccgaaaucguguacuugacaaauaccacuauugagaaggaaaucugccccaaauuagcugaguauaggaacuggaguaagccucagugugacauaacaggguucgcaccauuuagcaaagauaauuccauucggcugucugccggaggugacaucuggguaacccgcgagcccuacgugucgugcgauccugacaaguguuaucaauucgcgcuaggccaggggacgacucucaacaauguccauucaaacaauaccgugcgagaucguacaccauacagaacucugcuuaugaacgaacugggaguucccuuucacuugggcaccaaacaggugugcauugcuuggagcaguuccucuugucaugacgguaaggccuggcuccacgucugcaucacaggggaugacaagaaugcaaccgccagcuucaucuauaacggaaggcugguggauuccguaguuucauggaguaaagagauucugcggacgcaggaaagcgagugugugugcauaaauggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuacccucgcuacccaggcguuagaugugugugcagggacaacuggaagggguccaaccggccgauaguagauauuaauaucaaagaccacagcaucgugucgucuuaugucuguuccggacuggugggcgacacgccccgcaagaacgauucaaguagcuccucucauugccuugacccuaauaacgaggaaggugggcacggaguuaaaggcugggcuuucgaugacggcaaugauguguggauggggcgaaccauuaacgagacaagcagauugggauacgagacuuuuaaggucaucgaagguuggucaaauccaaaaaguaagcugcagauuaacaggcaagugauaguagaccggggcaaucguuccggguauagcggaaucuucucuguugagggcaaaucauguauuaaccgcugcuuuuacguggaacuaaucagagguaggaaggaggaaaccaagguccucuggacaaguaauagcaucguggucuucugugggacuuccggcaccuauggaacaggcucuuggcccgauggggccgaccugaaccuuaugccuauuuga

SEQ ID NO: 143825 - RNA, 1410 nt, Artificial Sequence
  derived and/or modified sequence opt3 from neuraminidase__InfluenzaA__AFD98376
augaaccccaaucagaagaucauuaccauaggcagcgugucccugacaaucucuacuauuugcuucuuuaugcagaucgccauucucaucacgaccgucacacuucacuucaaacaguacgaguuuaacuucccuccaaauaaccagguuaugcugugugaaccgacuauaaucgagagaaauauuaccgaaaucguguauuugacaaacaccacuauugagaaggaaaucugccccaaauuagcugaguacaggaauuggucaaagccucagugugacauaacaggguuugcaccauucaguaaagauaacagcauucggcuguccgccggaggugacaucuggguaacccgcgagcccuaugugucuugcgauccugacaaguguuaccaauuugcgcuaggccaggggacgacucucaauaacguccauucgaauaacaccgugcgagaucguacaccauauagaacucugcuuaugaaugaacugggaguucccuuccacuugggcaccaaacaggugugcauugcuuggucaagcaguuccugucaugacgguaaggccuggcuccacgucugcaucacaggggaugacaagaacgcaaccgccucuuuuaucuacaauggaaggcugguggauagcguaguuuccuggucaaaagagauucugcggacgcaggaaagugagugugugugcauaaacggcacuuguacagucgugaugaccgacggcagcgcuucugggaaggcagauacuaaaauccucuucauugaggaaggaaagaucgugcauacauccaccuuaucagguagcgcccaacacgucgaggaaugcaguugcuauccucgcuacccaggcguuagaugugugugcagggacaacuggaaggggucuaaucggccgauaguagauauuaacaucaaagaccacuccaucgugagcucguacgucuguucuggacuggugggcgacacgccccgcaagaaugauuccucaaguagcggucauugccuugacccuaacaaugaggaagggggacacggcguuaaaggcugggcuuuugaugacgggaacgauguguggaugggacgaaccauuaaugagacauccagauuggguuaugagacuuucaaggucaucgaaggcuggucuaacccaaaaagcaagcugcagauuaauaggcaagugauaguagacaaagggaaccggucaggauacaguggcaucuuuuccguugaggguaagagcuguauuaaucguugcuucuauguggaacuaauccgcgggagaaaggaggaaaccgagguccucuggacaucuaacucaaucguggucuucuguggcaccaguggaacuuacggcacagggagcuggcccgauggagccgaccugaaucuuaugccuauuuga

SEQ ID NO: 143826 - RNA, 1410 nt, Artificial Sequence
  derived and/or modified sequence opt3 from neuraminidase__InfluenzaA__AFD98387
augaaccccaaucagaagaucauuaccauaggcagcgugucccugacaaucucuacuauuugcuuccucaugcagaucgccauucuuaucacgaccgucacacugcacuuuaaacaguacgaguucaacucaccuccaaauaaccagguuauguugugugaaccgacuauaaucgagagaaauauuaccgaaaucguguauuuaacaaacaccacuauugagaaggaaaucugccccaaacuggcugaguacagggacuggaguaagccucagugugauauaacaggguuugcaccauucagcaaagacaauuccauucggcuaucugccggaggugauaucuggguaacccgcgagcccuaugugucgugcgacccugauaaguguuaccaauuugcgcucggccaggggacgacucugaacaauguccauucaaacaauaccgugcgagaccguacaccauauagaacucuucugaugaacgaauugggaguucccuuccaccucggcaccaaacaggugugcauugcuuggagcaguuccucuugucaugaugguaaggccuggcugcacgucugcaucacaggggacgauaagaaugcaaccgccagcuuuaucuacaacggaaaacugguggacuccguaguuucauggaguaaggagauucucaggacgcaggaaagcgagugugugugcauaaauggcacuuguacagucgugaugaccgauggcucugcuuccgggaaagcagacacuaagaucuuauucauugaggaaggaaagaucgugcauacaucaacccugagcgguagugcccaacacgucgaggaaugcucuugcuauccucgguacccaggcguucgcugugugugcagagauaacuggaaaggguccaacaggccgauaguagacauuaauaucaaggaccacagcaucgugucgucuuacgucuguuccggacuugugggcgauacgccccggaaaaacgaccgcucaaguaauagccauugcuuggauccuaacaaugaggaaggugggcacggaguuaagggcugggcuuuugacgauggcaacgacguguggauggggcgaaccauuaaugagacauccagacugggauaugagacuuucaaagucaucgaagguuggucuaacccaaagagcaaacuacagauuaauaggcaagugauaguagaucggggcaaccguucaggguacaguggaaucuuuuccguugagggcaagagcuguauuaaucgcugcuucuauguggaacucaucagagguaggaaggaggaaaccgagguccuguggacaucuaacucaaucguggucuuuugugggaccaguggcacuuacggaacaggcagcuggcccgacggggccgaucuuaaucugaugccuauuuga

SEQ ID NO: 143827 - RNA, 1410 nt, Artificial Sequence
  derived and/or modified sequence opt3 from neuraminidase__InfluenzaA__AFD98398
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcacccgacaggugugcauugcuuggagcaguuccucuugucaugacgguaaggccuggcuccacgucugcaucacaggggaugacaaaaacgcaaccgccagcuucaucuacaauggacggcugguggauuccguaguuucauggaguaaggagauucugcgcacgcaggaaagcgagugugugugcauaaacggcacuuguacagucgugaugaccgacggcucugcuuccgggaaagcagauacuaagauccucuuuauugaggaaggaaaaaucgugcauacaucaaccuuaagcgguagugcccaacacgucgaggaaugcucuugcuauccuagauacccaggcguuaggugugugugccgggacaacuggaagggguccaaucgcccgauaguagauauuaacaucaaggaccacagcaucgugucgucuuacgucuguuccggacuggugggcgacacgcccaggaaaaaugauucaaguagcuccucucauugccuugacccuaacaaugaggaaggugggcacggaguuaagggcugggcuuucgaugacggcaacgauguguggauggggagaaccauuaaugagacaagcagguugggauaugagacuuuuaaagucaucgaagguuggucaaacccaaagaguaaacugcagauuaaucgucaggugauaguagacaagggcaaccgguccggguacagcggaaucuucucuguugagggcaaaucauguauuaaucgcugcuuuuauguggaacuaaucagagguaggaaggaggaaaccgagguccucuggacaaguaacagcaucguggucuucugugggacuuccggcaccuacggaacaggcucuuggcccgauggggccgaccugaaucuuaugccuauuuga

SEQ ID NO: 143828 - RNA, 1410 nt, Artificial Sequence
  derived and/or modified sequence opt3 from neuraminidase__InfluenzaA__AFD98409
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccggucauugccuugacccuaacaaugaggaagggggacacggcguuaaaggcugggcuuucgaugacgggaacgauguguggaugggacgaaccauuaaugagacaucuagauuggguuaugagacuuuuaaggucaucgaaggcuggagcaacccaaaaucaaagcugcagauuaauaggcaagugauaguagacaaagggaaccggaguggauacuccggcaucuucagcguugaggguaagucuuguauuaaucguugcuuuuauguggaacuaauccgcgggagaaaggaggaaaccgagguccucuggacaucaaacaguaucguggucuucuguggcacuagcggaaccuacggcacaggguccuggcccgauggagccgaccugaaucuuaugccuauuuga

SEQ ID NO: 143829 - RNA, 1410 nt, Artificial Sequence; identical to SEQ ID NO: 143803
  derived and/or modified sequence opt3 from neuraminidase__InfluenzaA__AFD98420

SEQ ID NO: 143830 - RNA, 1410 nt, Artificial Sequence
  derived and/or modified sequence opt3 from neuraminidase__InfluenzaA__AFD98431
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuaaugagacaagcagauugggauaugagacuuuuaaggucaucgaagguuggucaaacccaaaaaguaagcugcagauuaauaggcaagugauaguaggccgggggaaccguuccggauacagcggcaucuucucuguugaggguaaaucauguauuaaucgcugcuuuuauguggaacuaaucagagggaggaaggaggaaaccgagguccucuggacaaguaacagcaucguggucuucuguggcacuuccggaaccuacggcacagggucuuggcccgacggagccgaucugaaucuuaugccuauuuga

SEQ ID NO: 143831 - RNA, 1410 nt, Artificial Sequence
  derived and/or modified sequence opt3 from neuraminidase__InfluenzaA__AFD98442
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucugacggccaggcuuccuacaaaauuuuucggaucgaaaaggguaaaauugucaagucaguggagaugaaugcccccaacuaucauuacgaagagugcaguuguuacccugauagcggggagauaacuugcgugugccgcgacaauuggcacggauccaacagaccaugggucucuuucaaucagaaccucgaauaucagaucggcuacauuuguagcggcaucuuuggggauaauccgaggcccaacgacaaaaccggaucaugcgguccuguuaguuccaauggcgcgaacggggugaagggauucagcuuuaaguauggcaacgguguauggaucgggcggacaaaaucuauuucaagucgcaagggcuucgagaugauaugggauccaaauggauggaccggcacggacaacaauuuugcaaucaaacaagacauuguggggaucaacgaauggagcggauacuccgguucuuucguccagcaucccgagcugacuggccuggauuguauucgaccuugcuucuggguggaacucaucagagggaggccaaaggagaauacaauauggaccucgggaagcuccaucucauuuuguggcguuaacagugacacuguggguuggucuuggcccgauggggccgaguuaccguucacaauugacaaauga

SEQ ID NO: 143832 - RNA, 1410 nt, Artificial Sequence
  derived and/or modified sequence opt3 from neuraminidase__InfluenzaA__AFD98452
augaaccccaaucagaagaucauuacccugggcagcgugucccucacaauaucuacuaucugcuucuuuauucagaucgccauucuuaucacgaccgucacacugcacuucaaacaguacgaguuuaacucaccuccaaauaaccagguuauguugugugaaccgacuauaaucgagagaaauauuaccgaaaucguguauuuaacaaacaccacuauugagaaggaaaucugccccaaacuggcugaguacaggaauuggaguaagccucagugugacauaacaggguucgcaccauuuagcaaagauaacuccauucggcuaucugccggaggugacaucuggguaacccgcgagcccuaugugucgugcgauccugacaaguguuaccaauucgcgcucggccaggggacgacucugaauaacguccauucaaauaacaccgugcgagaucguacaccauauagaacucuucugaugaaugaauugggaguucccuuucaccucggcaccaaacaggugugcauugcuuggagcaguuccucuugucaugacgguaaggccuggcugcacgucugcaucacaggggaugacaagaacgcaaccgccagcuucaucuacaauggaaggcugguggauuccguaguuucauggaguaaagagauucuccggacgcaggaaagcgagugugugugcauaaacggcacuuguacagucgugaugaccgacggcucugcuuccgggaaggcagauacuaaaaucuuauuuauugaggaaggaaagaucgugcauacaucaacccugagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuugugggcgacacgccccgcaagaaugauucaaguagcuccucucauugcuuggacccuaacaaugaggaaggugggcacggaguuaaaggcugggcuuucgaugacggcaacgauguguggauggggcgaaccauuaaugagacaagcagacugggauaugagacuuuuaaggucaucgaagguuggucaaacccaaaaaguaagcuacagauuaauaggcaagugauaguagaccggggcaaccguuccggguacagcggaaucuucucuguugagggcaaaucauguauuaaucgcugcuuuuauguggaacucaucagagguaggaaggaggaaaccgagguccuguggacaaguaacagcaucguggucuucugugggacuuccggcaccuacggaacaggcucuuggcccgauggggccgaccuuaaucugaugccuauuuga

SEQ ID NO: 143833 - RNA, 1410 nt, Artificial Sequence; identical to SEQ ID NO: 143803
  derived and/or modified sequence opt3 from neuraminidase__InfluenzaA__AFD98463

SEQ ID NO: 143834 - RNA, 1410 nt, Artificial Sequence
  derived and/or modified sequence opt3 from neuraminidase__InfluenzaA__AFD98474
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcaagggguucgagaugauaugggauccaaauggcuggaccggaacggacaacaauuuuuccaucaaacaagacauuaucggcauuaacgaauggucuggguacucggggagcuucgugcagcaucccgagcugacuggucuggauuguauccgaccuugcuucugggucgaacucauaagaggcaggccaaaggagaauacaaucuggaccuccgggucaaguauuucuuuuuguggagugaacagcgacacuguuggcugguccuggcccgauggugcagaguuaccguucacaaucgacaaauga

SEQ ID NO: 143835 - RNA, 1410 nt, Artificial Sequence
  derived and/or modified sequence opt3 from neuraminidase__InfluenzaA__AFD98484
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuaaugagacaagcagauugggauaugagacuuuuaaggucaucgaagguuggucaaacccaaaaaguaagcugcagaugaauaggcaagugauuguagaccggggcaaccguuccggguacagcggaauauucucuguugagggcaaaucauguaucaaucgcugcuuuuauguggaacuaauuagagguaggaaggaggaaaccgagguccucuggacaaguaacagcaucguggucuucugugggacuuccggcaccuacggaacaggcucuuggcccgauggggccgaccugaaucuuaugccuaucuga

SEQ ID NO: 143836 - RNA, 1410 nt, Artificial Sequence
  derived and/or modified sequence opt3 from neuraminidase__InfluenzaA__AFD98495
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaaacugguggauuccguaguuucauggaguaaggagauucugaggacgcaggaaagcgagugugugugcauaaacggcacuuguacagucgugaugaccgacggcucugcuuccgggaaagcaaacacuaagauccucuuuauugaggaaggaaagaucgugcauacaucaaccuuaagcgguagugcccaacacgucgaggaaugcucuugcuauccucgguacccaggcguucgcugugugugcagagauaauuggaaaggguccaacaggccgauaguagacauuaauaucaaggaucacagcaucgugucgucuuacgucuguuccggacuggugggcgacacgccccggaaaaacgacucaaguagcuccucucauugccuugauccuaauaacgaggaaggugggcacggaguuaagggcugggcuuucgacgauggcaaugacguguggauggggcgcaccauuaacgagacaagccgauugggauaugagacuuuuaaagucaucgaagguuggucaaauccaaagaguaaacugcagauuaacagacaggugauaguagauaggggcaaucgguccggguacagcggaaucuucucuguugagggcaagucauguauuaaccguugcuuuuauguggaacuaauccgcgguagaaaggaggaaaccgagguccucuggacaaguaauagcaucguggucuucugugggacuuccggcaccuacggaacaggcucuuggcccgacggggccgaucugaaccuuaugccuauuuga

SEQ ID NO: 143837 - RNA, 1410 nt, Artificial Sequence; identical to SEQ ID NO: 143803
  derived and/or modified sequence opt3 from neuraminidase__InfluenzaA__AFD98506

SEQ ID NO: 143838 - RNA, 1410 nt, Artificial Sequence
  derived and/or modified sequence opt3 from neuraminidase__InfluenzaA__AFD98517
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaaacugguggauuccguaguuucauggaguaaggagauucugaggacgcaggaaagcgagugugugugcauaaacggcacuuguacagucgugaugaccgacggcucugcuuccgggaaagcagauacuaagauccucuuuauuaaggagggaaaaaucgugcauacaucaaccuuaagcgguagugcccaacacgucgaagagugcucuugcuauccucgguacccaggcguucgcugugugugcagagacaacuggaagggguccaauaggccgauaguagauauuaacaucaaagaccacagcaucgugucgucuuacgucuguuccggacuggugggcgacacgccccggaagaaugauucaaguagcuccucucauugccuugacccuaacaaugaagagggugggcacggaguuaaaggcugggcuuucgaugacggcaacgauguguggauggggcgcaccauuaaugaaacaagccgauugggauaugagacuuuuaaggucaucgaggguuggucaaacccaaaaaguaagcugcagauuaauagacaggugauaguagacaggggcaaccgguccggguacagcggaaucuucucuguugaaggcaagucauguauuaaucguugcuuuuauguggagcuaauccgcgguagaaaagaagagaccgaaguccucuggacaaguaacagcaucguggucuucugugggacuuccggcaccuacggaacaggcucuuggcccgauggggccgaccugaaucuuaugccuauuuga

SEQ ID NO: 143839 - RNA, 1410 nt, Artificial Sequence; identical to SEQ ID NO: 141534
  derived and/or modified sequence opt3 from neuraminidase__InfluenzaA__AFD98528

SEQ ID NO: 143840 - RNA, 1410 nt, Artificial Sequence; identical to SEQ ID NO: 143803
  derived and/or modified sequence opt3 from neuraminidase__InfluenzaA__AFD98539

SEQ ID NO: 143841 - RNA, 1410 nt, Artificial Sequence; identical to SEQ ID NO: 143803
  derived and/or modified sequence opt3 from neuraminidase__InfluenzaA__AFD98550

SEQ ID NO: 143842 - RNA, 1410 nt, Artificial Sequence
  derived and/or modified sequence opt3 from neuraminidase__InfluenzaA__AFD98561
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuugugcugucgugaugacagacggcucugcauccgggaaggccgauaccaaaauccucuuuauugaggaaggaaagaucgugcauacuucaacauuaagcgguagugcucaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacccccaggaagucagauaguagcuccucuagccauugccuugacccuaauaacgaggaaggugggcacggaguuaaaggcugggccuucgaugacggcaaugauguguggauggggcgaacgauuaacgagaccucaagauugggauaugagacauuuaaggucaucgaagguuggaguaauccaaaauccaagcugcagauuaaccgccaggugauaguagaccggggcaaucguagcggguacucuggaaucuucucaguugagggcaaaaguuguauuaaccgcugcuuuuauguggaacuaaucagagguaggaaggaggaaacugagguccucuggaccagcaauuccaucguggucuucugugggacaucuggcacuuacggaaccggcucguggcccgauggggcggaccugaaccuuaugccuauuuga

SEQ ID NO: 143843 - RNA, 1410 nt, Artificial Sequence
  derived and/or modified sequence opt3 from neuraminidase__InfluenzaA__AFD98572
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuuuagagaaggaaauuugccccaaacuggcugaguacaggaauuggaguaagccucagugugacaucacaggguucgcaccauuuagcaaagauaacuccauacggcuaucugccggaggugacauuuggguaacccgcgagcccuaugugucgugcgauccugacaaguguuaccaauucgcgcucggccaggggacgacucugaauaacguccauucaaauaacaccgugcgagaucguacaccauauagaacucuucugaugaaugaauugggaguucccuuucaccucggcaccaaacaggugugcaucgcuuggagcaguuccucuugucaugacgguaaggccuggcugcacgucugcauuacaggggaugacaagaacgcaaccgccagcuucaucuacaauggaaggcugguggauuccguaguuucauggaguaaagagauccuccggacgcaggaaagcgagugugugugcauuaacggcacuuguacagucgugaugaccgacggcucugcuuccgggaaggcagauacuaaaauauuauuuaucgaggaaggaaagauugugcauacaucaacccugagcgguagugcccaacacgucgaggaaugcucuugcuauccucgcuacccaggcguuagaugugugugcagggacaacuggaagggguccaaucggccgaucguagauauaaacauuaaagaccacagcaucgugucgucuuacgucuguuccggacuugugggcgacacgccccgcaagaaugauucaaguagcuccucucauugcuuggacccuaacaaugaggaaggugggcacggaguuaaaggcugggcuuucgaugacggcaacgauguguggauggggcgaaccaucaaugagacaagcagacugggauaugagacuuuuaaggucauugaagguuggucaaacccaaaaaguaagcuacagaucaauaggcaagugauuguagaccggggcaaccguuccggguacagcggaauauucucuguugagggcaaaucauguaucaaucgcugcuuuuauguggaacucauuagagguaggaaggaggaaaccgagguccuguggacaaguaacagcaucguggucuucugugggacuuccggcaccuacggaacaggcucuuggcccgauggggccgaccuuaaucugaugccuaucuga

SEQ ID NO: 143844 - RNA, 1410 nt, Artificial Sequence
  derived and/or modified sequence opt3 from neuraminidase__InfluenzaA__AFD98583
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagccgggauaacuccauucgccugucugccggaggugacaucuggguaacccgagagcccuaugugucgugcgauccugacaaauguuaccaauucgcgcuaggccaggggacgacucucaauaacguccauucaaauaacaccgugcgugauagaacaccauauaggacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggacggcugguggauuccguaguuucauggaguaaggagauucugcgcacgcaggaaagcgagugugugugcauaaacggcacuuguacagucgugaugaccgacggcucugcuuccgggaaagcagauacuaagauccucuuuauugaggaaggaaaaaucgugcauacaucaaccuuaagcgguagugcccaacacgucgaggaaugcucuugcuauccuagauacccaggcguuaggugugugugccgggacaacuggaagggguccaaucgcccgauaguagauauuaacaucaaggaccacagcaucgugucgucuuacgucuguuccggacuggugggcgacacgccccgaaaaucagauaguagcuccucuagccauugccuugacccuaauaacgaggaaggugggcacggaguuaagggcugggcuuucgaugacggcaaugauguguggauggggagaaccauuaacgagacaucaagguugggauaugagacuuuuaaagucaucgaagguuggaguaauccaaaguccaaacugcagauuaaccgucaggugauaguagaccggggcaaucgcagcggguacucuggaaucuucucaguugagggcaagaguuguauuaacagaugcuuuuauguggaacuaaucaggggucggaaagaggaaaccgagguccucuggacaagcaauuccaucguggucuucugugggacuucuggcaccuacggaacaggcucguggcccgauggggccgaccugaaccuuaugccuauuuga

SEQ ID NO: 143845 - RNA, 1410 nt, Artificial Sequence
  derived and/or modified sequence opt3 from neuraminidase__InfluenzaA__AFE02944
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucugaacuguauccgaccuugcuucuggguugaacucauuagaggcaggccaaaagagaauacaguguggaccuccgggucaaguaucucuuuuuguggagucaacagcgauacugugggcugguccuggcccgacggugcagaguuaccguucacaauagauaaguga

SEQ ID NO: 143846 - RNA, 1410 nt, Artificial Sequence
  derived and/or modified sequence opt3 from neuraminidase__InfluenzaA__AFE47627
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccucacugagcgggagugcucaacacguggaggaaugcucuuguuauccucgguacccaggaguccgcugcguuuguagagacaacuggaagggcuccaauaggccgaucguggauauaaacguaaaagacuacagcauugugucgucuuaugucugcuccggucuugugggggacacgccccggaagaaugauucaaguagcuccucucauuguuuggacccuaacaaugaggaaggaggccacggcguuaaagggugggccuucgaugacggaaacgauguguggaugggucgcaccaucagcgagaagcugcgaucaggcuacgagaccuuuaaagucaucgaaggguggaguaagccaaauuccaaacuacagacaaacagacaggugauuguagacaggggaaaucggagcggcuauucugguaucuucucaguugagaguaagagcugcauuaaccguuguuuuuacguggaacucauacgcgggagaaagcaggagacugaaguccuguggaccuccaauucuaucguggucuucugcggcacaucgggaacuuauggcaccgggagcuggcccgauggagcggacauuaaccuuaugccuaucuga

SEQ ID NO: 143847 - RNA, 1410 nt, Artificial Sequence; identical to SEQ ID NO: 143159
  derived and/or modified sequence opt3 from neuraminidase__InfluenzaA__AFF18509

SEQ ID NO: 143848 - RNA, 1410 nt, Artificial Sequence
  derived and/or modified sequence opt3 from neuraminidase__InfluenzaA__AFF57129
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcaagggguucgagaugauaugggauccaaauggcuggaacggaaccgacaauaacuuuuccaucaaacaagacauugugggcaucaaugaauggucuggguacucggggagcuucguccagcaucccgagcugacgggucuggauuguauucgaccuugcuucuggguggaacucaucagaggcaggccaaaggagaacacuauauggacauccgggucaaguaucucuuuuuguggaguuaauagcgacaccgugggcugguccuggcccgauggugcagaguuaccguucacuauugacaaauga

SEQ ID NO: 143849 - RNA, 1410 nt, Artificial Sequence
  derived and/or modified sequence opt3 from neuraminidase__InfluenzaA__AFF57133
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggcugaaccagacauauguuaauaucuccaacacuaauuucgcugcaggccagucugugguaucggugaaauuggccgggaacucaucauuaugcccugucaguggaugggcgauauacuccaaggacaauucuauuagaaucggcagcaaaggugauguguuuguuauuagggagccauucaucuccuguucaccgagugaaugccggaccuuuuuccugacacagggggcucuacucaacgacaagcauagcaauggaaccaucaaagaucgcucucccuaucgaacucugauguccuguccuauuggcgaggugccaucacccuacaacagccguuuugaaagugucgccuggucugcauccgccugccacgacggcauaaacuggcuuacaaucgggauuagcggaccugauaauggugcuguggcaguacugaaguauaacggcaucauaaccgacacgauuaagucguggagaaauaacaucuugaggacucaagagucugagugugccugcguuaauggguccuguuucaccaucaugacagauggaccaucagacggccaggcuaguuacaaaauuuuucggaucgaaaaggguaaaauugucaagagcguggagaugaacgcccccaauuaucauuacgaagagugcuccuguuacccugauucuagcgagauaacuugcgugugccgcgacaacuggcacgggucaaauagaccaugggugaguuucaaccagaaucucgaauaucagaucggauacauuuguuccggcaucuuuggcgauaacccgaggcccaaugacaaaaccgggagcugcggaccugucucuucaaacggugcgaauggcguuaagggguucaguuuuaaguauggaaacggcguguggaucggucggacaaaaagcauuuccucucgcaagggguucgagaugauaugggauccaaacggcuggaccggaacggacaauaacuuuucgaucaaacaagacauuguaggcaucaaugaauggagcggguacuccggaucauucgugcagcaucccgagcugacuggucuggauuguauucgaccuugcuucugggucgaacucaucagaggcaggccaaaggagaacacaauauggaccagugggucuagcaucuccuuuuguggagugaauagcgacacuguuggcuggagcuggcccgauggugcagaguuaccguucacaauugacaaauga

SEQ ID NO: 143850 - RNA, 1410 nt, Artificial Sequence; identical to SEQ ID NO: 138909
  derived and/or modified sequence opt3 from neuraminidase__InfluenzaA__AFF57137

SEQ ID NO: 143851 - RNA, 1410 nt, Artificial Sequence; identical to SEQ ID NO: 138909
  derived and/or modified sequence opt3 from neuraminidase__InfluenzaA__AFF57141

SEQ ID NO: 143852 - RNA, 1410 nt, Artificial Sequence; identical to SEQ ID NO: 138909
  derived and/or modified sequence opt3 from neuraminidase__InfluenzaA__AFF57145

SEQ ID NO: 143853 - RNA, 1410 nt, Artificial Sequence; identical to SEQ ID NO: 138909
  derived and/or modified sequence opt3 from neuraminidase__InfluenzaA__AFF57149

SEQ ID NO: 143854 - RNA, 1410 nt, Artificial Sequence; identical to SEQ ID NO: 138909
  derived and/or modified sequence opt3 from neuraminidase__InfluenzaA__AFF57153

SEQ ID NO: 143855 - RNA, 1410 nt, Artificial Sequence; identical to SEQ ID NO: 138909
  derived and/or modified sequence opt3 from neuraminidase__InfluenzaA__AFF57157

SEQ ID NO: 143856 - RNA, 1410 nt, Artificial Sequence; identical to SEQ ID NO: 138909
  derived and/or modified sequence opt3 from neuraminidase__InfluenzaA__AFF57161

SEQ ID NO: 143857 - RNA, 1410 nt, Artificial Sequence; identical to SEQ ID NO: 138909
  derived and/or modified sequence opt3 from neuraminidase__InfluenzaA__AFF57165

SEQ ID NO: 143858 - RNA, 1410 nt, Artificial Sequence; identical to SEQ ID NO: 138909
  derived and/or modified sequence opt3 from neuraminidase__InfluenzaA__AFF57169

SEQ ID NO: 143859 - RNA, 1410 nt, Artificial Sequence; identical to SEQ ID NO: 138909
  derived and/or modified sequence opt3 from neuraminidase__InfluenzaA__AFF57173

SEQ ID NO: 143860 - RNA, 1410 nt, Artificial Sequence; identical to SEQ ID NO: 138909
  derived and/or modified sequence opt3 from neuraminidase__InfluenzaA__AFF57177

SEQ ID NO: 143861 - RNA, 1410 nt, Artificial Sequence; identical to SEQ ID NO: 138909
  derived and/or modified sequence opt3 from neuraminidase__InfluenzaA__AFF57181

SEQ ID NO: 143862 - RNA, 1410 nt, Artificial Sequence; identical to SEQ ID NO: 138909
  derived and/or modified sequence opt3 from neuraminidase__InfluenzaA__AFF57185

SEQ ID NO: 143863 - RNA, 1410 nt, Artificial Sequence; identical to SEQ ID NO: 138909
  derived and/or modified sequence opt3 from neuraminidase__InfluenzaA__AFF57189

SEQ ID NO: 143864 - RNA, 1350 nt, Artificial Sequence
  derived and/or modified sequence opt3 from neuraminidase__InfluenzaA__AFF60789
augaaccccaauaagaaaaucauuaccauaggcagcaucugcauggugacagggauggucucccugaugcuccagauuggaaaccuuaucucuauuuggguuucacacaguauccauacugguaaucaacacaaggccgagccuauaagcaacacgaauuuccugaccgaaaaagcuguggcauccguaaaguuggccggcaacucuucguuauguccaaucaaugggugggcgguguacucaaaagacaacagcauuagaaucggaaguaagggcgaugucuuugugauuagggagccguucaucuccugcucucaucuggaaugucggacauuuuuccuaacucagggugcucuccugaaugacaagcacagcaacgggaccguuaaagaucgcucaccccaucgaacacuuauguccugcccugugggagaggccccaagucccuauaauagccguuuugaaucugucgcaugguccgccucagcuugucacgacggcaccagcuggcugacuauaggcauuagugggccugauaacggagcaguggccguauugaaguacaaugguaucauuacagacaccaucaaaucuuggagaaacaauauccucaggacgcaggaguccgagugcgcuuguguuaacggcagcugcuucacugugaugaccgaugggccaucgaacggacaggccucucacaagauuuuuaaaauggaaaagggcaaggucgugaaauccguggagcuggacgcgcccaauuaucauuacgaagaguguucaugcuauccugaugccggugagauaacaugugucugccgggacaacuggcacgggaguaaucgcccauggguuagcuucaaccaaaaucuggaauaccagaucggauauauuugcuccggcguguuuggcgauaacccgagacccaaugacgggacuggaucuugugguccuguaagcucaaacggcgcauacggggugaagggauucaguuuuaaauacggcaauggugucuggaucgggaggaccaaguccacaaacagccggucuggcuucgagaugauaugggauccaaauggauggaccgaaacggacucaaguuuuagcgugaaacaggacauuguugcuaucacugauugguccggcuauucugggucguucgugcagcaucccgagcucacaggauuagacugcauccgcccuuguuucugggucgaacugauucgagguagaccaaaggagagcaccaucuggacuuccggcucaaguauuucuuuuugcggggugacaagcgauaccguaggaugguccuggcccgacggcgccgagcuuccguucacgauagauaaauga

SEQ ID NO: 143865 - RNA, 1410 nt, Artificial Sequence
  derived and/or modified sequence opt3 from neuraminidase__InfluenzaA__AFG29043
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccauccgcgaucgaagucccuaucguacucugaugagcuguccuauuggcgaggucccaucucccuacaacuccagauuugaaucaguggccuggagcgcaagugccugccacgacggcauaaauuggcuuacaaucgggauuucuggaccugauaacggugcuguagcaguucugaaauauaauggcaucauaaccgacacgauuaaguccuggaggaacaauaucuugcggacucaagagagcgagugugccugcgugaacgggucguguuucaccgucaugacagauggaccaucugacggccaggcuuccuacaagaucuuucgcauugaaaaagguaagaucgugaaaucaguggagaugaaugcccccaacuaucauuacgaagagugcaguuguuacccugauagcuccgagauuacuugcgucugcagagacaauuggcacgggucuaacaggccauggguuagcuucaaucagaaccucgaauaucagauaggauacaucuguucaggcauuuuuggcgauaauccgcggcccaacgacaagaccgggaguugcggaccuguguccagcaauggugcgaacggcguaaaaggguucucuuuuaaguauggaaacggcguguggaucggucgcacaaagucaaucaguagccgaaauggguucgagaugauuugggauccaaacggcuggaccggaacggacaauaacuuuuccauaaaacaagacaucgucggcauuaaugaauggucuggguacucggggagcuucgugcagcaucccgagcugacuggucuggauuguaucagaccuugcuucuggguugaacucauuaggggccggccaaaggagaacacaaucuggaccuccgggucaaguauaucuuuuuguggagugaauagcgacacugucggcugguccuggcccgauggugcagaguuaccguucacaaucgacaaauga

SEQ ID NO: 143866 - RNA, 1410 nt, Artificial Sequence; identical to SEQ ID NO: 140535
  derived and/or modified sequence opt3 from neuraminidase__InfluenzaA__AFG29045

SEQ ID NO: 143867 - RNA, 1410 nt, Artificial Sequence; identical to SEQ ID NO: 140667
  derived and/or modified sequence opt3 from neuraminidase__InfluenzaA__AFG31063

SEQ ID NO: 143868 - RNA, 1410 nt, Artificial Sequence; identical to SEQ ID NO: 138754
  derived and/or modified sequence opt3 from neuraminidase__InfluenzaA__AFG31073

SEQ ID NO: 143869 - RNA, 1410 nt, Artificial Sequence
  derived and/or modified sequence opt3 from neuraminidase__InfluenzaA__AFG31083
augaaccccaaucagaagaucauuaccauaggcagcgugugcaugacaaucgggauggccaaccugauucuccaaaucggaaauauuaucuccauauggaucucucacucaauucagcuugucaaccagaaucagaucgagacuuguaaccaaaguguuauuacguacgaaaauaacaccugggugaaucagacauauguaaacaucagcaauacuaacuucgcugcaggucaguccguggucucugugaaacuggccggcaauucgucauugugcccuguuagcgggugggcgauauacaguaaggacaacuccgugagaauuggaucuaaaggcgaugucuuugugaucagggagccauucauuagcuguuccccguuagaaugccggaccuuuuuccugacacagggugcucuacucaaugacaagcauucaaacgggaccaucaaagaucgcagucccuaucgaacucugaugagcuguccuaucggagagguaccaucucccuacaacucccguuuugaaucaguugccuggagcgcaagugccugccacgacggcauuaauuggcuuacaauaggcaucucugggccugauaacggagcuguggcaguccugaaguauaaugguauuaucaccgacacgauaaaguccuggagaaacaauauuuugaggacucaagagagcgagugugccugcgugaacggcucguguuucaccgugaugacagaugggccaucuaauggacaggcuuccuacaaaaucuuucggaucgaaaagggcaaaauugucaagucaguugagaugaacgcccccaauuaucauuacgaagagugcaguuguuacccugacagcuccgagaucacuugcgugugccgcgauaacuggcacgguucuaauagaccaugggugagcuucaaccagaaucucgaauaucagauuggguacauauguucaggaaucuuuggcgacaacccgaggcccaaugauaaaaccggcaguugcgggccuguauccagcaacggagcgaacggugucaagggcuucucuuuuaaguaugggaauggaguguggauuggccggacaaaaucaaucaguagccgcaacgguuucgagaugaucugggacccaaauggguggaccggcacggauaacaauuuuuccauuaagcaagacauaguuggaaucaacgaauggucuggcuacucggggagcuucgugcagcaucccgagcugacuggacuggacuguauucgaccuugcuucugggucgaacucaucagagguaggccaaaagagaauacaauuuggaccuccggcucaaguaucucuuuuuguggggugaacagcgauacuguaggaugguccuggcccgacggcgcagaguuaccguucacaauagauaaguga

SEQ ID NO: 143870 - RNA, 1410 nt, Artificial Sequence; identical to SEQ ID NO: 138754
  derived and/or modified sequence opt3 from neuraminidase__InfluenzaA__AFG31093

SEQ ID NO: 143871 - RNA, 1410 nt, Artificial Sequence; identical to SEQ ID NO: 138754
  derived and/or modified sequence opt3 from neuraminidase__InfluenzaA__AFG31103

SEQ ID NO: 143872 - RNA, 1410 nt, Artificial Sequence; identical to SEQ ID NO: 138754
  derived and/or modified sequence opt3 from neuraminidase__InfluenzaA__AFG31113

SEQ ID NO: 143873 - RNA, 1410 nt, Artificial Sequence; identical to SEQ ID NO: 138754
  derived and/or modified sequence opt3 from neuraminidase__InfluenzaA__AFG31123

SEQ ID NO: 143874 - RNA, 1410 nt, Artificial Sequence; identical to SEQ ID NO: 138754
  derived and/or modified sequence opt3 from neuraminidase__InfluenzaA__AFG31133

SEQ ID NO: 143875 - RNA, 1410 nt, Artificial Sequence; identical to SEQ ID NO: 138754
  derived and/or modified sequence opt3 from neuraminidase__InfluenzaA__AFG31143

SEQ ID NO: 143876 - RNA, 1410 nt, Artificial Sequence; identical to SEQ ID NO: 138754
  derived and/or modified sequence opt3 from neuraminidase__InfluenzaA__AFG31153

SEQ ID NO: 143877 - RNA, 1410 nt, Artificial Sequence; identical to SEQ ID NO: 138754
  derived and/or modified sequence opt3 from neuraminidase__InfluenzaA__AFG31163

SEQ ID NO: 143878 - RNA, 1410 nt, Artificial Sequence
  derived and/or modified sequence opt3 from neuraminidase__InfluenzaA__AFG31173
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcuuaccaaaagagaacacaaucuggaccuccgggucaaguauaucuuuuuguggagugaauagcgacacugucggcugguccuggcccgauggugcagagcugccguucacaaucgacaaguga

SEQ ID NO: 143879 - RNA, 1410 nt, Artificial Sequence; identical to SEQ ID NO: 143878
  derived and/or modified sequence opt3 from neuraminidase__InfluenzaA__AFG31183

SEQ ID NO: 143880 - RNA, 1410 nt, Artificial Sequence; identical to SEQ ID NO: 138754
  derived and/or modified sequence opt3 from neuraminidase__InfluenzaA__AFG31193

SEQ ID NO: 143881 - RNA, 1410 nt, Artificial Sequence; identical to SEQ ID NO: 138754
  derived and/or modified sequence opt3 from neuraminidase__InfluenzaA__AFG31203

SEQ ID NO: 143882 - RNA, 1410 nt, Artificial Sequence; identical to SEQ ID NO: 138754
  derived and/or modified sequence opt3 from neuraminidase__InfluenzaA__AFG31213

SEQ ID NO: 143883 - RNA, 1410 nt, Artificial Sequence; identical to SEQ ID NO: 138754
  derived and/or modified sequence opt3 from neuraminidase__InfluenzaA__AFG31223

SEQ ID NO: 143884 - RNA, 1410 nt, Artificial Sequence; identical to SEQ ID NO: 138754
  derived and/or modified sequence opt3 from neuraminidase__InfluenzaA__AFG31233

SEQ ID NO: 143885 - RNA, 1410 nt, Artificial Sequence
  derived and/or modified sequence opt3 from neuraminidase__InfluenzaA__AFG31243
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucguagcuggccaguccguggucucugugaaacuggcaggaaauucgucauugugcccuguuagcggaugggccauauacaguaaggacaacuccauuagaaucggcucuaaaggugauguguuugucauuagggagccauucaucagcuguuccccguuagaaugccggaccuuuuuccugacacagggggcgcuacucaaugacaagcauucaaacggaaccaucaaagaucgcagucccuaucgaacucugaugagcuguccuauuggcgaggugccaucucccuacaacucccguuuugaaucaguagcuuggagcgccagugcaugccacgacggcauaaauuggcuuacaaucgggauuucuggaccugauaacggugccguugcugugcugaaguauaauggcaucauaaccgacacgauuaaguccuggagaaacaauaucuugaggacucaagagagcgagugugcaugcgucaacgggucguguuucaccgugaugacagauggaccaucugacggccaggccuccuacaaaaucuuucggauugaaaaggguaaaaucgugaagucagucgagaugaaugcucccaacuaucauuacgaagagugcaguuguuacccugauagcuccgagauuacuugcguuugccgcgacaauuggcacgggucuaacagaccaugggugagcuucaaucagaaccucgaauaucagauaggauacaucuguucaggcauuuuuggcgauaauccgaggcccaacgacaaaaccgggaguugcggaccuguauccagcaauggugccaacggcgugaagggguucucuuuuaaguauggaaacggcgucuggaucggucggacaaaaucaaucaguagccgcaauggguucgagaugauuugggauccaaacggcuggaccggaacggacaauaacuuuuccauaaagcaagacaucgugggcauuaaugaauggucuggguacucggggagcuucguucagcaucccgagcugacuggucuggauuguauccgaccuugcuucuggguggaacucauuagaggcaggccaaaagagaacacaaucuggaccuccgggucaaguauaucuuuuuguggagucaauagcgacacugugggcugguccuggcccgauggugcggaguuaccguucacaaucgacaaguga

SEQ ID NO: 143886 - RNA, 1410 nt, Artificial Sequence; identical to SEQ ID NO: 141746
  derived and/or modified sequence opt3 from neuraminidase__InfluenzaA__AFG31253

SEQ ID NO: 143887 - RNA, 1410 nt, Artificial Sequence; identical to SEQ ID NO: 138754
  derived and/or modified sequence opt3 from neuraminidase__InfluenzaA__AFG31263

SEQ ID NO: 143888 - RNA, 1410 nt, Artificial Sequence; identical to SEQ ID NO: 138754
  derived and/or modified sequence opt3 from neuraminidase__InfluenzaA__AFG31273

SEQ ID NO: 143889 - RNA, 1410 nt, Artificial Sequence; identical to SEQ ID NO: 138754
  derived and/or modified sequence opt3 from neuraminidase__InfluenzaA__AFG31283

SEQ ID NO: 143890 - RNA, 1410 nt, Artificial Sequence; identical to SEQ ID NO: 138754
  derived and/or modified sequence opt3 from neuraminidase__InfluenzaA__AFG31293

SEQ ID NO: 143891 - RNA, 1410 nt, Artificial Sequence; identical to SEQ ID NO: 138754
  derived and/or modified sequence opt3 from neuraminidase__InfluenzaA__AFG31303

SEQ ID NO: 143892 - RNA, 1410 nt, Artificial Sequence; identical to SEQ ID NO: 138754
  derived and/or modified sequence opt3 from neuraminidase__InfluenzaA__AFG31313

SEQ ID NO: 143893 - RNA, 1410 nt, Artificial Sequence; identical to SEQ ID NO: 138754
  derived and/or modified sequence opt3 from neuraminidase__InfluenzaA__AFG31326

SEQ ID NO: 143894 - RNA, 1410 nt, Artificial Sequence; identical to SEQ ID NO: 138754
  derived and/or modified sequence opt3 from neuraminidase__InfluenzaA__AFG31336

SEQ ID NO: 143895 - RNA, 1410 nt, Artificial Sequence; identical to SEQ ID NO: 141746
  derived and/or modified sequence opt3 from neuraminidase__InfluenzaA__AFG31346

SEQ ID NO: 143896 - RNA, 1410 nt, Artificial Sequence; identical to SEQ ID NO: 141746
  derived and/or modified sequence opt3 from neuraminidase__InfluenzaA__AFG31356

SEQ ID NO: 143897 - RNA, 1410 nt, Artificial Sequence; identical to SEQ ID NO: 141746
  derived and/or modified sequence opt3 from neuraminidase__InfluenzaA__AFG31366

SEQ ID NO: 143898 - RNA, 1410 nt, Artificial Sequence; identical to SEQ ID NO: 141746
  derived and/or modified sequence opt3 from neuraminidase__InfluenzaA__AFG31379

SEQ ID NO: 143899 - RNA, 1410 nt, Artificial Sequence; identical to SEQ ID NO: 141746
  derived and/or modified sequence opt3 from neuraminidase__InfluenzaA__AFG31389

SEQ ID NO: 143900 - RNA, 1410 nt, Artificial Sequence; identical to SEQ ID NO: 141746
  derived and/or modified sequence opt3 from neuraminidase__InfluenzaA__AFG31399

SEQ ID NO: 143901 - RNA, 1410 nt, Artificial Sequence; identical to SEQ ID NO: 141746
  derived and/or modified sequence opt3 from neuraminidase__InfluenzaA__AFG31409

SEQ ID NO: 143902 - RNA, 1410 nt, Artificial Sequence; identical to SEQ ID NO: 138754
  derived and/or modified sequence opt3 from neuraminidase__InfluenzaA__AFG31419

SEQ ID NO: 143903 - RNA, 1410 nt, Artificial Sequence; identical to SEQ ID NO: 138754
  derived and/or modified sequence opt3 from neuraminidase__InfluenzaA__AFG31429

SEQ ID NO: 143904 - RNA, 1410 nt, Artificial Sequence; identical to SEQ ID NO: 138754
  derived and/or modified sequence opt3 from neuraminidase__InfluenzaA__AFG31439

SEQ ID NO: 143905 - RNA, 1410 nt, Artificial Sequence; identical to SEQ ID NO: 138754
  derived and/or modified sequence opt3 from neuraminidase__InfluenzaA__AFG31449

SEQ ID NO: 143906 - RNA, 1410 nt, Artificial Sequence; identical to SEQ ID NO: 138754
  derived and/or modified sequence opt3 from neuraminidase__InfluenzaA__AFG31459

SEQ ID NO: 143907 - RNA, 1410 nt, Artificial Sequence; identical to SEQ ID NO: 138754
  derived and/or modified sequence opt3 from neuraminidase__InfluenzaA__AFG31469

SEQ ID NO: 143908 - RNA, 1410 nt, Artificial Sequence; identical to SEQ ID NO: 138754
  derived and/or modified sequence opt3 from neuraminidase__InfluenzaA__AFG31479

SEQ ID NO: 143909 - RNA, 1410 nt, Artificial Sequence; identical to SEQ ID NO: 138754
  derived and/or modified sequence opt3 from neuraminidase__InfluenzaA__AFG31499

SEQ ID NO: 143910 - RNA, 1410 nt, Artificial Sequence; identical to SEQ ID NO: 140645
  derived and/or modified sequence opt3 from neuraminidase__InfluenzaA__AFG31509

SEQ ID NO: 143911 - RNA, 1410 nt, Artificial Sequence; identical to SEQ ID NO: 141746
  derived and/or modified sequence opt3 from neuraminidase__InfluenzaA__AFG31519

SEQ ID NO: 143912 - RNA, 1410 nt, Artificial Sequence; identical to SEQ ID NO: 138754
  derived and/or modified sequence opt3 from neuraminidase__InfluenzaA__AFG31529

SEQ ID NO: 143913 - RNA, 1410 nt, Artificial Sequence; identical to SEQ ID NO: 140645
  derived and/or modified sequence opt3 from neuraminidase__InfluenzaA__AFG31539

SEQ ID NO: 143914 - RNA, 1410 nt, Artificial Sequence; identical to SEQ ID NO: 138754
  derived and/or modified sequence opt3 from neuraminidase__InfluenzaA__AFG31549

SEQ ID NO: 143915 - RNA, 1410 nt, Artificial Sequence; identical to SEQ ID NO: 138754
  derived and/or modified sequence opt3 from neuraminidase__InfluenzaA__AFG31559

SEQ ID NO: 143916 - RNA, 1410 nt, Artificial Sequence; identical to SEQ ID NO: 141746
  derived and/or modified sequence opt3 from neuraminidase__InfluenzaA__AFG31569

SEQ ID NO: 143917 - RNA, 1410 nt, Artificial Sequence; identical to SEQ ID NO: 138754
  derived and/or modified sequence opt3 from neuraminidase__InfluenzaA__AFG31579

SEQ ID NO: 143918 - RNA, 1410 nt, Artificial Sequence; identical to SEQ ID NO: 138754
  derived and/or modified sequence opt3 from neuraminidase__InfluenzaA__AFG31589

SEQ ID NO: 143919 - RNA, 1410 nt, Artificial Sequence; identical to SEQ ID NO: 138754
  derived and/or modified sequence opt3 from neuraminidase__InfluenzaA__AFG31599

SEQ ID NO: 143920 - RNA, 1410 nt, Artificial Sequence; identical to SEQ ID NO: 138754
  derived and/or modified sequence opt3 from neuraminidase__InfluenzaA__AFG31609

SEQ ID NO: 143921 - RNA, 1410 nt, Artificial Sequence; identical to SEQ ID NO: 138754
  derived and/or modified sequence opt3 from neuraminidase__InfluenzaA__AFG31619

SEQ ID NO: 143922 - RNA, 1410 nt, Artificial Sequence; identical to SEQ ID NO: 138754
  derived and/or modified sequence opt3 from neuraminidase__InfluenzaA__AFG31629

SEQ ID NO: 143923 - RNA, 1410 nt, Artificial Sequence; identical to SEQ ID NO: 141746
  derived and/or modified sequence opt3 from neuraminidase__InfluenzaA__AFG31639

SEQ ID NO: 143924 - RNA, 1410 nt, Artificial Sequence; identical to SEQ ID NO: 138754
  derived and/or modified sequence opt3 from neuraminidase__InfluenzaA__AFG31649

SEQ ID NO: 143925 - RNA, 1410 nt, Artificial Sequence; identical to SEQ ID NO: 138754
  derived and/or modified sequence opt3 from neuraminidase__InfluenzaA__AFG31659

SEQ ID NO: 143926 - RNA, 1410 nt, Artificial Sequence; identical to SEQ ID NO: 138754
  derived and/or modified sequence opt3 from neuraminidase__InfluenzaA__AFG31669

SEQ ID NO: 143927 - RNA, 1410 nt, Artificial Sequence; identical to SEQ ID NO: 136111
  derived and/or modified sequence opt3 from neuraminidase__InfluenzaA__AFG71868

SEQ ID NO: 143928 - RNA, 1410 nt, Artificial Sequence; identical to SEQ ID NO: 136111
  derived and/or modified sequence opt3 from neuraminidase__InfluenzaA__AFG71890

SEQ ID NO: 143929 - RNA, 1410 nt, Artificial Sequence; identical to SEQ ID NO: 136111
  derived and/or modified sequence opt3 from neuraminidase__InfluenzaA__AFG71901

SEQ ID NO: 143930 - RNA, 1410 nt, Artificial Sequence; identical to SEQ ID NO: 136130
  derived and/or modified sequence opt3 from neuraminidase__InfluenzaA__AFG71912

SEQ ID NO: 143931 - RNA, 1410 nt, Artificial Sequence
  derived and/or modified sequence opt3 from neuraminidase__InfluenzaA__AFG71934
augaaccccaaucagaagaucauuaccauaggcagcgugucccugacaaucgccacugucugcuuccucaugcaaauugcuauccuuauuacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaucccacaucguacccugcuuaugaacgaacugggcguucccuuucacuuggguacaagacagguguguaucgccuggucaagcaguuccugccaugaugggaaggcauggcuccacgucugugugacuggagacgauaaaaaugccaccgcuucuuucauuuaugacggcaggcugguagauagcauaggcuccuggucacagaacauccugcggacacaagagagugaaugcguuuguauuaaugggaccugcacgguggucaugacugacggaagcgcaucuggucgcgccgauacaagaauccucuuuauagaggagggcaagauugugcacaucuccccuuuaucagggagcgcucagcauguggaagagugcaguuguuacccaagguauccgggaguccggugcaucugucgcgacaacuggaaaggcucuaaucgacccguuguggacauuaacguaaaggauuacuccaucgacagcagauacgugugcucgggucuggucggggauaccccuaggaacaaugaccgguucucuaacuccaauugucguaacccaaauaacgaacgcggaaaucacggcgugaagggcugggccuuugaugacgggaacgauguuuggaugggaagaacuauuucaaaagacaguaggagcgguuaugagacauucaaggugauaggcgggugguccacccccaauucuaaaagccagaucaaccggcaggucauuguggauucagacaaucgaaguggauacuccggcaucuuuagcguagaagguaagucuugcaucaaccgcuguuucuauguugagcuuauuagagggagggagcaagaaacgcgggugugguggaccucaaauaguauagucguguuuugcggcacaagcggaacuuacggcaccggguccuggccugauggagcggacaucaacuugaugccaauuuga

SEQ ID NO: 143932 - RNA, 1410 nt, Artificial Sequence
  derived and/or modified sequence opt3 from neuraminidase__InfluenzaA__AFG71945
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaaacaaucagguaaugccaugcgaaccgauuaucauagagagaaacaucacugaaauuguguauuugaccaauacaaccaucgagaaggaaauuugucccaaauuagucgaguacaggaacuggucaaagccucagugcaaaaucacuggguucgccccauuuaguaaggauaauagcauacggcuguccgcgggaggugacauuugggugacacgcgagcccuauguuucuugugauccuggcaagugcuaccaauucgcucuagggcagggaaccacgcucgacaacaaacauucgaaugauacuauccacgaccgaaucccacaucguacccugcuuaugaacgaacugggcgugcccuuucacuuggguacaagacaggucuguauugccuggucaagcaguuccugccaugaugggaaggcauggcuccacguguguguaacuggagacgaugagaaugccaccgcuucuuucaucuaugacggcaggcugguugauagcauuggcuccuggucacagaacauacugcggacacaagaaagugagugcguguguaucaaugggaccugcacggucgugaugacugacggaagcgcaucuggucgcgccgauacaaggauucucuuuaucgaggaaggcaaaauagugcacauuuccccuuuaucagggagcgcucagcaugucgaggaaugcaguuguuacccaagauauccgggaguucggugcaucugucgcgacaacuggaagggcucuaaucgacccgugguagacaucaacgugaaagauuacuccauugacagcagauacgucugcucgggucuggugggggauaccccuaggaacaaugacaagucuuccaacucaaauugucggaacccaaauaacgauaagggaaaucacggcguuaaaggcugggccuucgacgaugggaacgacguguggaugggacguacuaucaguaaggauagccgcuccgguuaugagacauuuaaagucauuggcggguggucuacccccaauagcaagucacagauaaacagacaggugaucguagacagugauaauagguccggauacagcggcauuuucucuguugaagguaaaucaugcaucaaccgguguuuuuauguggagcuuauccgagggcgcgagcaagaaacgaaggucugguggaccaguaauagcauuguggucuucugcggcacauccggaacuuacggcaccgggucuuggccugacggagcggacauaaacuugaugucgaucuga

SEQ ID NO: 143933 - RNA, 1410 nt, Artificial Sequence; identical to SEQ ID NO: 136134
  derived and/or modified sequence opt3 from neuraminidase__InfluenzaA__AFG71967

SEQ ID NO: 143934 - RNA, 1410 nt, Artificial Sequence; identical to SEQ ID NO: 136134
  derived and/or modified sequence opt3 from neuraminidase__InfluenzaA__AFG71978

SEQ ID NO: 143935 - RNA, 1410 nt, Artificial Sequence
  derived and/or modified sequence opt3 from neuraminidase__InfluenzaA__AFG71988
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaccccacaucguacacugcuuaugaacgaacugggcguucccuuucacuuggguacuagacagguguguaucgccuggucaagcaguuccugccaugaugggaaggcauggcuccacgucugugugaccggauaugacaaaaaugccacagcuucuuucaucuacgauggcaggcugguagacagcauuggcuccuggucacagaacauacugcggacccaagagagugaaugcaucuguauuaaugggacgugcacuguugugaugacagauggaagcgcaucuggucgcgccgacaccaagauccucuuuauagaggagggcaaaauuguccacaucuccccuuuaucagggagcgcucagcauguggaagagugcaguuguuauccaagauacccgggagugaggugcaucugucgggauaacuggaagggcucuaaucgccccgucguugacauuaacgugaaggacuacuccaucgauagcucguauguaugcucuggucuggugggggacacuccucgaaacaaugauagauccucaaacaguuacuguaggaauccaaacaaugaaaaaggaaaccacggcgucaagggcugggccuucgacgaugggaaugacguguggaugggacggacaauuagcgaggauucccguucugguuaugaaaccuuuaaaguuauaggcggguggagcacgcccaacucaaaacuucagaucaaucgccaggugauugucgacagugauaacagauccggauacagcggcaucuucucuguggaggguaagucaugcaucaauagguguuuuuauguagaguugauucgggggcgagaacaagagacccgcguuugguggacaaguaacagcauaguggucuucugcggcacuuccggaaccuacggcacagggucuuggccugacggagcggauaucaaucugaugccaauuuga

SEQ ID NO: 143936 - RNA, 1410 nt, Artificial Sequence; identical to SEQ ID NO: 136134
  derived and/or modified sequence opt3 from neuraminidase__InfluenzaA__AFG71999

SEQ ID NO: 143937 - RNA, 1410 nt, Artificial Sequence; identical to SEQ ID NO: 136592
  derived and/or modified sequence opt3 from neuraminidase__InfluenzaA__AFG72021

SEQ ID NO: 143938 - RNA, 1410 nt, Artificial Sequence
  derived and/or modified sequence opt3 from neuraminidase__InfluenzaA__AFG72032
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccaucauaaucgagagaaacauuacugaaaucguauauuugaccaauacaaccauugagaaggaaaucuguccuaaauuaguggaguacaggaacuggaguaagccacagugcaaaauaacuggguucgcacccuuuagcaaggacaauuccauucggcugucugccggaggugauaucugggucacacgcgagccuuaugugucgugugacccaggcaagugcuaccaauucgcgcuagggcagggaaccacgcucgauaacaaacauucaaaugacacuauucacgaucgaacccccuaucguacacugcuuaugaacgaacugggcguuccuuuucauuuggguacuagacagguguguaucgcuuggagcaguuccucuugccacgacgggaaggccuggcuccaugucugugugaccggauacgauaaaaaugcaacagccagcuucaucuaugacggcaggcugguagauuccauuggcucauggaguaagaacauacugcggacccaggagagcgaaugcguuuguaucaaugggacgugcacuguggucaugacagacggaucugcuuccgagcgcgcagauaccaaaauucucuuuaucgaggaagguaagauagugcacauuucaccauuaagcggcagugcccaacacguggaggaaugcucuuguuacccgagauaccccggggucaggugcguuugucgggacaacuggaagggauccaaucgcccugugguagauaucaacgugaaagacuauagcaucgucucgucuuacgugugcuccggccugguuggugacacuccacgaaagaacgauagaucaaguagcuccuauuguaggaaucccaacaaugagaaagggaaccauggagugaagggcugggcuuucgacgauggcaaugacgucuggauggggcggacaauuucugaagagagccguucaggauacgagaccuuuaaagugaucgguggcuggaguacgccuaacuccaaacuucagauuaaucgccagguaauaguugauagcgacaacagaucuggguauucaggaaucuucaguguggaaggcaagagcugcauuaauagguguuuuuacgucgaguugauccggggucgagaacaggagacccgcgugugguggacauccaacucuaucgucguguucugcgggacuucgggcaccuauggaacaggcagcuggccagauggggccgacauuaaucugaugcccauauga

SEQ ID NO: 143939 - RNA, 1410 nt, Artificial Sequence; identical to SEQ ID NO: 136829
  derived and/or modified sequence opt3 from neuraminidase__InfluenzaA__AFG72088

SEQ ID NO: 143940 - RNA, 1410 nt, Artificial Sequence
  derived and/or modified sequence opt3 from neuraminidase__InfluenzaA__AFG72121
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaauagagugaugccgugcgaacccacuaucauagagaggaacaucaccgaaauuguauauuugacaaauaccacuaucgagaaggaaauuuguccuaaauuaguggaguaccggaacuggaguaagccacagugcaaaaucacaggguucgcacccuuuagcaaggacaauuccauacgccugucugccggaggugauauuugggucacccgagagccuuaugugucgugugacccaggcaagugcuaccaguucgcgcuagggcaaggaacgacucucaacaaucgucauucaaacgauaccguucacgacagaacacccuauaggacucugcuuaugaaugaacugggcgugccuuuucauuuggguaccaaacaggucuguauggcuuggagcaguuccucuugccacgaugggaaggccuggcuccauguguguguaacaggacacgacgagaacgcaaccgccagcuucaucuacgauggccggcugguugacuccauuggcucauggaguaaaaauauccugcgcacgcaggaaagcgagugcguguguaucaacgggacuugcacagucgugaugaccgauggaucugcuuccgagagagcagacacuaagauucucuuuauagaagaggguaaaaucgugcacauuucaccauuaagcggcagugcccagcaugucgaagagugcucuuguuauccgagguaccccgggguucggugcgugugucgcgauaauuggaagggauccaaccgaccuaucguagacauaaacgugaaggauuacagcauugucucgucuuaugugugcuccggccugguuggugacacaccaaggaaaaaugacagaucaaguagcuccuacugucggaaccccaauaacgaaaaggggucucacggagugaaaggcugggcuuucgaugacggcaaugaugucuggauggggcguaccaucggagaggagcuucgcagcgguuaugaaacguuuaaggugaucggcggguggucaaccccuaacaguaaauugcaaauuaauagacagguaaucguugacuccggaaacaggagcggcuacucugguauuuucucaguggaggggaagaguugcauaaaucgguguuuuuaugucgaacugauccgaggccgcaaacaggagacaagagugugguggacuagcaacuccauugucguguucugcggaaccucuggcacauacgggacuggaucguggccagauggugccgacaucaaucuaaugcccaucuga

SEQ ID NO: 143941 - RNA, 1410 nt, Artificial Sequence
  derived and/or modified sequence opt3 from neuraminidase__InfluenzaA__AFG72143
augaaccccaaucagaagaucauuaccauaggcagcgugucccugacaaucgccacuauuugccuccuuaugcaaaucgcuauucuggucacgaccguuacauugcacuucaaacaguacgaguguucuucaccuccaaacaaucaggugaugccgugcgaacccacuaucauagagagaaacaucaccgaaauuguauauuuaacaaauaccacuaucgagaaggaaauuuguccuaaacugguggaguacaggaacuggaguaagccacagugcaaaaucacaggguuugcacccuucagcaaggacaauuccauacggcuaucugccggaggugauauuugggucacccgcgagccuuaugugucgugugacccaggcaagugcuaccaauuugcgcucgggcagggaacgacucugaacaaucgacauucaaacgauaccguucacgaccguacacccuauagaacucuucugaugaaugaauugggcgugccuuuccaucucgguaccaaacaggucuguaucgcuuggagcaguuccucuugccacgaugggaaggccuggcugcauguguguguaacaggacacgacgagaacgcaaccgccagcuuuauuuacgauggcaggcugguugacuccaucggcucauggaguaaaaauauccuccggacgcaggaaagcgagugcguguguauuaacgggacuugcacagucgugaugaccgauggaucugcuuccgagcgcgcagacacuaagauauuauucaucgaagaggguaaaauugugcacaucucaccacugagcggcagugcccaacaugucgaagagugcucuuguuauccgagauaccccgggguuaggugcgugugucgggauaauuggaagggauccaaccgcccuauaguagacauuaacgugaaggauuacagcaucgucucgucuuaugugugcuccggccuuguuggugacacaccacgaaagaaugacucaaguagcuccucuuacuguagaaaccccaauaacgaaaaggggagccacggagugaaaggcugggcuuuugaugacggcaaugaugucuggauggggaggaccaucggagaggaguugcggucagguuaugaaacguucaaggugauuggcggguggaguaccccuaacuccaaacugcagaucaaucgucagguaauuguugacagcggaaaccgcucuggcuacucagguauauuuaguguggaggggaaaagcugcaucaauagauguuucuaugucgaacuaauuaggggccggaaacaggagacaaaggugugguggacuuccaacucuaucgucguguuuugcggaaccucgggcacauacgggacuggaagcuggccagauggugccgacaucaaucucaugcccauuuga

SEQ ID NO: 143942 - RNA, 1410 nt, Artificial Sequence
  derived and/or modified sequence opt3 from neuraminidase__InfluenzaA__AFG72165
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugaugccgugcgaacccacuaucauagagagaaauaucaccgaaauuguauauuugacaaacaccacuaucgagaaggaaauuuguccuaaauuaguggaguacaggaauuggucaaagccacagugcaaaaucacaggguucgcacccuuuaguaaggacaacagcauacggcuguccgccggaggugauauuugggucacccgcgagccuuaugugucuugugacccaggcaagugcuaccaauucgcgcuagggcagggaacgacucucaauaaccgacauucgaaugauaccguucacgaccguacacccuauagaacucugcuuaugaacgaacugggcgugccuuuucauuuggguaccaaacaggucuguaucgcuuggucaagcaguuccugccacgaugggaaggccuggcuccauguguguguaacaggacacgacgagaaugcaaccgccucuuucauuuacgauggcaggcugguugacagcaucguguccuggaguaaaaacauccugcggacgcaggaaucagagugcgucuguauuaauggcacuugcacaguggugaugaccgaugggagcgcuucugagcgcgcagacacuaagauacucuuuaucgaagagggaaaaauuguccacaucuccccauuaucagguagcgcccaacauguugaagagugcaguuguuauccgagauaccccggcgugaggugcguaugucgggauaacuggaaggggucuaaccgcccuauaguggacauuaaugucaaggauuacuccaucgugagcucguauguuugcucuggacuggugggcgacacaccacgaaagaacgacuccucaaguagcuccuacuguagaaaucccaacaaugaaaaagguucucacggggucaaaggaugggcuuucgaugacggcaacgauguguggaugggcaggaccaucggggaggagcuucggagcggauaugaaacguuuaagguaauugguggcuggucaaccccuaauaguaaauugcagacaaaccgucagguuaucguggaccgcgggaauagauccggauacagcggcauuuucucugucgaggguaagucaugcauaaacagguguuuuuauguggaacugauccgggggcgaaaacaggagacuaaggucugguggaccaguaauagcauugugguuuucugcggcacauccggaacuuacggcaccgggucuuggccagauggagccgacaucaaccuaaugcccaucuga

SEQ ID NO: 143943 - RNA, 1410 nt, Artificial Sequence
  derived and/or modified sequence opt3 from neuraminidase__InfluenzaA__AFG72176
augaaccccaaucagaagaucauuaccauaggcagcgugucccugacaaucgccacuauuugcuuccucaugcaaaucacgauucuugucaccacaguuacucugcacuuuaaacaguacgaguguaacucuccuccaaauaaccaggugauguugugcgaaccgaccaucauagagagaaauaucacagaaauuguauauuuaaccaacacuacaaucgagaaggaaaaaugucccaagcugguggaguacaggaauuggucaaaaccucagugcaagauuaccggguucgcuccauuuaguaaggacaacagcauccggcuauccgcaggaggugauauaugggucacgcgcgagcccuaugugucuugugacccuggcaaaugcuaccaauucgcccucgggcagggaacuacccugaauaaccgacauucgaaugauacaguucacgaccguacuccauauagaacccuucugaugaacgaauugggcgugcccuuucaucucgguacaaagcaggucuguauugcguggucaagcaguuccugccacgaugggaaagccuggcugcauguguguguaaccggacacgacgagaaugcuacggcaucuuucaucuacgauggcaggcugguugacagcauuggcuccuggucaaagaacauccuccggacucaggaaagugagugcguguguaucaaugggacaugcaccgucgugaugacugauggaagcgccucugagcgcgcugacacaaaaauuuuauuuauagaagaggguaagaucgugcacauuuccccucugucaggcagcgcacaacaugucgaagagugcaguuguuauccaagauacccggggguuaggugcgugugucgggauaacuggaagggaucuaaccgccccaucguagacauaaaugugaaagauuacuccauugucagcucguaugugugcucuggccuuguuggugacaccccucgaaagaacgacuccucaaguagcuccuacuguagaaauccaaacaaugaaaaagggucucacggagugaagggcugggccuucgaugacggcaacgaugucuggauggggaggacgaucagcgaggaguugcggucaggauaugaaaccuuuaaagugaucgguggcuggaguacacccaauuccaagcugcagauuaaccgucagguaaucguugaccgcgggaauagaagcggauacucuggcauuuucucaguggaggguaaaaguugcauaaacagguguuuuuaugucgaacuaauccgggggcgaaagcaggagaauaaggugugguggacuagcaacuccauugucguguucugcggcaccucuggaacauacggcacugggucguggccugauggagcugacaucaaucucaugccaaucuga

SEQ ID NO: 143944 - RNA, 1410 nt, Artificial Sequence; identical to SEQ ID NO: 143942
  derived and/or modified sequence opt3 from neuraminidase__InfluenzaA__AFG72198

SEQ ID NO: 143945 - RNA, 1410 nt, Artificial Sequence; identical to SEQ ID NO: 143942
  derived and/or modified sequence opt3 from neuraminidase__InfluenzaA__AFG72209

SEQ ID NO: 143946 - RNA, 1410 nt, Artificial Sequence
  derived and/or modified sequence opt3 from neuraminidase__InfluenzaA__AFG72220
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguacauuuaacaaacaccacuaucgagaaggaaauuugucccaaacuggcagaguauaggaauuggucaaagccucagugcaaaaucacaggguucgccccauuuaguaaggacaacagcauacggcuauccgcgggaggugauauuugggugacccgcgagcccuacgucucuugugacccuggcaagugcuaucaauucgcucucgggcagggaacgacucugaauaaccgacacucgaaugauaccgugcaugaccguacaccauacagaacucuucugaugaacgaauugggcguucccuuucaccucgguaccaaacagguguguaucgccuggucaagcaguuccugccaugaugggaaggcauggcugcacgucugugugacaggacacgacgagaaugccaccgcuucuuucauuuaugauggcaggcugguagacagcaucggcuccuggaguaaaaacauccuccggacgcaggaaucagagugcguuuguauuaaugggacuugcacaguggucaugaccgauggaagcgcaucugagcgcgccgacacuaagauauuauuuaucgaagaggguaaaauugugcauaucuccccucugucaggcagcgcucaacacguggaagagugcaguuguuacccaagauauccgggggucaggugcguuugucgggauaacuggaagggaucuaaccgccccauaguggacauuaauguaaaggauuacuccaucgugagcucguacgucugcucuggccuugugggugacacaccucgaaagaacgacuccucaaguagcuccuauuguagaaauccaaacaaugaaaaagggucucauggaguuaaaggcugggccuucgaugacggcaacgauguguggauggggaggaccaucagcgaggaguugcggucaggauacgaaacguuuaaggucauugguggcuggaguaaacccaauuccaagcugcagaucaaccgucaggugauuguagaccgcgggaauagaagcggauauucuggcauauucucaguugaggguaaaaguugcaucaacagguguuuuuacguggaacuaauucgggggcgaaagcaggagaccgaagucugguggacaagcaauuccaucguggucuucugcggcacuucuggaaccuauggcacagggucguggccugauggagcggacaucaaccucaugccaauuuga

SEQ ID NO: 143947 - RNA, 1410 nt, Artificial Sequence; identical to SEQ ID NO: 143942
  derived and/or modified sequence opt3 from neuraminidase__InfluenzaA__AFG72231

SEQ ID NO: 143948 - RNA, 1410 nt, Artificial Sequence
  derived and/or modified sequence opt3 from neuraminidase__InfluenzaA__AFG72297
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagagggaaauuugucccaagcuggcagaguaccggaauuggucaaaaccucagugcaagaucacaggguucgccccauuuaguaaagacaacagcauacgccuauccgcgggaggugauauuugggugacccgagagcccuaugucucuugugacccuggcaagugcuaccaauucgcucucgggcagggaacgacucugaauaaccgucauucgaaugauaccgugcacgaaagaacaccauauaggacucuucugaugaacgaguugggcguucccuuucaucucgguaccaaacagguguguaucgccuggucaagcaguuccugccacgacgggaaggcauggcugcaugucugugugacaggacacgaugaaaaugccaccgcuucuuucauuuacgacggccggcugguagauagcaucggcuccuggucaaagaacauccuccgcacgcaggagagugagugcguuuguauuaaugggacuugcacaguggucaugaccgacggaagcgcaucugaaagagccgauacuaaaauauuauuuaucgaggaagguaagauugugcacaucuccccucugucaggcagcgcucaacauguggaggaaugcaguuguuauccaagguacccggggguccggugcguuugucgcgacaacuggaaaggaucuaaccgacccauaguggauauuaauguaaaggacuacuccaucgugagcucguaugucugcucuggccuugugggugauacaccuagaaagaacgacuccucaaguagcuccuacuguaggaauccaaacaaugagaaagggucucacggaguuaagggcugggccuucgacgauggcaacgacguguggauggggcggaccaucagcgaggaauugcguucaggauaugagacguuuaaagucauugguggcuggaguaagcccaauuccaaacugcagaucaaccgccaggugauuguagauagagggaauaggagcggauacucuggcauauucucaguugaagguaagaguugcaucaaccgguguuuuuauguggagcuaauucgagggcgcaaacaggaaaccgaggucugguggacaagcaauuccaucguggucuucugcggcacuucuggaaccuacggcacagggucguggccugacggagcggauaucaaccucaugccaauuuga

SEQ ID NO: 143949 - RNA, 1410 nt, Artificial Sequence
  derived and/or modified sequence opt3 from neuraminidase__InfluenzaA__AFG72308
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaucaaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucgugugacccuggcaagugcuaccaauucgcucucgggcagggaacgacucugaacaaucgacauucaaacgauaccgugcacgaccguacaccauauagaacucuucugaugaaugaauugggcguucccuuucaucucgguaccaaacagguguguaucgccuggagcaguuccucuugccacgaugggaaggcauggcugcaugucugugugacaggacacgacgagaacgccaccgcuagcuucauuuacgauggcaggcugguagacuccaucggcucauggaguaaaaauauccuccggacgcaggaaagcgagugcguuuguauuaacgggacuugcacaguggucaugaccgauggaucugcauccgagcgcgccgacacuaagauauuauuuaucgaagaggguaaaauugugcacaucucaccucugagcggcagugcucaacauguggaagagugcucuuguuauccaagauacccgggggucaggugcguuugucgggauaauuggaagggauccaaccgccccauaguggacauuaacguaaaggauuacagcaucgugucgucuuaugucugcuccggccuugugggugacacaccucgaaagaaugacucaaguagcuccucuuacuguagaaacccaaauaacgaaaaagggagccacggaguuaaaggcugggccuucgaugacggcaaugauguguggauggggaggaccaucucagaggaguugcggaguggauaugaaacguuucgugucauugguggcugguccaagcccaacagcaaacugcagaucaaucgccaggugauuguagacagagggaacaggucuggauacucaggcauauucaguguugaggguaagagcugcaucaaucgguguuuuuauguggaacuaauucgagggcgcaaacaggagaccgaagucugguggacauccaacucuaucguggucuucugcggcacuucgggaaccuacggcacagggagcuggccugauggagcggacaucaaucucaugccaauuuga

SEQ ID NO: 143950 - RNA, 1410 nt, Artificial Sequence; identical to SEQ ID NO: 137201
  derived and/or modified sequence opt3 from neuraminidase__InfluenzaA__AFG72320

SEQ ID NO: 143951 - RNA, 1410 nt, Artificial Sequence
  derived and/or modified sequence opt3 from neuraminidase__InfluenzaA__AFG72331
augaaccccaaucagaagaucauuaccauaggcagcgugucccugacagucgccacuaucugcuuccucaugcaaauugcuauccuuguuacgaccgugacacugcacuuuaaacaguacgaguguaacucuccuccaaauaaccagguaauguugugcgaaccgacuauuaucgagagaaauauaaccgaaaucguguauuuaacaaacaccacuauugagaaggaaaucugucccaaacuggcagaguacaggaauuggucaaagccucagugcaaaauuacaggguucgccccauuuaguaaggacaacagcauccggcuauccgcgggaggugauauaugggucacccgcgagcccuaugugucuugugacccuggcaagugcuaccaauucgcucucgggcagggaacgacucugaauaaccgacauucgaaugauaccguucacgaccguacaccauauagaacucuucugaugaacgaauugggcgugcccuuucaucucgguaccaaacaggucuguauugccuggucaagcaguuccugccacgaugggaaggcauggcugcauguguguguaacaggacacgacgagaaugccaccgcuucuuucaucuacgauggcaggcugguugacagcauuggcuccuggaguaaaaacauccuccggacgcaggaaucagagugcguguguaucaaugggacuugcacagucgugaugaccgauggaagcgcaucugagcgcgccgacacuaagauuuuauuuauagaagaggguaaaaucgugcacauuuccccucugucaggcagcgcucaacaugucgaagagugcaguuguuauccaagauacccggggguuaggugcgugugucgggauaacuggaagggaucuaaccgccccaucguagacauaaaugugaaggauuacuccauugucagcucguaugugugcucuggccuuguuggugacacaccucgaaagaacgacuccucaaguagcuccuacuguagaaauccaaacaaugaaaaagggucucacggagugaaaggcugggccuucgaugacggcaacgaugucuggauggggaggaccaucagcgaggaguugcggucaggauaugaaacguuuaaggugaucgguggcuggaguaaacccaauuccaagcugcagauuaaccgucagguaaucguugaccgcgggaauagaagcggauacucuggcauuuucucaguggaggguaaaaguugcauaaacagguguuuuuaugucgaacuaauccgggggcgaaagcaggagaccgaagugugguggacaagcaauuccauugucguguucugcggcacuucuggaaccuacggcacagggucguggccugauggagcggacaucaaccucaugccaaucuga

SEQ ID NO: 143952 - RNA, 1410 nt, Artificial Sequence
  derived and/or modified sequence opt3 from neuraminidase__InfluenzaA__AFG72353
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacucgggcaagugcuaccaauucgcucucgggcagggaacgacucugaauaaccgacauucaaaugauaccgugcacgaccguacaccuuauagaacucuucugaugaacgaauugggcguuccauuucaucucgguaccaaacagguguguaucgccuggagcaguuccucuugccacgaugggaaggcauggcugcaugucugugugacaggacacgacgagaaugccaccgcuagcuucauuuacgauggcaggcugguagacuccaucggcucauggaguaaaaacauccuccggacgcaggaaagcgagugcguuuguauuaaugggacuugcacaguggucaugaccgauggaucugcauccgagcgcgccgacacuaagauauuauuuaucgaagaggguaaaauugugcacaucucaccccugagcggcagugcucaacauguggaagagugcucuuguuauccuagauacccaggggucaggugcguuugucgggauaacuggaagggauccaaccgcccgauaguggacauuaauguaaaggauuacagcaucgugucgucuuaugucugcuccggccuugugggugacacaccccgaaagaacgacucaaguagcuccucuuacuguagaaauccuaacaaugaaaaagggagccacggaguuaaaggcugggccuucgaugacggcaacgauguguggauggggaggaccaucucagaggaguugcggaguggauaugaaacguuuaaggucauugguggcugguccaaaccaaauagcaagcugcagaucaaccgucaggugauuguagaccgcgggaauagaucuggauacucaggcauauucaguguugaggguaaaagcugcaucaacagguguuuuuauguggaacuaauucgggggcgaaagcaggagaccgaagucugguggacauccaauucuaucguggucuucugcggcacuucgggaaccuacggcacagggagcuggcccgauggagcggacaucaaccucaugccuauuuga

SEQ ID NO: 143953 - RNA, 1410 nt, Artificial Sequence; identical to SEQ ID NO: 137201
  derived and/or modified sequence opt3 from neuraminidase__InfluenzaA__AFG72364

SEQ ID NO: 143954 - RNA, 1410 nt, Artificial Sequence
  derived and/or modified sequence opt3 from neuraminidase__InfluenzaA__AFG72430
augaaccccaaucagaagaucauuaccauaggcagcgugucccugacaaucacuacgauuugcuuccucaugcaaaucgccauucuugucaucaccguuacacugcacuuuaaacagugugagugcaacucuccuccaaauaaccaggugauguugugugaaccgacuauaaucgagagaaauauuaccgaaaucguauacuuaacaaacaccacuauugagaaggaaaucugccccaaacuggcugaguauaggaauuggucaaagccucaguguaaaauaacaggguucgcaccauuuaguaaggacaacagcauucggcuauccgccggaggugauaucugggugacccgcgagcccuacgucucuugcgacccuggcaaguguuaucaauucgcgcucgggcagggaacgacucugaauaaccgacauucgaaugauaccgugcacgaccguacaccauacagaacucuucugaugaacgaauugggcguucccuuucaucucgguaccaaacaggugugcauugcuuggucaagcaguuccugucacgaugggaaggccuggcugcaugucugcgugacaggacacaaugagaacgcaaccgccucuuucaucuaugacggcaggcugguagauagcaucggcuccuggaguaaaaauauucuccggacgcaggaaucagaguguguuugcauaaacgggacuugcacaguggucaugaccgacggaagcgcuucuggucgcgcagauacuaagaucuuauuuauugaggaaggcaaaaucgugcacauaucccaacugucagggagcgcccagcauguggaggaauguaguugcuacccuagauauccaggagucagguguguuugccgggacaacuggaagggcucuaaucgcccgauuguggauaucaacguaaaggacuacuccaucgugagcucguacgucuguucuggucuugugggggauacaccccggaaaaaugacuccucaaguagcuccaacugcuuggacccuaauaacgaggaaggaggccacggcguuaaggggugggcuuucgaugacggaaaugauguguggauggguagaaccauuucugagaaacugaggagcggcuaugagacguuuaaggucaucgggggauggucaaaaccaaacaguaagcuacagauuaaucgacaggugauaguagaccguggcaaccgcuccgguuacagcgggaucuucucuguugaaggcaaaucauguauuaauagaugcuuuuauguggagcucaucaggggacggaagcaagaaaccgaggucugguggacaaguaacagcaucguggucuucuguggcacuuccgggaccuacggaacagguucuuggcccgauggcgccgacauuaaucugaugccuauauga

SEQ ID NO: 143955 - RNA, 1410 nt, Artificial Sequence; identical to SEQ ID NO: 137201
  derived and/or modified sequence opt3 from neuraminidase__InfluenzaA__AFG72452

SEQ ID NO: 143956 - RNA, 1410 nt, Artificial Sequence
  derived and/or modified sequence opt3 from neuraminidase__InfluenzaA__AFG72474
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcgagaucacaggguucgccccauuuaguaaagacaacagcauacggcuauccgcgggaggugauauuugggugacccgcgaacccuaugucucuugugacccuggcaagugcuaccaauucgcucucgggcagggaacgacucugaauaaccgacauucgaaugauaccgugcacgaccguacaccauauagaacucuucugaugaacgaguugggcguucccuuucaucucgguaccaaacagguguguaucgccuggucaagcaguuccugccacgaugggaaggcauggcugcaugucugugugacaggacacgacgaaaaugccaccgcuucuuucauuuacgauggcaggcugguagacagcaucggcuccuggucaaagaacauccuccggacgcaggagagugagugcguuuguauuaaugggacuugcacaguggucaugaccgauggaagcgcaucugaacgcgccgacacuaaaauauuauuuaucgaggaagguaagauugugcacaucuccccucugucaggcagcgcucaacauguggaggaaugcaguuguuauccaagauacccgggggucaggugcguuugucgggauaacuggaaaggaucuaaccgccccauaguggacauuaauguaaaggauuacuccaucgugagcucguaugucugcucuggccuugugggugacacaccucgaaagaacgacuccucaaguagcuccuacuguagaaauccaaacaaugagaaagggucucacggaguuaagggcugggccuucgaugacggcaacgauguguggauggggaggaccaucagcgaggaauugcggucaggauaugagacguuuaaagucauugguggcuggaguaagcccaauuccaaacugcagaucaaccgucaggugauuguagaccgcgggaauagaagcggauacucuggcauauucucaguugaagguaagaguugcaucaacagguguuuuuauguggagcuaauucgggggcgaaaacaggaaaccgaggucugguggacaagcaauuccaucguggucuucugcggcacuucuggaaccuacggcacagggucguggccugauggagcggacaucaaccucaugccaauuuga

SEQ ID NO: 143957 - RNA, 1410 nt, Artificial Sequence
  derived and/or modified sequence opt3 from neuraminidase__InfluenzaA__AFG72485
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaaaaucacaggguucgccccauuuaguaaggacaacagcauacggcuauccgcgggaggugauauuugggugacccgcgagcccuacgucucuugugacccuggcaagugcuaucaauucgcucucgggcagggaacgacucugaauaaccgacacucgaaugauaccgugcaugaccguacaccauacagaacucuucugaugaacgaauugggcguucccuuucaccucgguaccaaacagguguguaucgccuggucaagcaguuccugccaugaugggaaggcauggcugcacgucugugugacaggacacgacgagaaugccaccgcuucuuucauuuaugauggcaggcugguagacagcaucggcuccuggaguaaaaacauccuccggacgcaggaaucagagugcguuuguauuaaugggacuugcacaguggucaugaccgauggaagcgcaucugagcgcgccgacacuaagauauuauuuaucgaagaggguaaaauugugcauaucuccccucugucaggcagcgcucaacacguggaagagugcaguuguuacccaagauauccgggggucaggugcguuugucgggauaacuggaagggaucuaaccgccccauaguggacauuaauguaaaggauuacuccaucgugagcucguacgucugcucuggccuugugggugacacaccucgaaagaacgacuccucaaguagcuccuauuguagaaauccaaacaaugaaaaagggucucauggaguuaaaggcugggccuucgaugacggcaacgauguguggauggggaggaccaucagcgaggaguugcggucaggauacgaaacguuuaaggucauugguggcuggaguaaacccaauuccaagcugcagaucaaccgucaggugauuguagaccgcgggaauagaagcggauauucuggcauauucucaguugaggguaaaaguugcaucaacagguguuuuuacguggaacuaauucgggggcgaaagcaggagaccgaagucugguggacaagcaauuccaucguggucuucugcggcacuucuggaaccuauggcacagggucguggccugauggagcggacaucaaccucaugccaauuuga

SEQ ID NO: 143958 - RNA, 1410 nt, Artificial Sequence; identical to SEQ ID NO: 137117
  derived and/or modified sequence opt3 from neuraminidase__InfluenzaA__AFG72507

SEQ ID NO: 143959 - RNA, 1410 nt, Artificial Sequence
  derived and/or modified sequence opt3 from neuraminidase__InfluenzaA__AFG72529
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaagauccuccggacgcaggaaucagagugcguuuguauuaacgggacuugcacaguggucaugaccgauggaagcgcaucugagcgcgccgacacuaaaauauuauuuaucgaagaggguaagauugugcacaucuccccucugucaggcagcgcucaacauguggaagagugcaguuguuauccaagauacccgggggucaggugcguuugucgggauaauuggaagggaucuaaccgccccauaguggacauuaacguaaaagauuacuccaucgugagcucguaugucugcucuggccuugugggugacacaccucgaaagaaugacuccucaaguagcuccuacugucagaacccaaauaacgaaaaugggucucacggaguuaaaggcugggccuucgaugacggcaacgauguguggauggggagaaccaucagcgaggaguugaggucaggauaugaaacguuuaaggucauugguggcuggaguaaacccaauuccaagcugcagaucaaccgucaggugauuguagaccgggggaaucgcagcggauacucuggcauauucucaguugaggguaaaaguugcaucaacagauguuuuuauguggaacuaauuagggggcggaagcaagagaccgaagucugguggacaagcaauuccaucguggucuucugcggcacuucuggaaccuacggcacagggucguggccugauggagcggacaucaaccucaugccaauuuga

SEQ ID NO: 143960 - RNA, 1410 nt, Artificial Sequence
  derived and/or modified sequence opt3 from neuraminidase__InfluenzaA__AFG72540
augaaccccaaucagaagaucauuaccauaggcagcgugucccugacaaucgccacuauuugcuuccucaugcaaaucgcuauucuugucacgaccguuacacugcacuuuaaacaguacgaguguaacccuccaccgaauaaccaggugauguugugcgaacccacuaucauagagagaaauaucaccgaaauuguauauuuaacaaacaccacuaucaagaaagagauuuguccuaagcuggcagaauacaggaauuggucuaaaccacagugcaagaucacaggguucgcccccuuuucaaaggacaacaguauacggcuaagcgcgggaggugauauuugggugacccgcgagccuuaugucuccugugacccaggcaaaugcuaccaauucgcucucgggcagggaacgacucugaauaaccgacauucuaaugauaccgugcacgaccguacacccuauagaacucuucugaugaacgaguugggcguuccuuuucaucucgguaccaaacagguguguaucgccuggucgucaagcaguugccacgaugggaaggcauggcugcaugucugugugacaggacacgacgaaaaugccaccgcuuccuucauuuacgauggcaggcugguagacucuaucggcagcugguccaagaacauccuccggacgcaggagucagaaugcguuuguauuaaugggacuugcacaguggucaugaccgauggaagugcaagcgagcgcgccgacacuaaaauauuauuuaucgaggaagguaagauugugcacaucucuccacuguccggcucagcucaacauguggaggaaugcagcuguuauccgagauaccccggggucaggugcguuugucgggauaacuggaagggaaguaaccgcccuauaguggacauuaauguaaaagauuacucuaucguguccagcuaugucugcucgggccuugugggugacacaccacgaaagaacgacucuuccucaaguagcuacuguuggaaucccaacaaugagaaagggggacacggcguuaagggcugggccuucgaugacgggaacgauguguggaugggaagaaccaucuccgaagaguugaggucugguuaugagacguuuaaagucauuggcggguggagcaagccuaauucaaaacugcagaucaaccgucaggugauuguagaccggggaaaucgcaguggcuacuccgguauauucagcguugaagggaagucuugcaucaacagauguuuuuauguggagcuaauuaggggccggaagcaggaaaccgaggucugguggacaucaaauaguaucguggucuucugcggaacuagcggcaccuacgggacaggauccuggccagauggugcggacaucaaccucaugcccauuuga

SEQ ID NO: 143961 - RNA, 1410 nt, Artificial Sequence
  derived and/or modified sequence opt3 from neuraminidase__InfluenzaA__AFG72562
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggucaaagaacauccuccggacgcaggaaagugagugcguuuguauuaaugggacuugcacaguggucaugaccgauggaagcgcaucugagcgcgccgacacuaagauauuauuuaucgaagaggguaaaauugugcacaucuccccucugucaggcagcgcucaacauguggaagagugcaguuguuauccaagauacccgggggucaggugcguuugucgggauaacuggaagggaucuaaccgccccauaguggacauuaauguaaaggauuacuccaucgugagcucguaugucugcucuggccuugugggugacacaccucggaaaaacgacuccucaaguagcuccuacuguuggaauccaaacaaugaaaaagggggacacggcguuaaaggcugggccuucgaugacgggaacgauguguggaugggaagaaccaucucugaggaguugaggagcgguuaugaaacguuuaaggucauuggcggguggucaaaacccaauaguaagcugcagaucaaccgacaggugauuguagaccguggaaaucgcuccggcuacagcgguauauucucuguugaggggaaaucaugcaucaacagauguuuuuauguggaacuaauuaggggccggaagcaggagaccgaagucugguggacaaguaauagcaucguggucuucugcggaacuuccggcaccuacgggacaggaucuuggccugauggugcggacaucaaccucaugccaauuuga

SEQ ID NO: 143962 - RNA, 1410 nt, Artificial Sequence
  derived and/or modified sequence opt3 from neuraminidase__InfluenzaA__AFG72584
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaagugugucccaaacuggcagaguacaggaauuggucaaagccucagugcaaaauuacaggguucgccccauuuaguaaggacaacagcauccggcuauccgcgggaggugauauaugggucacccgcgagcccuaugugucuugugacccuggcaagugcuaccaauucgcucucgggcagggaacgacucugaauaacaaacauucgaaugauaccguucacgaccgaacaccauaucguacucuucugaugaacgaauugggcgugcccuuucaucucgguaccaagcaggucuguauugccuggucaagcaguuccugccacgaugggaaagcauggcugcauguguguguaacaggacacgacgagaaugccaccgcuucuuucaucuacgauggcagacugguugacagcauuggcuccuggucaaagaacauccucaggacgcaggaaagugagugcguguguaucaaugggacuugcacagucgugaugaccgauggaagcgcaucugagaaagccgacacuaagauuuuauuuauagaagaggguaagaucgugcacauuuccccucugucaggcagcgcucaacaugucgaagagugcaguuguuauccacgguacccggggguucgcugcguguguagagauaacuggaaaggaucuaacaggcccaucguagacauaaaugugaaggauuacuccauugucagcucguaugugugcucuggccuuguuggugacacaccucggaaaaacgacuccucaaguagcuccuacuguuggaauccaaacaaugaaaaagggggacacggcgugaagggcugggccuucgaugacgggaacgaugucuggaugggacgcaccaucucugaggaguugcgaagcgguuaugaaacguuuaaggugaucggcggguggucaaaacccaauaguaagcugcagauuaacagacagguaaucguugacaggggaaaucgguccggcuacagcgguauuuucucuguggaggggaagucaugcauaaaccguuguuuuuaugucgaacuaauccgcggcagaaaacaggagaccgaagugugguggacaaguaauagcauugucguguucugcggaacuuccggcaccuacgggacaggaucuuggccugauggugcggacaucaaccucaugccaaucuga

SEQ ID NO: 143963 - RNA, 1410 nt, Artificial Sequence
  derived and/or modified sequence opt3 from neuraminidase__InfluenzaA__AFG72606
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacauccuccggacgcaggaaucagagugcguuuguauuaaugggacuugcacaguggucaugaccgauggaagcgcaucugagcgcgccgacacuaagauauuauuuaucgaagaggguaaaauugugcacaucuccccucugucaggcagcgcucaacauguggaagagugcaguuguuauccaagauacccgggggucaggugcguuugucgggauaacuggaagggaucuaaccgccccauaguggacauuaauguaaaggaucacuccaucgugagcucguacgucugcucuggccuugugggugacacaccucggaaaaacgacuccucaaguagcuccuauuguuugaauccaaacaaugaagaagggggacauggcguuaagggcugggccuucgaugacgggaacgauguguggaugggaagaaccaucucugagaaacugaggagcgguuacgagacguuuaaggucauuggcggguggucaaaacccaauaguaagcuacagaucaaccgacaggugauuguagaccguggaaaucgcuccggcuauagcgguauauucucuguugaggggaaaucaugcgugaacagauguuuuuacgucgaacucaucaggggccggaagcaggagaccgaagugugguggacaaguaauagcauugucguguucugcggaacuuccggcaccuaugggacaggaucuuggccugauggugcggacaucaaccugaugccaaucuga

SEQ ID NO: 143964 - RNA, 1410 nt, Artificial Sequence
  derived and/or modified sequence opt3 from neuraminidase__InfluenzaA__AFG72617
augaaccccaaucagaagaucauuaccauaggcagcgugucccugacaaucacuacgauuugcuuccucaugcaaaucgccauucuugucaucaccguuacacugcacuuuaaacagugugagugcaacucuccuccaaauaaccaggugauguugugugaaccgacuauaaucgagagaaauauuaccgaaaucguauacuuaacaaacaccacuauugagaaggaaaucugccccaaacuggcugaguauaggaauuggucaaagccucaguguaaaauaacaggguucgcaccauuuaguaaggacaacagcauucggcuauccgccggaggugauaucugggugacccgcgagcccuacgucucuugcgacccuggcaaguguuaucaauucgcgcucgggcagggaacgacucugaauaaccgacauucgaaugauaccgugcacgaccguacaccauacagaacucuucugaugaacgaauugggcguucccuuucaucucgguaccaaacaggugugcauugcuuggucaagcaguuccugucacgaugggaaggccuggcugcaugucugcgugacaggacacaaugagaacgcaaccgccucuuucaucuaugacggcaggcugguagauagcaucggcuccuggaguaaaaauauucuccggacgcaggaaucagaguguguuugcauaaacgggacuugcacaguggucaugaccgacggaagcgcuucuggucgcgcagauacuaagaucuuauuuauugaggaaggcaaaaucgugcacauauccccucugucagggagcgcccaacauguggaggaauguaguugcuacccaagauauccgggagucagguguguuugccgggacaacuggaagggcucuaaucgccccauuguggauaucaacguaaaggacuacuccaucgugagcucguacgucuguucuggucuugugggggauacaccucggaaaaaugacuccucaaguagcuccuauugcuugaacccaaauaacgaggaaggaggccacggcguuaaggggugggcuuucgacgauggaaaugacguguggauggguagaaccauuucugagaaacugaggagcggcuacgagacguuuaaggucaucgggggauggucaaaacccaacaguaagcuacagauuaaucgacaggugauaguagaucguggcaaccgcuccgguuauagcgggaucuucucuguugaaggcaaaucauguauuaauagaugcuuuuacguggagcucaucaggggacggaagcaggaaaccgaggucugguggacaaguaacagcaucguggucuucuguggcacuuccgggaccuauggaacagguucuuggccugacggcgccgauauuaaucugaugccaauauga

SEQ ID NO: 143965 - RNA, 1410 nt, Artificial Sequence
  derived and/or modified sequence opt3 from neuraminidase__InfluenzaA__AFG72628
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucggcuccuggaguaaaaagauccuccggacgcaggaaucagagugcguuuguauuaacggcacuugcacaguggucaugaccgacgggagcgcaucuggacgcgccgauacuaaaauauuauuuaucgaggaagguaagauugugcacaucuccccucugucaggcagcgcucaacauguggaggaaugcaguuguuauccaagauacucuggggucaggugcguuugucgggacaauuggaagggauccaaccgcccgauaguggauauuaacguaaaagacuacagcaucgugucgucuuaugucugcuccggccuugugggugacacaccccgaaagaaugauucaaguagcuccucucacuguuugaacccuaauaacgaggaagggggacauggcguuaaaggcugggccuucgacgaugggaaugacguguggaugggaagaaccaucagcgagaagcugaggucagguuacgagacguuuaaagucauuggcggguggaguaagccaaacuccaaacuacagaucaaucgucaggugauuguagaucggggaaaccgcagcggcuauucugguauauucucaguugaagggaagaguugcaucaauagauguuuuuacguggagcucauuaggggccggaagcaggaaaccgaggucugguggacaagcaacuccaucguggucuucugcggaacuucuggcaccuaugggacaggaucguggcccgacggugcggauaucaaucugaugccuauuuga

SEQ ID NO: 143966 - RNA, 1410 nt, Artificial Sequence; identical to SEQ ID NO: 136996
  derived and/or modified sequence opt3 from neuraminidase__InfluenzaA__AFG72639

SEQ ID NO: 143967 - RNA, 1410 nt, Artificial Sequence
  derived and/or modified sequence opt3 from neuraminidase__InfluenzaA__AFG72650
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacauccuccggacgcaggaaucagagugcguuuguauuaaugggacuugcacaguggucaugaccgauggaagcgcaucugagcgcgccgacacuaagauauuauuuaucgaagaggguaaaauugugcacaucuccccucugucaggcagcgcucaacauguggaagagugcaguuguuauccaagauacccgggggucaggugcguuugucgggauaacuggaagggaucuaaccgccccauaguggacauuaauguaaaggauuacuccaucgugagcucguaugucugcucuggccuugugggugacacaccucggaaaaacgacuccucaaguagcuccuacuguuugaauccaaacaaugaagaagggggacacggcguuaagggcugggccuucgaugacgggaacgauguguggaugggaagaaccaucucugagaaacugaggagcgguuaugagacguuuaaggucauuggcggguggucaaaacccaauaguaagcuacagaucaaccgacaggugauuguagaccguggaaaucgcuccggcuacagcgguauauucucuguugaggggaaaucaugcgugaacagauguuuuuaugucgaacucaucaggggccggaagcaggagaccgaagugugguggacaaguaauagcauugucguguucugcggaacuuccggcaccuacgggacaggaucuuggccugauggugcggacaucaaccugaugccaaucuga

SEQ ID NO: 143968 - RNA, 1410 nt, Artificial Sequence; identical to SEQ ID NO: 143965
  derived and/or modified sequence opt3 from neuraminidase__InfluenzaA__AFG72672

SEQ ID NO: 143969 - RNA, 1407 nt, Artificial Sequence
  derived and/or modified sequence opt3 from neuraminidase__InfluenzaA__AFG72683
augaaccccaaucagaagaucauuaccauaggcagcgugucccugacaaucgccacuauuugcuuccucaugcaaaucgcuauucuugucaucacgguuacccugcacuuuaaacaguacgaguguaacucuccuccaaauaaccaggugauguugugcgaaccgacaauaaucgagagaaauauuacugaaaucguauauuuaaccaacacaaccauugagaaggaaaucugucccaaacuggcagaguacaggaauuggucaaagccucagugcaaaauaacuggguucgccccauuuaguaaggacaacagcauucggcuauccgcgggaggugauaucugggugacacgcgagcccuaugucucuugugacccuggcaagugcuaccaauucgcucucgggcagggaaccacgcugaauaaccgacauucgaaugaagugcacgaucguacuccauauagaacccuucugaugaacgaguugggcguucccuuucaucucgguacaaaacagguguguauugccuggucaagcaguuccugccacgacgggaaggcauggcugcaugucugugugacuggacacaaugaaaacgccaccgcuucuuucaucuacgauggcaggcugguagacagcaucggcuccuggaguaaaaauauucuccggacacaggagucagagugcguuuguauaaacgggaccugcacgguggucaugacugauggaagcgcaucuggucgcgccgacacaaagaucuuauuuauugaagagggcaaaaucgugcacauauccccucugucagggagcgcucaacauguggaagagugcaguuguuauccaagauacccgggagucaggugcguuugucgggauaacuggaagggcucuaaucgccccauuguggacaucaacguaaaggauuacuccaucgugagcucguaugucugcucuggucuugugggggacaccccucggaaaaaugauuccucaaguagcucccacuguuugaacccaaauaacgaagagggaggccauggcguuaaggggugggccuucgacgacggaaaugauguguggauggguagaacuauuucugagaaacugaggagcggcuacgaaacauuuaaggucaucgggggauggucaaaacccaacaguaagcuacagauuaaucgacaggugauaguagaccguggcaaccgcuccgguuauagcgggaucuucucuguugagggcaaaucaugcauuaauagauguuuuuacguggaacucaucaggggacggaagcaggagaccgaagucugguggacgaguaacagcaucguggucuucugcggcaccuccgggacauauggaacugguucuuggccugauggcgcggacauuaaucugaugccaauauga

SEQ ID NO: 143970 - RNA, 1410 nt, Artificial Sequence
  derived and/or modified sequence opt3 from neuraminidase__InfluenzaA__AFG72705
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucggcuccuggaguaaaaagauccuccggacgcaggaaucagagugcguuuguauuaacggcacuugcacaguggucaugaccgacgggagcgcaucuggacgcgccgauacuaaaauauuauuuaucgaggaagguaagauugugcacaucucccaacugucaggcagcgcucagcauguggaggaaugcaguuguuauccuagauacccaggggucaggugcguuugucgggacaauuggaagggaucuaaccgcccgauaguggauauuaacguaaaagaccacuccaucgugagcucguacgucugcucuggccuugugggugacacaccccgaaagaaugauuccucaaguagcucccauuguuugaacccuaauaacgaggaagggggacacggcguuaaaggcugggccuucgacgaugggaaugacguguggaugggaagaaccaucucugagaagcugaggagcgguuaugagacguuuaaagucauugaaggcuggucaaagccaaacaguaaacuacagaucaaucgucaggugauuguagaucgggggaaccgcuccggauacagcggcauauucucuguugaggguaagucaugcaucaauagauguuuuuauguggaacucauuagggggcggaagcaagagaccgaagucugguggacaaguaacagcaucguggucuucugcggcacuuccggaaccuacggcacagggucuuggcccgacggagcggauaucaaucugaugccuauuuga

SEQ ID NO: 143971 - RNA, 1410 nt, Artificial Sequence
  derived and/or modified sequence opt3 from neuraminidase__InfluenzaA__AFG72716
augaaccccaaucagaagaucauuaccauaggcagcgugucccugacaaucacuacgauuugcuuccucaugcaaaucgccauucuugucaucaccguuacacugcacuuuaaacagugugagugcaacucuccuccaaauaaccaggugauguugugugaaccgacuauaaucgagagaaauauuaccgaaaucguauacuuaacaaacaccacuauugagaaggaaaucugccccaaacuggcugaguauaggaauuggucaaagccucaguguaaaauaacaggguucgcaccauuuaguaaggacaacagcauucggcuauccgccggaggugauaucugggugacccgcgagcccuacgucucuugcgacccuggcaaguguuaucaauucgcgcucgggcagggaacgacucugaauaaccgacauucgaaugauaccgugcacgaccguacaccauacagaacucuucugaugaacgaauugggcguucccuuucaucucgguaccaaacaggugugcauugcuuggucaagcaguuccugucacgaugggaaggccuggcugcaugucugcgugacaggacacaaugagaacgcaaccgccucuuucaucuaugacggcaggcugguagauagcaucggcuccuggaguaaaaauauucuccggacgcaggaaucagaguguguuugcauaaacgggacuugcacaguggucaugaccgacggaagcgcuucuggucgcgcagauacuaagaucuuauuuauugaggaaggcaaaaucgugcacauauccccucugucagggagcgcccaacauguggaggaauguaguugcuacccaagauauccgggagucagguguguuugccgggacaacuggaagggcucuaaucgccccauuguggauaucaacguaaaggacuacuccaucgugagcucguacgucuguucuggucuugugggggauacaccucggaaaaaugacuccucaaguagcuccuauugcuuggacccaaacaaugaggaaggaggccacggcguuaaggggugggcuuucgaugacggaaacgauguguggauggguagaaccauuucugagaaaagcaggucaggcuacgagacguuuaaggucaucgggggauggaguaaacccaauuccaagcugcagauuaaccgacaggugauaguagaccguggcaaucgcagcgguuauucugggaucuucucaguugaaggcaaaaguuguauuaacagaugcuuuuacguggagcuaaucaggggacggcgacaggaaaccgaggucugguggacaagcaauuccaucguggucuucuguggcacuucugggaccuauggaacagguucguggccugauggcgccgacauuaaccucaugccaauauga

SEQ ID NO: 143972 - RNA, 1410 nt, Artificial Sequence
  derived and/or modified sequence opt3 from neuraminidase__InfluenzaA__AFG72738
augaaccccaaucagaagaucauuaccauaggcagcgugucccugacaaucacuacgauuugcuuccucaugcaaaucgccauucuugucaucaccguuacacugcacuuuaaacagugugagugcaacucuccuccaaauaaccaggugauguugugugaaccgacuauaaucgagagaaauauuaccgaaaucguauacuuaacaaacaccacuauugagaaggaaaucugccccaaacuggcugaguauaggaauuggucaaagccucaguguaaaauaacaggguucgcaccauuuaguaaggacaacagcauucggcuauccgccggaggugauaucugggugacccgcgagcccuacgucucuugcgacccuggcaaguguuaucaauucgcgcucgggcagggaacgacucugaauaaccgacauucgaaugauaccgugcacgaccguacaccauacagaacucuucugaugaacgaauugggcguucccuuucaucucgguaccaaacaggugugcauugcuuggucaagcaguuccugucacgaugggaaggccuggcugcaugucugcgugacaggacacaaugagaacgcaaccgccucuuucaucuaugacggcaggcugguagauagcaucggcuccuggaguaaaaauauucuccggacgcaggaaucagaguguguuugcauaaacgggacuugcacaguggucaugaccgacggaagcgcuucuggucgcgcagauacuaagaucuuauuuauugaggaaggcaaaaucgugcacauaucccaacugucagggagcgcccagcauguggaggaauguaguugcuacccuagauauccaggagucagguguguuugccgggacaacuggaagggcucuaaucgcccgauuguggauaucaacguaaaggacuacuccaucgugagcucguacgucuguucuggucuugugggggauacaccccggaaaaaugacuccucaaguagcuccuauugcuuggacccuaacaaugaggaaggaggccacggcguuaaggggugggcuuucgaugacggaaacgauguguggauggguagaaccauuucugagaaacugaggagcggcuacgagacguuuaaggucaucgggggauggucaaaaccaaauaguaagcuacagauuaaccgacaggugauaguagaccguggcaaucgcuccgguuauagcgggaucuucucuguugaaggcaaaucauguauuaacagaugcuuuuacguggagcucaucaggggacggaagcaagaaaccgaggucugguggacaaguaauagcaucguggucuucuguggcacuuccgggaccuauggaacagguucuuggcccgauggcgccgacauuaaccugaugccuauauga

SEQ ID NO: 143973 - RNA, 1410 nt, Artificial Sequence; identical to SEQ ID NO: 137201
  derived and/or modified sequence opt3 from neuraminidase__InfluenzaA__AFG72749

SEQ ID NO: 143974 - RNA, 1410 nt, Artificial Sequence; identical to SEQ ID NO: 136589
  derived and/or modified sequence opt3 from neuraminidase__InfluenzaA__AFG72760

SEQ ID NO: 143975 - RNA, 1410 nt, Artificial Sequence; identical to SEQ ID NO: 136056
  derived and/or modified sequence opt3 from neuraminidase__InfluenzaA__AFG72771

SEQ ID NO: 143976 - RNA, 1410 nt, Artificial Sequence
  derived and/or modified sequence opt3 from neuraminidase__InfluenzaA__AFG72782
augaaccccaaucagaagaucauuaccauaggcagcgugucccugacaaucgccacuauuugcuuccucaugcaaaucgcuauucuugucacgaccguuacacugcacuuuaaacaguacgaguguaacucuuugccuaauaaccaggugauguuaugcgaaccaacuaucauagagagaaauaucaccgaaauuguauaucugacaaacaccacuaucgagaaggaaauuuguccgaaacuagcagaguacaggaauuggucaaagccccagugcaaaaucacaggguucgccccuuuuaguaaggacaacagcauacggcucuccgcgggaggugauauuugggugacccgcgagccauaugucucuugugaccccgauaagugcuaccaauucgcucugggccaggggacgacucuuaauaaccgacauucgaaugacaccgugcacgaucguacaccuuauagaacucuguugaugaacgaacucggaguuccauuucaucugggcaccaaacagguguguaucgccuggucaagcaguuccugccacgacgguaaggcauggcugcaugucugugugacagggcacgaugagaaugccaccgcuucuuucauuuacgacggaaggcucguagauagcaucggcuccuggaguaaaaagaucuuacggacgcaggaaagugagugcguuuguauuaacggcacuugcacaguggucaugaccgacgggagcgcaucuggacgcgccgauacuaaaauacuguuuaucgaggaagguaagauuauccacacaucccaacuuucaggcagcgcucagcauguggaggaaugcaguuguuaucccagauacccuggggugaggugcgucugucgggacaauuggaagggaucuaaccgcccaauaguugauauuaacgugaaagacuacuccaucguaagcucguaugugugcucuggcuuggucggugacaccccgcgaaagaaugauuccucaaguagcucccacugucugaaccccaauaacgaggaagggggacauggcgugaaaggcugggccuucgacgaugggaaugacguuuggaugggaagaacgaucucugagaaguuuaggagcgguuacgagaccuucaaagugauugaaggcuggucaaagccuaacaguaaacuacagaucaaucggcaggucauuguggaucgugacaaccgcuccggguauagcggaauauuuucuguagagggcaagucaugcaucaauagauguuucuacguugaacucauuaggggucggaagcaagagacagaagugugguggacuucaaacagcaucgucguguuuugcgggaccuccggcacauauggaacuggcucuuggccagauggggcggacaucaaucugaugcccauuuga

SEQ ID NO: 143977 - RNA, 1410 nt, Artificial Sequence; identical to SEQ ID NO: 137765
  derived and/or modified sequence opt3 from neuraminidase__InfluenzaA__AFG72793

SEQ ID NO: 143978 - RNA, 1410 nt, Artificial Sequence; identical to SEQ ID NO: 136300
  derived and/or modified sequence opt3 from neuraminidase__InfluenzaA__AFG72804

SEQ ID NO: 143979 - RNA, 1410 nt, Artificial Sequence; identical to SEQ ID NO: 137945
  derived and/or modified sequence opt3 from neuraminidase__InfluenzaA__AFG72826

SEQ ID NO: 143980 - RNA, 1410 nt, Artificial Sequence
  derived and/or modified sequence opt3 from neuraminidase__InfluenzaA__AFG72837
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaacgaacaccauaucguacucuucugaugaaugaguugggcguucccuuucaucucgguaccaaacagguguguaucgccuggucaagcaguuccugccacgaugggaaggcauggcugcaugucugugugacaggagacgaugaaaacgccaccgcuucuuucauuuacaauggcagacugguagacagcaucggcuccuggucaaagaaaauccucaggacgcaggagagugagugcguuuguauuaacgggacuugcacaguggucaugaccgauggaagcgcaucugguaaggccgacacuaaaauauuauuuaucgaagagggcaagauugugcacaucuccacacugucagggagcgcucaacacguggaagagugcaguuguuauccucgguacccaggaguccgcugcguuuguagagauaacuggaagggcucuaauaggccgauaguggacauuaacguaaaagauuacuccaucgugagcucguaugucugcucuggucuugugggggacacgccccggaagaaugacuccuucucaaguagccauuguuuggauccuaacaaugaagagggaggccacggcguuaaagggugggccuuugacgauggaaacgacguguggaugggucgcaccaucuccgagaagcugcgaucuggcuacgaaaccuucaaagucauugagggguggagcaagccaaauucaaaacuacagaucaacagacaggugauuguagaaaggggaaaucggaguggcuauuccgguauauuuagcguugaggggaagucuugcaucaaccguuguuucuacguggaacucauucgcggcagaaaggaggagacagaagucugguggacuucaaauaguaucguggucuuuugcggaaccagcggcacauaugggacuggauccuggcccgauggugcggacaucaaccugaugccuauuuga

SEQ ID NO: 143981 - RNA, 1413 nt, Artificial Sequence
  derived and/or modified sequence opt3 from neuraminidase__InfluenzaA__AFG72848
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaaucagcagaguacaggaauuggaguaagccucagugcaacaucacaggguucgccccauuuagcaaagacaauuccauacggcugucugcgggaggugauauuugggugacccgcgagcccuaugucucgugugacccugauaagugcuaccaauucgcucuaggccaggggacgacucucaacaauggacauucaaacgacaccgugcacgaucgaacaccauaucguacucugcuuaugaaugaacugggcguucccuuucauuuggguaccagacagguguguaucgccuggagcaguuccucuugccacgacgggaaggcauggcuccaugucugugugacaggagaugacaaaaacgccaccgcuagcuucauuuacaauggcaggcugguagauuccaucggcucauggaguaagaaauauauccugcggacgcaggagagcgaaugcguuuguauuaacgggacuugcacaguggucaugaccgacggaucugcauccgguaaggccgauacuaaaauacucuuuaucgaggagggcaagauuauccacauaucaacauuaagcgggagugcucaacacguggaagagugcucuuguuacccucgcuacccaggagugagaugcgucuguagggacaacuggaagggcuccaaucggccgauuguugauaucaacgugaaagacuauagcaucguaucgucuuacgugugcuccggucuggucggggacacgccccgcaagaaugauucaaguagcuccucucauugucuugacccuaacaaugaagagggaggccacggcgugaaagggugggccuucgaugacggaaacgauguuuggaugggucgaaccauuagcgaaaaguugagaucaggcuaugagaccuuuaaagugaucgagggguggaguaagccaaauuccaaacugcagauuaacaggcaggucauaguggaacggggaaaucguagcggcuacucugguaucuucucaguagaggggaagaguugcauuaaccgcuguuuuuauguugaacuaaucagaggcaggaaggaggaaacagaggugugguggacuagcaauuccaucgucguguucugcggaaccucuggcacauacgggacuggaucguggcccgacggugcggauauuaaccucaugccuauauga

SEQ ID NO: 143982 - RNA, 1410 nt, Artificial Sequence
  derived and/or modified sequence opt3 from neuraminidase__InfluenzaA__AFG72859
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacauugugcacgaucgaaccccauaucguacacugcuuaugaaugaacugggaguucccuuucauuugggcacuaaacaggugugcaucgcuuggagcaguuccucuugucacgacgguaaggccuggcuccaugucugcgugaccggggaugacgagaacgcaacagccagcuucaucuacaauggaagacugguagauuccauuguuucauggaguaagaaaauacugaggacccaggaaagcgagugugugugcaucaacggcacguguacugucgugaugacagacggcucugcuuccgggaaggcagauaccaaaauucucuuuaucgaggaaggaaagauagugcacacuucaacauuaagcgguagugcccaacacgucgaggaaugcucuugcuauccucgguacccaggcguucgcugugugugcagagacaacuggaagggguccaauaggccgauuguagauaucaacaucaaagacuacagcauugugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccaucagcgagaaguugcgaucaggauacgagaccuuuaaagucauugaagguuggaguaauccaaacuccaagcugcagauaaauagacaggugaucguagacaggggcaaccggagcggguauucuggaauuuucucaguugagggcaaaaguuguaucaaucguugcuuuuacguggaacuaauccgcgguagaaagcaggagacagaaguccucuggacuagcaacuccauuguggucuucugugggaccucuggcacauauggaacuggcucguggcccgauggggccgacauaaaucugaugccuaucuga

SEQ ID NO: 143983 - RNA, 1410 nt, Artificial Sequence
  derived and/or modified sequence opt3 from neuraminidase__InfluenzaA__AFG72870
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcacuucugguaaggcagauacaaaaauauuauuuaucgaggaaggcaagauugugcacaucuccacccugucagggagcgcccaacacguggaggaaugcaguuguuauccucgguacccaggaguccgcugcguuuguagagacaacuggaagggcucuaauaggccgauaguggauauuaacguaaaagacuacuccaucgugagcucguaugucugcucuggucuugugggggacacgccccggaagaaugauuccuucucaaguagccauuguuuggacccuaacaaugaggaaggaggccacggcguuaaagggugggcuuuugaugacggaaacgauguguggaugggucgcaccaucuccgagaagcugcgaucuggcuacgagacauucaaagucauugaaggguggagcaagccaaauucaaaacuacagaucaacagacaggugauuguagagaggggaaaucggaguggcuauuccgguauauuuagcguugaaucuaagucaugcaucaaccguuguuucuacguggagcucauucgcgggagaaaggaagagacugaggucugguggaccaguaauagcaucguggucuuuugcggcacauccggaacuuauggcaccgggucuuggcccgacggagccgauaucaaccugaugccuauuuga

SEQ ID NO: 143984 - RNA, 1410 nt, Artificial Sequence
  derived and/or modified sequence opt3 from neuraminidase__InfluenzaA__AFG72892
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaacuggaagggguccaacaggccgauaguagacauuaauaucaaagacuacagcaucgugucgucuuaugucuguuccggacuggugggcgauacgccccggaagaacgacucaaguagcuccucucauugccuugauccuaauaacgaggaaggugggcacggaguuaaaggcugggcuuucgacgauggcaaugacguguggauggggcgcaccauuagcgagaaguugcgaucaggauacgagacauuuaaagucaucgaagguuggaguaacccaaauuccaagcugcagauuaacagacaggugauaguagauaggggcaaucggagcggguauucuggaaucuucucaguugagggcaaaaguuguauuaaccguugcuuuuacguggaacuaauccgcgguagaaaggagaagacugaaguccucuggaccagcaauuccaucguggucuucugugggacaucuggcacuuauggaaccggcucguggcccgacggggccgauauuaaccugaugccuauauga

SEQ ID NO: 143985 - RNA, 1410 nt, Artificial Sequence
  derived and/or modified sequence opt3 from neuraminidase__InfluenzaA__AFG72903
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaagauucaaguagcuccucucauugccuugacccuaauaacgaggaaggugggcacggaguuaagggcugggcuuucgaugacggcaaugauguguggauggggcgcaccauuagcgagaaauugcgaucaggauacgagacauuuaaggucaucgaagguuggaguaacccaaauuccaaacugcagauuaacagacaggugauaguagacaggggcgaucggagcggguauucuggaaucuucucaguugagggcaagaguuguauuaaucguugcuuuuacguggaacuaauccgcgguagaaaggaggaaacugagguccucuggaccagcaacuccaucguggucuucugugggacaucuggcacuuauggaaccggcucguggcccgacggggccgauauuaaucugaugccuauauga

SEQ ID NO: 143986 - RNA, 1410 nt, Artificial Sequence
  derived and/or modified sequence opt3 from neuraminidase__InfluenzaA__AFG72936
augaaccccaaucagaagaucauuaccauaggcagcgugucccugacaaucucuacuauuugcuucuuuauccaaauugccauccucauaacgaccgucacacuucacuucaaacaguacgaguuuaacucaccuccaaauaaccagguuaugcugugugaaccgacuaucauugagagaaauaucaccgaaauuguguauuugacaaacaccacuaucgagaaggaaauaugccccaaauuagcugaguacaggaauuggaguaagccucagugugacauuacaggguucgcaccauuuagcaaagauaacuccauccggcugucugccggaggugacauuuggguaacccgcgagcccuaugugucgugcgauccugacaaguguuaccaauucgcgcuaggccaggggacgacucucaauaacguccauucaaauaacaucgugcgagaucguaccccauauagaacacugcuuaugaaugaacugggaguucccuuucacuugggcacuaaacaggugugcaucgcuuggagcaguuccucuugucaugacgguaaggccuggcuccacgucugcauuaccggggaugacaagaacgcaacagccagcuucauauacaauggaaggcugguggauuccguaguuucauggaguaaagagauccugcggacccaggaaagcgagugugugugcauuaacggcacguguacugucgugaugacagacggcucugcuuccgggaaggcagauaccaaaauccucuuuauagaggaaggaaagauugugcauacuucaacauuaagcgguagugcccaacacgucgaggaaugcucuugcuauccucgcuacccaggcguuagaugugugugcagggacaacuggaagggguccaaucggccgaucguagauaucaacauuaaagaccacagcaucgugucgucuuacgucuguuccggacuggugggcgacacccccaggaagaaugauucaaguagcuccucucauugccuugacccuaacaaugaggaaggugggcacggaguuaaaggcugggcuuucgaugacggcaacgauguguggauggggcgaacgauuagcgagaagucaagauugggauaugagaccuuuaaagucauagaagguuggaguaaucauaaguccaaacugcagaucaaccgccaggugauuguagaccggggcaaucguagcggguacucuggaaucuucucaguugagggcaagaguuguaucaaccgcugcuuuuauguggaacuaauuagagguaggaaggaggaaacagagguccucuggacuagcaauuccauaguggucuucugugggaccucuggcacauacggaacuggcucguggccagauggggccgaccugaaccuuaugcccaucuga

SEQ ID NO: 143987 - RNA, 1410 nt, Artificial Sequence
  derived and/or modified sequence opt3 from neuraminidase__InfluenzaA__AFG72958
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacauugugcgagaucguaccccauauagaacacugcuuaugaaugaacugggaguucccuuucacuugggcacuaaacaggugugcaucgcuuggagcaguuccucuugucaugacgguaaggccuggcuccacgucugcaucaccggggaugacaagaacgcaacagccagcuucauuuacaauggaaggcugguggauuccguaguuucauggaguaaagagauacugcggacccaggaaagcgagugugugugcaucaacggcacguguacugucgugaugacagacggcucugcuuccgggaaggcagauaccaaaauucucuuuaucgaggaaggaaagauagugcauacuucaacauuaagcgguagugcccaacacgucgaggaaugcucuugcuauccucgcuacccaggcguuagaugugugugcagggacaacuggaagggguccaaucggccgauuguagauaucaacaucaaagaccacagcauugugucgucuuacgucuguuccggacuggugggcgacacccccaggaagaaugauucaaguagcuccucucauugccuugacccuaacaaugaggaaggugggcacggaguuaaaggcugggcuuucgaugacggcaacgauguguggauggggcgaacgaucaaugagaccagcagauugggauaugagacauuuaaggucauugaagguuggucaaacccaaaaaguaagcugcagauaaaucgccaggugaucguagaccggggcaaccguuccggguacagcggaauuuucucuguugagggcaaaucauguaucaaucgcugcuuuuauguggaacuaaucagagguaggaaggaggaaacugagguccucuggaccaguaacagcauuguggucuucugugggacauccggcacuuacggaaccggcucuuggcccgauggggccgaccugaaucuuaugccuauauga

SEQ ID NO: 143988 - RNA, 1410 nt, Artificial Sequence; identical to SEQ ID NO: 136119
  derived and/or modified sequence opt3 from neuraminidase__InfluenzaA__AFG98811

SEQ ID NO: 143989 - RNA, 1410 nt, Artificial Sequence
  derived and/or modified sequence opt3 from neuraminidase__InfluenzaA__AFG98822
augaaccccaaucagaagaucauuaccauaggcagcgugucccugaucauugccacagucugcuuccucaugcaaaucgcuauucuuguuacuacggugacccugcacuuuaaacagcaugagugugacucuccuucaaguaaccagguaauguugugcgaaccaaucauaaucgagagaaauauuacagaaaucguguacuuaaacaauacuaccauugagaaggaaacauguccgaaacuggucgaguauaggaacuggagcaagccccagugcaaaaucaccggguucgcaccuuuuuccaaggauaauucuauacggcuaucggccggaggugacauuugggugacucgcgagccauacguuucaugugaucccggcaagugcuaucaauucgcgcucgggcagggaacaacccuggacaacaaacacagcaaugauacgauccaugacaggauuccucaccguacucuucugaugaacgaauugggcgugccauuucaucucgguaccagacaggucuguaucgcuuggaguuccucuagcugccacgaugggaaggccuggcugcacguguguguaacaggagacgauaaaaaugcaacugccuccuucaucuacgacggcaggcugguugauucaauuggcaguuggagccagaacauacuccggacccaagagucugaaugcguguguaucaaugggacaugcaccgucgugaugacggacggauccgcuucaggucgcgcagauacuagaauuuuauuuaucgaggagggcaagauagugcauauuagcccccugagugggucugcccagcacgucgaagagugcuccuguuauccuagguacccagacguucggugcaucugucgcgacaacuggaaaggaagcaaucgaccgaucguggauauuaacaugaaggacuauucgaucgauucuuccuacguaugcucaggccuugugggugacacacccagaaacgaugacaggaguagcaaguccaauugucggaacccuaauaacgaacgugggaaucauggagucaaaggcugggcuuucgauaacggcaaugacguguggauggggcgcaccauuucuaaggauuugagaagcggauacgagacuuuuaaaguuauagguggcuggucaacaccaaacaguaagucccagaucaaucgacaggugauugucgacagcgauaaccggucuggguauucaggaaucuucaguguggaaggcaaaagcugcaucaaucgauguuuuuacguagagcugauucgcgguagagagcaagaaaccaggguuugguggacguccaacucuauaguggucuucugcgggaccucgggcacauauggaacuggcagcuggcccgacggggccaauaucaacuuuaugccuauuuga

SEQ ID NO: 143990 - RNA, 1410 nt, Artificial Sequence; identical to SEQ ID NO: 142143
  derived and/or modified sequence opt3 from neuraminidase__InfluenzaA__AFG98833

SEQ ID NO: 143991 - RNA, 1410 nt, Artificial Sequence
  derived and/or modified sequence opt3 from neuraminidase__InfluenzaA__AFG98844
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaugugucccaaauuaguggaguacaggaacuggucaaagccucagugcaaaaucacuggguucgccccauuuaguaaggauaauagcauacggcuguccgcgggaggugacauuugggucacacgcgagcccuaugugucuugugauccuggcaagugcuaccaauucgcucuagggcagggaaccacgcucaacaaucgacauucgaacgacacuauccacgaucguauuccacauagaacccugcuuaugaaugaacugggcguucccuuucacuuggguacaaggcaaguguguaucgccuggucaagcaguuccugccaugacgggaaagcauggcuccacgucugugugacuggagaugacaagaacgccaccgcuucuuucaucuaugauggccggcugguagacagcauuggcuccuggucacagaauauacugcgcacacaggagagugaaugcguuuguaucaacagaaccugcacgguggucaugacugaugggagcgcaucuggaaaagccgacacaaggauucucuuuaucgaggaggguaagauagugcacauuuccccuuuaucaggcagcgcucagcauguggaagagugcaguuguuacccacgguauccggggguccgcugcaucugucgagauaauuggaaaggaucuaacagacccguuguggacaucaacguaaaggacuacuccauugauagcucguacgugugcucuggccuggucggugacaccccuaggaauaacgaucgguccucaaguagcuauugucguaauccaaacaaugaacgcgggaaccacggagugaagggcugggccuucgacgaugagaaugacguuuggaugggcagaacuaucuccaaagauucuaggagcggguacgaaacauuuaaggugauuggagguuggucaacccccaacaguaaaucccagauaaaucggcaggucaucguggacagcgauaaccgaucuggcuauucagggauuuucaguguagagggaaagagcugcaucaaucgcuguuuuuacguugagcuuaucagaggcagggaacaagagacgcgggugugguggaccuccaacucuauugucguguucugcgguacaucggggacuuauggcaccggaagcuggccugacggcgcggauauaaauuugaugccaaucuga

SEQ ID NO: 143992 - RNA, 1410 nt, Artificial Sequence; identical to SEQ ID NO: 136134
  derived and/or modified sequence opt3 from neuraminidase__InfluenzaA__AFG98855

SEQ ID NO: 143993 - RNA, 1410 nt, Artificial Sequence; identical to SEQ ID NO: 136988
  derived and/or modified sequence opt3 from neuraminidase__InfluenzaA__AFG98866

SEQ ID NO: 143994 - RNA, 1410 nt, Artificial Sequence
  derived and/or modified sequence opt3 from neuraminidase__InfluenzaA__AFG98877
augaaccccaaucagaagaucauuaccauaggcagcgugucccugacaaucgccacuauuugcuuccucaugcaaaucgcuauucuugucacgaccguuacacugcacuuuaaacaguacgagugugacucuccuccaaacaaucaggugaugccgugcgaacccaucauaaucgagagaaacauuacugaaaucguauauuugaccaauacaaccauugagaaggaaaucuguccuaaauuaguggaguacaggaacuggucaaagccacagugcaaaauaacuggguucgcacccuuuaguaaggauaauagcauucggcuguccgccggaggugacaucugggucacacgcgagccuuaugugucuugugauccaggcaagugcuaccaauucgcgcuagggcagggaaccacgcucgacaacaaacauucgaaugauacuauucacgaccgaacaccccaucguacccugcuuaugaacgaacugggcguuccuuuucacuuggguacuagacagguguguaucgcuuggucaagcaguuccugccaugaugggaaggccuggcuccacgucugugugaccggauaugacaaaaaugcaacagccucuuucaucuacgauggcaggcugguagacagcauuggcuccuggucacagaacauacugcggacccaagagagugaaugcguuuguaucaaugggacgugcacuguggucaugacagauggaagcgcuucuggucgcgcagacaccaagauucucuuuaucgaggagggcaaaauagugcacauuuccccauuaucagggagcgcccagcauguggaagagugcaguuguuauccgagauaccccggagucaggugcaucugucgggauaacuggaagggcucuaaucgcccuguuguggacaucaacguaaaggacuacuccauugauagcucguaugugugcucuggucuggucggggacacuccacgaaacaaugauagauccucaaacaguuacuguaggaaucccaacaaugaaaaaggaaaccacggcgugaagggcugggcuuucgacgaugggaaugacguuuggaugggacggacaaucagcgaggauucccguucugguuaugaaaccuuuaaagugauuggcggguggagcacgccuaacucaaaacuucagauaaaucgccaggucaucguggacagugauaacagauccggauacagcggcauuuucucuguagaggguaagucaugcaucaauagguguuuuuauguugaguugauccgggggcgagaacaagagacccgcgugugguggacaaguaacagcauugucguguucugcggcacuuccggaaccuacggcacagggucuuggccagacggagccgauauaaaucugaugcccaucuga

SEQ ID NO: 143995 - RNA, 1410 nt, Artificial Sequence; identical to SEQ ID NO: 136134
  derived and/or modified sequence opt3 from neuraminidase__InfluenzaA__AFG98888

SEQ ID NO: 143996 - RNA, 1410 nt, Artificial Sequence
  derived and/or modified sequence opt3 from neuraminidase__InfluenzaA__AFG98899
augaaccccaaucagaagaucauuaccauaggcagcgugucccugaucauugccacaaucugcuuccucaugcaaauugcuauccuugucacuacgguuacccugcacuuuaaacaguacgagugugacucuccugcaaacaaucaggugaugccaugcgaaccgauaaucauugagagaaacaucacagaaauuguauauuugacuaauaccacaaucgagaaggaaauaugucccaaauuaguggaguacaggaacuggucaaagccucagugcaaaauuaccggguucgccccauuuaguaaggauaauagcauccggcuguccgcgggaggugacauuugggucacucgcgagcccuaugugucuugugauccuggcaagugcuaccaauucgcucuagggcagggaacaacccucgacaacaaacauucgaaugauacgauccacgaccgaacuccacaucguacccugcuuaugaacgaacugggcguucccuuucacuuggguacaagacagguguguaucgccuggucaagcaguuccugccaugaugggaaggcauggcuccacgucugugugacuggauaugacaaaaaugccaccgcuucuuucauuuacgauggcaggcugguagacagcauaggcuccuggucacagaacauccugcggacacaagagagugaaugcguuuguauuaaugggaccugcacgguggucaugacugauggaagcgcaucuggucgcgccgacacaaagauccucuuuauagaggagggcaaaauugugcacaucuccccuuuaucagggagcgcucagcauguggaagagugcaguuguuauccaagauacccgggagucaggugcaucugucgggauaacuggaagggcucuaaucgccccguuguggacauuaacguaaaggacuacuccaucgauagcucguaugugugcucuggucuggucggggacaccccucgaaacaaugauagauccucaaacaguuacuguaggaauccaaacaaugaaaaaggaaaccacggcgugaagggcugggccuucgacgaugggaaugacguuuggaugggacggacuauuagcgaggauucccguucugguuaugaaacauuuaaagugauaggcggguggagcacccccaacucaaaacuucagaucaaucgccaggucauuguggacagugauaacagauccggauacagcggcaucuucucuguagaggguaagucaugcaucaauagguguuuuuauguugaguugauucgggggcgagaacaagagacgcgcgugugguggaccaguaacagcauagucguguucugcggcacauccggaacuuacggcaccgggucuuggccugacggagcggauaucaaucugaugccaauuuga

SEQ ID NO: 143997 - RNA, 1410 nt, Artificial Sequence; identical to SEQ ID NO: 136134
  derived and/or modified sequence opt3 from neuraminidase__InfluenzaA__AFG98910

SEQ ID NO: 143998 - RNA, 1410 nt, Artificial Sequence; identical to SEQ ID NO: 136134
  derived and/or modified sequence opt3 from neuraminidase__InfluenzaA__AFG98921

SEQ ID NO: 143999 - RNA, 1410 nt, Artificial Sequence
  derived and/or modified sequence opt3 from neuraminidase__InfluenzaA__AFG98932
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaguagagagaaacaucacugaaauuguguauuugaccaauacaaccaucgagaaggaaauuugucccaaauuagucgaguacaggaaguggucaaaaccucagugcaagaucacuggguucgccccauuuaguaaggauaacagcauacggcuguccgcgggaggugacauuugggugacacgcgagcccuauguuucuugugauccuggcaaaugcuaccaauucgcucuagggcagggaaccacgcucgacaauaagcauucgaacgauacuauccacgaccgaaccccacaucguacacugcuuaugaaugaacugggcgugcccuuucacuuggguacuagacaggucuguauugccuggucaagcaguuccugccaugaugggaaagcauggcuccacguguguguaaccggauaugacaagaacgccacagcuucuuucaucuacgauggcaggcugguugacagcaucggcuccuggucacagaauauucugcggacccaagagagugaaugcguguguauaaacgggacgugcacugucgugaugacagauggaagcgcaucuggucgcgccgacaccaaaauccucuuuauugaggagggcaagaucgugcacauauccccuuuaucagggagcgcucagcaugucgaagagugcaguuguuauccaagauacccgggaguuaggugcauuugucgggauaauuggaagggcucuaaccgccccgugguagacaucaaugugaaagacuacuccaucgauagcucguaugucugcucuggucuggugggggacacuccucgaaacaacgauagauccucaaauaguuacuguaggaacccaaauaacgaaaagggaaaucacggcguuaaaggcugggccuucgacgaugggaacgacguguggaugggacggacaauuagcgaggauucccguucugguuaugaaaccuuuaaggucaucggcggguggagcacgcccaauucaaaacuucagauuaaccgccaggugauaguagacagugauaauagauccggauacagcggcaucuucucuguugaggguaagucaugcauuaacagguguuuuuauguggaguugauccgggggcgagaacaagagacccgcgucugguggacaaguaauagcaucguggucuucugcggcacuuccggaaccuacggcacagggucuuggccugacggagcggauauuaaccugaugccaauauga

SEQ ID NO: 144000 - RNA, 1410 nt, Artificial Sequence
  derived and/or modified sequence opt3 from neuraminidase__InfluenzaA__AFG98943
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaccccacaucguacacugcuuaugaacgaacugggcguucccuuucacuuggguacuagacagguguguaucgccuggucaagcaguuccugccaugaugggaaggcauggcuccacgucugugugaccggauaugacaaaaaugccacagcuucuuucaucuacgauggcaggcugguagacagcauuggcuccuggucacagaacauacugcggacccaagagagugaaugcguuuguaucaaugggacgugcacuguggucaugacagauggaagcgcaucuggucgcgccgacaccaagauucucuuuaucgaggagggcaaaauagugcacauuuccccuuuaucagggagcgcucagcauguggaagagugcaguuguuauccaagauacccgggagucaggugcaucugucgggauaacuggaagggcucuaaucgccccguuguggacaucaacguaaaggacuacuccauugauagcucguaugugugcucuggucuggucggggacacuccucgaaagaacgauagauccucaaauaguuacuguaggaacccaaauaacgaaaaaggaaaucacggcgugaaaggcugggccuucgacgaugggaacgacguuuggaugggacggacaaucagcgaggauucccguucugguuaugaaaccuuuaaggugauuggcggguggagcacgcccaauucaaaacuucagauaaaccgccaggucaucguggacagugauaauagauccggauacagcggcauuuucucuguagaggguaagucaugcaucaacagguguuuuuauguugaguugauccgggggcgagaacaagagacccgcgugugguggacaaguaauagcauugucguguucugcggcacuuccggaaccuacggcacagggucuuggccugacggagcggauauagaccugaugccaaucuga

SEQ ID NO: 144001 - RNA, 1410 nt, Artificial Sequence
  derived and/or modified sequence opt3 from neuraminidase__InfluenzaA__AFG98965
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgacuaucauagagagaaacaucaccgaaauuguauauuugacaaauaucaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaccccacaucguacacugcuuaugaacgaacugggcguucccuuucacuuggguacuagacagguguguaucgccuggucaagcaguuccugccaugaugggaaggcauggcuccacgucugugugaccggauaugacaaaaaugccacagcuucuuucaucuacgauggcaggcugguagacagcauuggcuccuggucacagaacauacugcggacccaagagagugaaugcguuuguaucaaugggacgugcacuguggucaugacagauggaagcgcaucuggucgcgccgacaccaagauucucuuuaucgaggagggcaaaauagugcacauuuccccuuuaucagggagcgcucagcauguggaagagugcaguuguuauccaagauacccgggagucaggugcaucugucgggauaacuggaagggcucuaaucgccccguuguggacaucaacguaaaggacuacuccauugauagcucguaugugugcucuggucuggucggggacacuccucgaaacaaugauagauccucaaacaguuacuguaggaauccaaacaaugaaaaaggaaaccacggcgugaagggcugggccuucgacgaugggaaugacguuuggaugggacggacaaucagcgaggauucccguucugguuaugaaaccuuuaaagugauuggcggguggagcacgcccaacucaaaacuucagauaaaucgccaggucaucguggacagugauaacagauccggauacagcggcauuuucucuguagaggguaagucaugcaucaauagguguuuuuauguugaguugauccgggggcgagaacaagagacccgcgugugguggacaaguaacagcauugucguguucugcggcacuuccggaaccuacggcgcggggucuuggccugacggagcagauauaaaucugaugccaaucuga

SEQ ID NO: 144002 - RNA, 1410 nt, Artificial Sequence
  derived and/or modified sequence opt3 from neuraminidase__InfluenzaA__AFG98976
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuuggccaauaccacaauugagaaggaaaucugucccaaauuaguggaguacaggaacuggucaaagccucagugcaaaauaaccggguucgcgccauuuaguaaggauaauagcauucggcuguccgcuggaggugacaucugggucacucgcgagcccuaugugucuugugauccuggcaagugcuaccaauucgcccuagggcagggaacaacccucgacaacaaacauucgaaugauacgauucacgaccgaacuccacaucguacccugcuuaugaacgaacugggcguucccuuucacuuggguacaagacagguguguaucgcauggucaagcaguuccugccaugaugggaaggccuggcuccacgucugugugacuggauaugacaaaaaugcuaccgcaucuuucaucuacgauggcaggcugguagacagcauuggcuccuggucaaagaacauacugcggacacaggagagugaaugcguuuguaucaaugggaccugcacgguggucaugacugauggaagcgccucuggucgcgcugacacaaaaauucucuuuaucgaggagggcaagauagugcacauuuccccuuuaucagggagcgcccaacauguggaagagugcaguuguuauccaagauacccgggagucaggugcaucugucgggauaacuggaagggcucuaaucgccccguuguggacaucaacguaaaagacuacuccauugauagcucguaugugugcucuggucuggucggggacaccccucgaaacaaugauagauccucaaguagcuacuguaggaacccaaauaacgaaaagggaaaucacggcgugaaaggcugggcguucgacgaugggaacgacguuuggaugggacggacuaucuccgaggauucucguagcgguuaugaaacauuuaaggugauuggcggguggucaacccccaauaguaaacuucagauaaaccgccaggucaucguggacuccgauaauagaagcggauacucuggcguauucucaguugaggguaagaguugcauuaacagguguuuuuauguggaguugauccgggggcgagaacuggagacgcgcgucugguggaccagcaauuccaucguggucuucugcggcacaucuggaacuuacggcaccgggucguggccugacggagcagauauuaaccuaaugccaauauga

SEQ ID NO: 144003 - RNA, 1410 nt, Artificial Sequence; identical to SEQ ID NO: 144002
  derived and/or modified sequence opt3 from neuraminidase__InfluenzaA__AFG98987

SEQ ID NO: 144004 - RNA, 1410 nt, Artificial Sequence
  derived and/or modified sequence opt3 from neuraminidase__InfluenzaA__AFG98998
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgaaaacaaacauucgaaugacacuauucacgaucgaaccccacaucguacacugcuuaugaacgagcugggcguucccuuucacuuggguacuagacagguguguaucgccuggucaagcaguuccugccaugacgggaaggcauggcuccacgucugugugaccggauaugauaaaaaugccacagcuucuuucaucuacgacggcaggcugguagauagcauuggcuccuggucacagaacauacugcggacccaagaaagugagugcguuuguaucaaugggacgugcacuguggucaugacagacggaagcgcaucuggucgcgccgauaccaagauucucuuuaucgaggaaggcaaaauagugcacauuuccccuuuaucagggagcgcucagcauguggaggaaugcaguuguuauccaagauacccgggagucaggugcaucugucgggacaacuggaagggcucuaaucgccccguuguggauaucaacguaaaggacuacuccauugacagcucguaugugugcucuggucuggucggggauacuccucgaaagaacgacagauccucaaguagcuacuguaggaauccaaacaaugagaaaggaaaccacggcgugaaaggcugggccuucgaugacgggaaugauguuuggaugggacggacaaucuccgaagacucucguagcgguuaugagaccuuuaaggugauuggcggguggucaacgcccaacaguaaacuucagauaaaucgccaggucaucguggauuccgcgaacagaagcggauacucuggcauuuucucaguagaggguaagaguugcaucaauagguguuuuuauguugaauugauccgggggcgagagcaagaaacccgcgugugguggacaagcaacuccauugucguguucugcggcacuucuggaaccuacggcacagggucguggccugacggagcagauauaaaucugaugccaaucuga

SEQ ID NO: 144005 - RNA, 1410 nt, Artificial Sequence; identical to SEQ ID NO: 144002
  derived and/or modified sequence opt3 from neuraminidase__InfluenzaA__AFG99009

SEQ ID NO: 144006 - RNA, 1410 nt, Artificial Sequence
  derived and/or modified sequence opt3 from neuraminidase__InfluenzaA__AFG99020
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaccccacaucguacacugcuuaugaacgaacugggcguucccuuucacuuggguacuagacagguguguaucgccuggucaagcaguuccugccaugaugggaaggcauggcuccacgucugugugaccggauaugacaaaaaugccacagcuucuuucaucuacgauggcaggcugguagacagcauuggcuccuggucacagaacauacugcggacccaagagagugaaugcguuuguaucaaugggacgugcacuguggucaugacagauggaagcgcaucuggucgcgccgacaccaagauucucuuuaucgaggagggcaaaauagugcacacuuccccuuuaucagggagcgcucagcauguggaagagugcaguuguuauccaagauacccgggagucaggugcauuugucgggauaacuggaagggcucuaaucgccccguuguggacaucaacguaaaggacuacuccaucgauagcucguaugugugcucuggucuggucggggacacaccucgaaacaaugauagauccucaaguagcuacuguaggaacccaaauaacgaaaaaggaacccacggcgugaagggcugggccuucgacgaugggaaugacguuuggaugggacggacgauuuccgaggauucucguagcgguuaugaaaccuuuaaagugaucggcggguggucaacacccaacaguaaacuucagauuaaucgccaggucauaguggacuccgauaacagaagcggauacucuggcaucuucucaguagaggguaagaguugcauuaauagguguuuuuauguugaguugauccgggggcgagaacaagagacucgcgugugguggaccagcaacuccaucgucguguucugcggcacaucuggaacuuacggcaccgggucguggccugacggagcggauauuaauauaaugccaaucuga

SEQ ID NO: 144007 - RNA, 1410 nt, Artificial Sequence
  derived and/or modified sequence opt3 from neuraminidase__InfluenzaA__AFG99031
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaccccacaucguacacugcuuaugaacgaacugggcguucccuuucacuuggguacuagacagguguguaucgccuggucaagcaguuccugccaugaugggaaggcauggcuccacgucugugugaccggauaugacaaaaaugccacagcuucuuucaucuacgauggcaggcugguagacagcauuggcuccuggucacagaacauacugcggacccaagagagugaaugcguuuguaucaaugggacgugcacuguggucaugacagauggaagcgcaucuggucgcgccgacaccaagauucucuuuaucgaggagggcaaaauagugcacacuuccccuuuaucagggagcgcucagcauguggaagagugcaguuguuauccaagauacccgggagucaggugcauuugucgggauaacuggcgcggcucuaaucgacccguuguggacaucaacguaaaggacuacuccaucgauagcucguaugugugcucuggucuggucggggacacaccuagaaacaaugauagguccucaaguagcuacugucggaacccaaauaacgaaaagggaacccacggcgugaaaggcugggccuucgacgaugggaaugacguuuggaugggacguacgauuuccgaggauucucgcagcgguuaugaaaccuuuaaggugaucggcggguggucaacacccaacaguaaacuucagauuaauagacaggucauaguggacuccgauaacaggagcggauacucuggcaucuucucaguagaggguaagaguugcauuaaucgguguuuuuauguugaguuggugcgagggcgcgaacaagagacuagagucugguggaccagcaacuccaucguggucuucugcggcacaucuggaacuuacggcaccgggucguggccugacggagcggauaucaaucugaugccaauuuga

SEQ ID NO: 144008 - RNA, 1410 nt, Artificial Sequence; identical to SEQ ID NO: 136592
  derived and/or modified sequence opt3 from neuraminidase__InfluenzaA__AFG99042

SEQ ID NO: 144009 - RNA, 1410 nt, Artificial Sequence
  derived and/or modified sequence opt3 from neuraminidase__InfluenzaA__AFG99053
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaccccacaucguacacugcuuaugaacgaacugggcguucccuuucacuuggguacuagacagguguguaucgccuggucaagcaguuccugccaugaugggaaggcauggcuccacgucugugugaccggauaugacaaaaaugccacagcuucuuucaucuacgauggcaggcugguagacagcauuggcuccuggucacagaacauacugcggacccaagagagugaaugcguuuguaucaaugggacgugcacuguggucaugacagauggaagcgcaucuggucgcgccgacaccaagauucucuuuaucgaggagggcaaaauagugcacacuuccucauuaagcgggagugcucagcauguggaagagugcucuuguuauccuagauacccaggagucaggugcauuugucgggauaacuggaagggcuccaaucgcccgguuguggacaucaacguaaaggacuacagcaucgauucgucuuaugugugcuccggucuggucggggacacaccccgaaacaaugauagaucaaguagcuccuacuguaggaacccuaauaacgaaaaaggaacccacggcgugaagggcugggccuucgacgaugggaaugacguuuggaugggacggacgauuucugaggauagccguucagguuaugaaaccuuuaaagugaucggcggguggaguauuccaaacuccaaacuucagauaaaucgccaggucaucguggacagcgauaacagaucuggauacucaggcauuuucaguguagaggguaagagcugcaucaauagguguuuuuauguugaguugauccgggggcgagaacaagagacacgcgugugguggacuuccaacucuauugucguguucugcggcaccucgggaacauacggcacugggagcuggcccgacggagcggauauaaaucugaugccuaucuga

SEQ ID NO: 144010 - RNA, 1410 nt, Artificial Sequence
  derived and/or modified sequence opt3 from neuraminidase__InfluenzaA__AFG99064
augaaccccaaucagaagaucauuaccauaggcagcgugucccugacaaucgccacugucugcuuccucaugcaaauugcuauccuuguuacgaccgugacacugcacuuuaaacaguacgagugugacucuccuccaaacaaucagguaaugccgugcgaacccauuaucauagagagaaacgugacugaaaucgucuauuugaccaauacaaccauugagaaggaaaucuguccuaaauuaguggaguacaggaacuggucaaagccacagugcaaaauuacuggguucgcacccuuuaguaaggauaauagcauccggcuguccgccggaggugacauauggguuacacgcgagccuuaugugucuugugauccaucgaagugcuaccaauucgcgcuaggccaggggaccacgcucgacaacaaacauucaaaugauacuauucacgaccgaacaccccaucguacccugcuuaugaacgaacugggagucccuuuucacuugggcacuagacagguguguaucgcuuggagcaguuccucuugccaugaugguaaggccuggcuccacguauguauuaccggguaugacaaaaaugcaacagccagcuucaucuacgauggaaggcugguugacuccaucggcucauggaguaagaacauucugcggacccaggagagcgaaugcguguguauaaauggcacgugcacugucgugaugacagaugggucugcuuccgagcgcgcagacaccaaaauccucuuuauugaggaaggaaagaucgugcacauaucaccauuaagcgguagugcccaacaugucgaggaaugcucuuguuauccgagauaccccggcguuaggugcauuugucgggauaacuggaagggguccaaucgcccugugguagacaucaacgugaaagacuacagcaucgucucgucuuaugugugcuccggacugguuggcgauacuccacgaaagaacgacagaucaaguagcuccuacuguaggaaucccaacaaugagaaagguaaccacggggugaagggaugggcuuucgaugacggcaaugaugucuggaugggccggacaauuucugaagagagccguucaggguaugagaccuuuaaagugaucggagguuggaguacgccuaacuccaaacuucagauuaaucgccagguaauaguugacagcgauaacagaucuggcuacucagggaucuucaguguggaaggaaagagcugcauuaauagguguuuuuaugucgaguugauccggggccgagaacaggagacccgcgugugguggacauccaacucuaucgucguguucugcgguacuucggggaccuacggcacaggaagcuggccagacggcgccgauauuaaucugaugcccauauga

SEQ ID NO: 144011 - RNA, 1410 nt, Artificial Sequence
  derived and/or modified sequence opt3 from neuraminidase__InfluenzaA__AFG99086
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacguaacugaaauuguguauuugaccaauacaaccaucgagaaggaaauuugucccaaauuagucgaguacaggaacuggucaaagccucagugcaaaaucacuggguucgccccauuuaguaaggauaauagcauacggcuguccgcgggaggugacauuugggugacacgcgagcccuauguuucuugugauccuggcaagugcuaccaauucgcucuagggcagggaaccacgcucgacaacaaacauucgaaugauacuauccacgaccgaaccccauaucguacacugcuuaugaacgaacugggcgugcccuuucauuuggguacuagacaggucuguauugccuggucaagcaguuccugccacgaugggaaggcauggcuccauguguguguaaccggauacgacaaaaaugccacagcuucuuucaucuaugauggcaggcugguugacagcaucggcuccuggucaaagaacauucugcggacccaggagagugaaugcguguguauaaaugggacgugcacugucgugaugacagauggaagcgcaucugagcgcgccgacaccaaaauccucuuuauugaggaagguaagaucgugcacauauccccuuuaucaggcagcgcucaacacgucgaggaaugcaguuguuacccaagauacccggggguuaggugcauuugucgggauaacuggaagggaucuaaucgccccgugguagacaucaacgugaaagacuauuccaucgucagcucguacgugugcucuggccugguuggugauacuccucgaaagaacgacagauccucaaguagcuauuguaggaauccaaacaaugagaaagggaaccauggagugaagggcugggccuucgaugacggcaaugaugucuggauggggcggacaauuuccgaagagucucguagcggauacgagaccuuuaaagugaucgguggcuggucaacgcccaacaguaaacuucagauuaaucgccagguaauaguugacuccgauaacagaagcggguauucuggaaucuucucaguggaaggcaagaguugcauuaauagguguuuuuacgucgaguugauccggggucgagaacaggagacccgcgugugguggacaagcaacuccaucgucguguucugcgggacuucuggcaccuauggaacaggcucguggccugacggggcggauauuaaucugaugccaauauga

SEQ ID NO: 144012 - RNA, 1410 nt, Artificial Sequence
  derived and/or modified sequence opt3 from neuraminidase__InfluenzaA__AFG99097
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacguaacugaaauuguguauuugaccaauacaaccaucgagaaggaaauuugucccaaauuagucgaguacaggaacuggucaaagccucagugcaaaaucacuggguucgccccauuuaguaaggauaauagcauacggcuguccgcgggaggugacauuugggugacacgcgagcccuauguuucuugugauccuggcaagugcuaccaauucgcucuagggcagggaaccacgcucgacaacaaacauucgaaugauacuauccacgaccgaaccccauaucguacacugcuuaugaacgaacugggcgugcccuuucauuuggguacuagacaggucuguauugccuggucaagcaguuccugccacgaugggaaggcauggcuccauguguguguaaccggauacgacaaaaaugccacagcuucuuucaucuaugauggcaggcugguugacagcaucggcuccuggucaaagaacauucugcggacccaggagagugaaugcguguguauaaaugggacgugcacugucgugaugacagauggaagcgcaucugagcgcgccgacaccaaaauccucuuuauugaggaagguaagaucgugcacauauccccuuuaucaggcagcgcucaacacgucgaggaaugcaguuguuacccaagauacccggggguuaggugcauuugucgggauaacuggaagggaucuaaucgccccgugguagacaucaacgugaaagacuauuccaucgucagcucguacgugugcucuggccugguuggugauacuccucgaaagaacgacagauccucaaguagcuauuguaggaauccaaacaaugagaaagggaaccauggagugaagggcugggccuucgaugacggcaaugaugucuggauggggcggacaauuuccgaagagucucgucuuggauacgagaccuuuaaagugaucgguggcuggagcacgcccaacucaaaguugcagauuaaucgccagguaauaguugacagugauaacagauccggguauagcggaaucuucucuguggaaggcaaaucaugcauuaauagguguuuuuacgucgagcugauccggggucgagaacaggagacccgcgugugguggacaaguaacagcaucgucguguucugcgggacuuccggcaccuauggaacaggcucuuggccugacggggcggauauuaaucuaaugccaauauga

SEQ ID NO: 144013 - RNA, 1410 nt, Artificial Sequence
  derived and/or modified sequence opt3 from neuraminidase__InfluenzaA__AFG99119
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccaucauaaucgagagaaacauuacugaaaucguauauuugaccaauacaaccauugagaaggaaaucuguccuaaauuaguggaguacaggaacuggaguaagccacagugcaaaauaacuggguucgcacccuuuagcaaggacaauuccauucggcugucugccggaggugauaucugggucacacgcgagccuuaugugucgugugacccaggcaagugcuaccaauucgcgcuagggcagggaaccacgcucgauaacaaacauucaaaugacacuauucacgaucgaacccccuaucguacacugcuuaugaacgaacugggcguuccuuuucauuuggguacuagacagguguguaucgcuuggagcaguuccucuugccacgacgggaaggccuggcuccaugucugugugaccggacacgauaaaaaugcaacagccagcuucaucuacgacggcaggcugguagauuccauuggcucauggaguaagaacauacugcggacccaggagagcgaaugcguuuguaucaaugggacgugcacuguggucaugacagacggaucugcuuccgagcgcgcagauaccaaaauucucuuuaucgaggaagguaagauagugcacauuucaccauuaagcggcagugcccaacauguggaggaaugcucuuguuauccgagauaccccggggucaggugcguuugucgggacaacuggaagggauccaaucgcccuaucguggauaucaacguaaaagacuacagcauugugucgucuuaugucugcuccggccuggugggugacacuccacgaaagaacgauagaucaaguagcuccuacuguaggaaucccaacaaugagaaagggaaccacggaguuaagggcugggcuuucgacgauggcaaugacguguggauggggcggacaaucucugaagagagccguucaggauaugagaccuuuaaagucauugguggcuggaguacgccuaacuccaaacuucagauaaaucgccaggugaucguagauagcgacaacagaucuggguacucaggaauuuucaguguugaaggcaagagcugcaucaauagguguuuuuauguggaguugauccggggucgagaacaggagacccgcgucugguggacauccaacucuauuguggucuucugcgggacuucgggcaccuacggaacaggcagcuggccagauggggccgacauaaaucugaugcccaucuga

SEQ ID NO: 144014 - RNA, 1410 nt, Artificial Sequence
  derived and/or modified sequence opt3 from neuraminidase__InfluenzaA__AFG99130
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgggcccaucauaaucgaaagaaacauuacugagaucguauauuugaccaauacaaccauugaaaaggagaucuguccuaaauuaguggaauacaggaacuggaguaagccacagugcaaaauaacuggauucgcacccuuuagcaaggacaauuccauucggcugucugccgguggcgauaucugggucacacgcgagccuuaugugucgugugacccagggaagugcuaccaauucgcgcuaggacagggcaccacgcucgauaacaaacauucaaaugacacuauucacgaucgaacccccuaucguacacugcuuaugaacgagcuggguguuccuuuucauuuggggacuagacagguguguaucgcuuggagcaguuccucuugccacgacggaaaggccuggcuccaugucugugugaccggccacgauaaaaaugcaacagccagcuucaucuacgacggcaggcugguagauuccauugggucauggaguaagaacauacugcggacccaggaaagcgagugcguuuguaucaauggaacgugcacuguggucaugacagacgguucugcuuccgaacgcgcagauaccaaaauucucuuuaucgaggagggcaagauagugcacauuucaccauuaagcgggagugcccaacauguggaagagugcucuuguuauccgagauaccccggagucaggugcguuugucgggacaacuggaagggcuccaaucgcccugugguagauaucaacgugaaagacuacagcaucgucucgucuuaugugugcuccggucugguuggggacacuccacgaaagaacgauagaucaaguagcuccuacuguaggaaucccaacaaugaaaaaggaaaccacggcgugaagggcugggcuuucgacgaugggaaugacgucuggaugggacggacaauuucugaggaaagccguucagguuaugagaccuuuaaagugaucggcggguggaguacgccuaacuccaaacuucagaccaaucgccagguaauuguugauagcgacaacagaucuggauacucaggcauauucaguguggaggguaagagcugcaucaauagguguuuuuaugucgaauugauucgggggcgagagcaggaaacacgcgugugguggacuuccaacucuaucgucguguucugcggcaccucgggaacauacggcacugggagcuggccagauggagccgacaucaaucugaugcccauuuga

SEQ ID NO: 144015 - RNA, 1410 nt, Artificial Sequence
  derived and/or modified sequence opt3 from neuraminidase__InfluenzaA__AFG99141
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccaucauaaucgagagaaacauuacugaaaucguauauuugaccaauacaaccauugagaaggaaaucuguccuaaauuaguggaguacaggaacuggaguaagccacagugcaaaauaacuggguucgcacccuuuagcaaggacaauuccauucggcugucugccggaggugauaucugggucacacgcgagccuuaugugucgugugacccaggcaagugcuaccaauucgcgcuagggcagggaaccacgcucgauaacaaacauucaaaugacacuauucacgaucgaacccccuaucguacacugcuuaugaacgaacugggcguuccuuuucauuuggguacuagacagguguguaucgcuuggagcaguuccucuugccacgacgggaaggccuggcuccaugucugugugaccggacacgauaaaaaugcaacagccagcuucaucuacgacggcaggcugguagauuccauuggcucauggaguaagaacauacugcggacccaggagagcgaaugcguuuguaucaaugggacgugcacuguggucaugacagacggaucugcuuccgagcgcgcagagaccaaaauucucuuuaucgaagaggguaagauagugcacauuucaccauuaagcggcagugcccaacauguggaagagugcucuuguuauccgagauaccccggggucaggugcguuugucgggauaacuggaagggauccaaucgcccugugguagacaucaacgugaaagauuacagcaucgucucgucuuaugugugcuccggccugguuggugacacuccacgaaagaacgacagaucaaguagcuccuacuguaggaaucccaacaaugaaaaagggaaccacggagugaagggcugggcuuucgaugacggcaaugaugucuggauggggcggacaauuucugaggagagccguucaggauaugaaaccuuuaaagugaucgguggcuggaguacgccuaacuccaaacuucagauuaaucgccagguaauaguugacagcgauaacagaucuggguacucaggaaucuucaguguggagggcaagagcugcauuaauagguguuuuuaugucgaauugauccggggucgagagcaggaaacccgcgugugguggacauccaacucuaucgucguguucugcgggacuucgggcaccuacggaacaggcagcuggccagacggggccgauauuaaucugaugcccauauga

SEQ ID NO: 144016 - RNA, 1410 nt, Artificial Sequence
  derived and/or modified sequence opt3 from neuraminidase__InfluenzaA__AFG99152
augaaccccaaucagaagaucaugaccauuggcagcgugucccugacaauagccacuaucugcuuccucaugcaaauugcuauccuugucacgaccguuacacugcacuuuaaacauuacgaguucucuucaccuccaaacaaucaggugaugccgugugaacccauuaucauagagagaaacaucacugaaauuguauauuugaccaauacaaccaucgagaaggaagugugcccuaaauuagucgaguacaggaacuggaguaagccacaguguaaaauuacuggguuugcacccuucagcaaggacaauuccauccggcugucugccggaggugauauaugggugacacgcgagccuuauguuucgugcgacccaggcaaguguuaccaguuugcgcuagggcaaggaaccacgcucaacaauaaacacucaaacgauacuauucaugaccgaacccccuaucguacacugcuuaugaaugaacugggcgugccuuuccacuuggguacuagacaggucugcaucgcuuggagcaguuccucuugucaugaugggaaggccuggcuccacgugugcguaaccggacacgacaaaaacgcaacagccagcuuuauuuacgauggcaggcugguugacuccaucggcucauggaguaagaauauccugcggacccaggagagcgaaugugugugcauuaacgggacguguacugucgugaugacagauggaucugcuuccggucgcgcagacaccaaaauacucuucaucgaggagggcaagauugugcauaucucaccauuaagcgggagugcccagcacgucgaagagugcucuugcuauccgagauaccccggaguuaggugugugugccgggauaauuggaagggcuccaaccgcccuauaguagacauuaacgugaaagauuacagcaucgucucgucuuauguguguuccggucugguuggggacacuccacgaaagaaugacagaucaaguagcuccuacugcaggaaccccaauaacgaaaaaggaaaucauggcgugaagggcugggcuuuugaugacgggaacgaugucuggaugggacggacaaucggugaggaacuucguucuggcuaugagaccuucaaagugauugggggauggagcacgccuaauucaaaguugcaaaucaaccgccagguaauuguugacagugauaauagauccggcuacagcgguauauuuucuguggaggggaaaucauguaucaacaggugcuucuaugucgaacugauucggggccgagagcaggaaacccgcgugcuauggacaaguaauagcaucgucguguuuuguggaacuuccggcaccuacgggacaggaucuuggccagacggugccgauaucaaccucaugcccauuuga

SEQ ID NO: 144017 - RNA, 1410 nt, Artificial Sequence; identical to SEQ ID NO: 141011
  derived and/or modified sequence opt3 from neuraminidase__InfluenzaA__AFG99163

SEQ ID NO: 144018 - RNA, 1410 nt, Artificial Sequence
  derived and/or modified sequence opt3 from neuraminidase__InfluenzaA__AFG99174
augaaccccagccagaagaucauuaccauaggcuccgugucucugacaaucgccacuauuugcuuccucaugcaaaucgcuauucuugucacgaccguuacacugcacuuuaaacaguacgaguguucaaguccuccaaauaaccaggugaugccgugcgaacccaucauaaucgagagaaauauuacugaaaucguauauuugaccaacacaaccauugagaaggaaaucuguccuaaauuaauggaguacaggaauuggagcaagccacagugcaaaauaacuggguucgcacccuuuuccaaggacaacucuauucggcugucggccggaggugauaucugggugacacgcgagccuuaugucucaugugacccaggcaagugcuaccaauucgcgcuagggcagggaaccacgcucgauaauaaacauagcaacgacacuauucacgaucgaacccccuaucguacacugcuuaugaaugaacugggcgugccuuuucauuuggguacuagacagguuuguaucgcuuggaguuccucuagcugccacgacgggaaggccuggcuccaugugugugucaccggacacgauaaaaacgcaacagccuccuucaucuacgacggcaggcugguggauucaauuggcaguuggagcaagaauauacugcggacccaggagucugaaugcguauguaucaacgggacgugcacuguugugaugacagacggauccgcuucagagcgcgcagagaccaaaauucucuuuaucgaagaggguaagauaguccacauuagcccauuaaguggcucugcccaacauguggaagagugcuccuguuauccgagauaccccggggugaggugcgucugucgggauaauuggaagggaagcaaccgcccuguuguggacaucaauguaaaagauuacucgaucgugucuuccuaugucugcucaggccuggugggugacacuccacgaaagaacgacagaaguagcuccucuuacuguaggaaccccaauaacgaaaaagggaaucacggaguuaagggcugggcuuucgaugacggcaacgauguguggauggggcggacaauuagcgaggagucacguaguggauaugaaaccuuuaaagucaucgguggcugguccacgccuaauagcaaacuucagauuaaccgccaggugauaguagacucugauaauagaucaggguacaguggaaucuucagcguugagggcaaguccugcauuaacagguguuuuuauguggaauugauccggggucgagagcaggaaacccgcgucugguggacaucuaauucgaucguggucuucugcgggacuagcggcaccuacggaacaggcuccuggccagacggggccgauauuaaccugaugcccauauga

SEQ ID NO: 144019 - RNA, 1410 nt, Artificial Sequence
  derived and/or modified sequence opt3 from neuraminidase__InfluenzaA__AFG99185
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccaucauaaucgagagaaacauuacugaaaucguauauuugaccaauacaaccauugagaaggaaaucuguccuaaauuaguggaguacaggaacuggaguaagccacagugcaaaauaacuggguucgcacccuuuagcaaggacaauuccauucggcugucugccggaggugauaucugggucacacgcgagccuuaugugucgugugacccaggcaagugcuaccaauucgcgcuagggcagggaaccacgcucaacaauaaacauucaaacgauacuauucacgaccgaacccccuaucguacacugcuuaugaaugaacugggcguuccuuuucauuuggguacuaaacagguguguaucgcuuggagcaguuccucuugccacgaugggaaggccuggcuccaugucugugugaccggacacgacaagaacgcaacagccagcuucaucuacgauggcagacugguagacuccauuggcucauggaguaaaaauauacugaggacccaggagagcgaaugcguuuguaucaacgggacgugcacuguggucaugacagauggaucugcuuccgagcgggcagacaccaagauucucuuuaucgaggaagguaagauagugcacauuucaccauuaagcggcagugcccaacauguggaggaaugcucuuguuauccgcgcuaccccggggucagaugcguuuguagggauaauuggaaaggauccaaccggccuaucguggacaucaacguaaaggauuacagcauugugucgucuuaugucugcuccggccuggugggugacacuccacgcaaaaaugaccgaucaaguagcuccuacuguagaaaccccaauaacgagaaggggaaucacggaguuaaaggcugggcuuucgaugacggcaacgauguguggauggggaggacaaucggagaggaacuucggucugguuaugagaccuuuaaggucauuggcggguggagcacgccuaauucaaaauugcagauaaaccgucaggugaucguagacaguaagaaucgcuccggauacagcggcauuuucucuguugaagguaagucaugcaucaacagauguuuuuauguggagcugaucagggggcgggaacaggagacccgagucugguggacaaguaauagcauuguggucuucugcggcacuuccggaaccuacggcacagggucuuggccagauggagccgacauaaaccuaaugcccaucuga

SEQ ID NO: 144020 - RNA, 1410 nt, Artificial Sequence
  derived and/or modified sequence opt3 from neuraminidase__InfluenzaA__AFG99196
augaaccccaaucagaagaucauuaccauaggcagcgugucccugacaaucgccacuauuugcuuccucacgcaaaucgcuauucuugucaccacaguuacucugcacuuuaaacaguacgaguguucuucaaguccuaacaaucaggugaugccaugcgaaccgaucauaaucgagagaaacauuaccgaaaucguauauuugacaaauaccacuauugagaaggaaaucugucccaaauuaguggaguacaggaacuggagcaagccucagugcaaaauaacaggguucgcaccauuuuccaaggacaauucuauucggcugucggccggaggugauaucugggucacccgcgagcccuaugugucaugugacccuggcaagugcuaccaauucgcgcuagggcagggaacgacucucaacaauaaacauagcaacgauaccauucacgaccgaacaccauaucguacucugcuuaugaaugaacugggcguucccuuucauuuggguaccaaacagguguguaucgcuuggaguuccucuagcugccacgaugggaaggccuggcuccaugucuguaucacaggacacgacaagaacgcaaccgccuccuucauuuacgauggcagacugguggacucaauaggcaguuggagcaaaaauauccugaggacgcaggagucugaaugcguauguauuaacgggacuugcacaguugugaugaccgauggauccgcuucagagcgggcagacacuaagauccucuuuauagaggaagguaagauuguccacaucagcccuuuaaguggcucugcccaacauguggaggaaugcuccuguuauccacgcuacccgggggugagaugcgucuguagggauaauuggaaaggaagcaaccggcccaucguugacauuaacgugaaggauuacucgaucguaucuuccuaugugugcucaggccuggucggugacacaccucgcaaaaaugaccgaaguagcuccucuuacuguagaaacccaaauaacgagaaggggaaucacggagugaaaggcugggcuuucgaugacggcaacgauguuuggauggggaggaccauuggagaggaacuucggagcgguuaugagacguuuaaggugauaggcggguggucaacccccaauaguaaauugcagaucaaccgucaggucauuguggacuccggaaaucgcagcggcuacucugguaucuucucaguagaagggaagaguugcaucaacagauguuuuuauguugagcugauuaggggccgggaacaggagacacgagugugguggacuagcaauuccauagucguguucugcggaaccucuggcacauacgggacuggaucguggccugauggugccgacaucaaccuaaugccaauuuga

SEQ ID NO: 144021 - RNA, 1410 nt, Artificial Sequence
  derived and/or modified sequence opt3 from neuraminidase__InfluenzaA__AFG99207
augaaccccaaucagaagaucauuaccauaggcagcgugucccugacaaucgccacuauuugcuuccucaugcaaaucgcuauucuugucacgaccguuacacugcacuuuaaaccuuacgaguguucuucaccaccgaacaaucaggugaugcccugcgaaccuaucauaaucgagagaaacauuacugaaaucguauauuugaccaauacaaccauugagaaggaaaucuguccaaaauuaguggaguacaggaacuggaguaagccccagugcaaaauaacuggguucgcaccuuuuagcaaggacaauuccauucggcugucugccggaggugauaucugggucacacgcgagccauaugugucgugugaccccggcaagugcuaccaguucgcgcuagggcaaggaaccacgcucaacaauaaacauucaaacgauacuauucacgaccgaaccccuuaucguacacugcuuaugaaugaacugggcguuccauuucauuuggguacuaaacagguguguaucgcuuggagcaguuccucuugccacgaugggaaggccuggcuccaugucugugugaccggacacgacaagaacgcaacagccagcuucaucuacgauggcagacugguagacuccauuggcucauggaguaaaaauauacugaggacccaggagagcgaaugcguuuguaucaacgggacgugcacuguggucaugacagauggaucugcuuccgagcgggcagacaccaagauucucuuuaucgaggaagguaagauagugcacauuucaccguuaagcggcagugcccagcauguggaggaaugcucuuguuauccccgcuacccuggggucagaugcguuuguagggauaauuggaaaggauccaaccggccaaucguggacaucaacguaaaggauuacagcauugugucgucuuaugucugcuccggccuggugggugacacuccccgcaaaaaugaccgaucaaguagcuccuacuguagaaacccuaauaacgagaaggggaaucacggaguuaaaggcugggcuuucgaugacggcaacgauguguggauggggaggacaaucggagaggaacuucggucugguuaugagaccuuuaaggucauuggcggguggagcacgccaaauucaaaauugcaaauaaaccgucaggugaucguagacaguaagucccgcagcggauacucuggcauuuucucaguugaagguaagaguugcaucaauagauguuuuuauguggagcugaucagggggcgggaacaggagacccgagucugguggacaagcaacuccauuguggucuucugcggcacuucuggaaccuacggcacagggucguggcccgauggagccgacauaaaucuaaugccgaucuga

SEQ ID NO: 144022 - RNA, 1410 nt, Artificial Sequence; identical to SEQ ID NO: 136830
  derived and/or modified sequence opt3 from neuraminidase__InfluenzaA__AFG99218

SEQ ID NO: 144023 - RNA, 1410 nt, Artificial Sequence
  derived and/or modified sequence opt3 from neuraminidase__InfluenzaA__AFG99229
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccaucauaaucgagagaaacauuacuaagaucguauauuugaccaauacaaccauugaaaaagagaucuguccuaaguuaguggaauacaggaacuggaguaaaccacagugcaagauaacuggguucgcacccuuuagcaaggacaauuccauucggcugucugccggaggugauaucugggucacacgcgagccuuaugugucgugugacccaggcaaaugcuaccaauucgcgcuagggcagggaaccacgcucaacaauaagcauucaaacgauacuauucacgaccgaacccccuaucguacacugcuuaugaaugagcugggcguuccuuuucauuuggguacuaaacagguguguaucgcuuggagcaguuccucuugccacgaugggaaggccuggcuccaugucugugugaccggacacgacaaaaacgcaacagccagcuucaucuacgauggcagacugguagacuccauuggcucauggaguaagaauauacugaggacccaggaaagcgagugcguuuguaucaacgggacgugcacuguggucaugacagauggaucugcuuccgaacgggcagacaccaagauucucuuuaucgaggaggguaaaauagugcacauuucaccauuaagcggcagugcccaacauguggaagagugcucuuguuauccgcgcuaccccggggucagaugcguuuguagggauaauuggaagggauccaaccggccuaucguggacaucaacguaaaagauuacagcauugugucgucuuaugucugcuccggccuggugggugacacuccacgcaagaaugaccgaucaaguagcuccuacuguagaaaccccaauaacgaaaaagggaaucacggaguuaagggcugggcuuucgaugacggcaacgauguguggauggggaggacaaucggagaggaacuucggucugguuaugagaccuuuaaagucauuggcggguggagcacgccuaauucaaaguugcagauaaaccgucaggugaucguagacaguaagaaucgcuccggauacagcggcauuuucucuguugaggguaaaucaugcaucaacagauguuuuuauguggaacugaucagggggcgggagcaggaaacccgagucugguggacaaguaauagcauuguggucuucugcggcacuuccggaaccuacggcacagggucuuggccagauggagccgacauaaaccuaaugcccaucuga

SEQ ID NO: 144024 - RNA, 1410 nt, Artificial Sequence
  derived and/or modified sequence opt3 from neuraminidase__InfluenzaA__AFG99240
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaguaaccaggugaugccgugcgaacccaucauaaucgagagaaauauuacugaaaucguauauuugaccaacacaaccauugagaaggaaaucuguccuaaaccaguggaguacaggaauuggagcaagccccagugcaaaauaacuggguucgcaccuuuuuccaaggacaacucuauucgguuaucggccggaggugauaucugggucacacgcgagccauaugugucaugugaccccggcaagugcuaccaauucgcgcuggggcagggaaccacgcuaaauaacaaacauagcaaugauacuauucacgaccgaaccccuuaucguacacuccugaugaacgaacuuggcguuccauuucaucuggguacuaaacagguguguaucgcuuggaguuccucuagcugccacgaugggaaggccugguugcaugucugugugaccggacacgacaagaaugcaacagccuccuucaucuacgauggcagacucguagacucaauuggcaguuggagcaaaaacauacugaggacccaggagucugaaugcguuuguaucaaugggacgugcacuguggucaugacagauggauccgcuucagagcgggcagacaccaagauucuguuuaucgaggaagguaagauagugcacauuagcccgcucaguggcucugcccaacauguggaggaaugcuccuguuauccccgcuacccuggggucagaugcguuuguagggauaacuggaaaggaagcaaucggccaaucguggacaucaacguaaaggauuacucgauugugucuuccuaugucugcucaggcuuagugggugacacuccccgcaaaaacgaccgauucaguagcuccuacuguagaaauccuaacaaugagaaggggaaccacggaguuaaaggcugggcuuuugaugacggcaaugauguguggauggggaggacaaucggagaggaacugcggucugguuaugagaccuucaaggucauuggcggguggagcacgccaaacucaaaacuucagauaaaucgucaggugaucguagacaguaagaaccgcuccggauacagcggcaucuuuucuguugaagguaagucaugcauuaauagauguuucuauguggaguugaucagggggcgggaacaggagacccgagucugguggacaaguaacagcauuguggucuuuugcggcacuuccggaaccuacggcacagggucuuggcccgauggagccgacauaaaucugaugccgaucuga

SEQ ID NO: 144025 - RNA, 1410 nt, Artificial Sequence; identical to SEQ ID NO: 136829
  derived and/or modified sequence opt3 from neuraminidase__InfluenzaA__AFG99251

SEQ ID NO: 144026 - RNA, 1410 nt, Artificial Sequence
  derived and/or modified sequence opt3 from neuraminidase__InfluenzaA__AFG99273
augaaccccaaucagaagaucauuaccauaggcagcgugucccugacaaucgccacuaugugcuuccucaugcaaauugcuauccuugucacgaccguuacacugcacuuuaaacaguacgaguguucuucaccuccaaacaaucaggugaugccgugcgaacccacuauuaucgagagaaacauaaccgaaaucguauauuugacaaauaccacuauugagaaggaaaucuguccuaaauuaguggaguacaggaacuggaguaagccacagugcaaaauuacaggguucgcacccuuuagcaaggacaauuccauccggcugucugccggaggugauauaugggucacccgcgagccuuaugugucgugugacccaggcaagugcuaccaauucgcgcuagggcagggaacgacucucaacaaucgacauucaaacgauaccguucacgaccguacacccuauagaacucugcuuaugaaugaacugggcgugccuuuucauuuggguaccaaacaggucuguauugcuuggagcaguuccucuugccacgaugggaaggccuggcuccauguguguguaacaggacacgacaaaaacgcaaccgccagcuucaucuacgauggcaggcugguugacuccauuggcucauggaguaagaauauccugcggacgcaggagagcgaaugcguguguaucaacgggacuugcacagucgugaugaccgauggaucugcuuccgagcgcgcagacacuaaaauucucuuuauagaggaagguaagaucgugcacauuucaccauuaagcggcagugcccaacaugucgaggaaugcucuuguuauccgagauaccccgggguuaggugcgugugucgggauaauuggaagggauccaaccgcccuaucguagacauaaacgugaaagauuacagcauugucucgucuuaugugugcuccggccugguuggugacacaccacgaaagaaugacagaucaaguagcuccuacuguaggaaccccaauaacgagaaagggucucacggagugaagggcugggcuuucgaugacggcaaugaugucuggauggggcggaccaucggagaggaacuucguagcgguuaugagacguuuaaagugaucggcggguggucaaccccuaacaguaaguugcagauuaaucgccagguaaucguugacuccggaaacagaagcggcuacucugguauuuucucaguggaagggaaaaguugcauaaauagguguuuuuaugucgagcugauccggggccgagaacaggagacacgcgugugguggacuagcaacuccauugucguguucugcggaaccucuggcacauacgggacuggaucguggccagauggugccgacaucaaucuaaugcccaucuga

SEQ ID NO: 144027 - RNA, 1410 nt, Artificial Sequence
  derived and/or modified sequence opt3 from neuraminidase__InfluenzaA__AFG99284
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaguaaccaggugaugccgugcgaacccaucauaaucgagagaaauauuacuaagaucguauauuugaccaacacaaccauugaaaaagagaucuguccuaaguuaguggaauacaggaauuggagcaaaccacagugcaagauaacuggguucgcacccuuuuccaaggacaacucuauucggcugucggccggaggugauaucugggucacacgcgagccuuaugugucaugugacccaagcaaaugcuaccaauucgcgcuaggccaggggaccacgcucaauaacaagcauaguaaugauacuauucacgaccgaacccccuaucguacacugcuuaugaacgagcugggaguuccuuuucauuugggcacuaaacagguguguaucgcuugguccucuagcuccugccacgaugguaaggccuggcuccaugucugugugaccgggcacgacgauaaugcaacagccucauucaucuacgacggaagacugguagauaguauuggcagcuggucuaaaaacauacugaggacccaggaauccgagugcguuuguaucaauggcacgugcacuguggucaugacagacgggucagcuagcgaacgggcagauaccaagauucucuuuaucgaggagggaaagauagugcacauuaguccauuaucugguuccgcccaacauguggaagagugcagcuguuauccgcgcuaccccggcgucagaugcguuuguagggacaacuggaaagggucgaaucggccuaucguggauaucaacguaaaggacuacucuauuguguccucauaugucugcaguggacuggugggcgacacuccacgcaaaaacgaucgaagcuccucuagcuacuguagaaaucccaacaaugaaaaggguucacacgggguuaaaggaugggcuuucgacgauggcaacgacguguggaugggcaggacaaucggggaggaacuucggaguggauaugagaccuuuaaggucauugguggcugguccacgccuaauagcaaauugcagauaaaccgucaggugaucguagauucuaagaaucgcucaggguacaguggaauuuucagcguugagggcaaguccugcaucaacagauguuuuuauguggaacugaucaggggucgggagcaggaaacccgagucugguggacaucuaauucgauuguggucuucugcgggacuagcggcaccuacggaacaggcuccuggccagacggggccgauauaaaccuaaugcccaucuga

SEQ ID NO: 144028 - RNA, 1410 nt, Artificial Sequence
  derived and/or modified sequence opt3 from neuraminidase__InfluenzaA__AFG99295
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccacuaucauagagagaaacaucaccgaaauuguauauuugacaaauaccacuaucgagaaggaaauuuguccuaaauuaguggaguacaggaacuggaguaagccacagugcaaaaucacaggguucgcacccuuuagcaaggacaauuccauacggcugucugccggaggugauauuugggucacccgcgagccuuaugugucgugugacccagauaagugcuaccaauucgcgcuaggccaggggacgacucucaacaaucgacauucaaacgacaccguucacgaucguacacccuauagaacucugcuuaugaaugaacugggagugccuuuucauuugggcaccaaacaggucuguaucgcuuggagcaguuccucuugccacgacgguaaggccuggcuccauguguguguaacagggcacgauaaaaacgcaaccgccagcuucauuuacaauggaaggcugguugacuccaucggcucauggaguaagaacauccugcggacgcaggagagcgaaugcguguguauuaauggcacuugcacagucgugaugaccgaugggucugcuuccgagcgcgcagacacuaaaauacucuuuaucgaggaaggaaagauugugcacaucucaccauuaagcgguagugcccaacaugucgaggaaugcucuuguuauccgagauaccccggcguuaggugcgugugucgggauaacuggaagggguccaaccgcccuauaguagacauuaaugugaaagauuacagcaucaucucgucuuaugucugcuccggacuggugggcgacacaccacgaaagaacgacagaucaaguagcuccuacugucagaaucccaacaaugagaaagguucucacgggguuaagggaugggcuuucgaugacggcaacgauguguggaugggcaggaccauuggggaggaacuucggagcggauaugagacguuuaaagucaucgguggcuggucaaccccuaauaguaaguugcagauuaaccgucaggugauaguagacuccgggaaucgcagcggauacucuggcaucuucucaguugaagguaaaaguugcauuaacagauguuuuuauguggagcugaucagggggcggaagcaagaaacacgagucugguggacuagcaauuccaucguggucuucugcggcaccucuggaacauacggcacugggucguggccagauggagccgacauuaaccuaaugcccauauga

SEQ ID NO: 144029 - RNA, 1410 nt, Artificial Sequence
  derived and/or modified sequence opt3 from neuraminidase__InfluenzaA__AFG99317
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccacuaucauagagagaaacaucaccgaaauuguauauuugacaaauaccacuaucgagaaggaaauuuguccuaaauuaguggaguacaggaacuggaguaagccacagugcaauaucacaggguucgcacccuuuagcaaagacaacuccauacggcugucugccggaggugauauuugggucacccgcgagccuuaugugucgugugacccaggcaagugcuaccaauucgcgcuagggcagggaacgacucucaauaaccgacauucaaaugauaccguucacgaccguacacccuauagaacucugcuuaugaacgaacugggcgugccuuuucauuuggguaccaagcaggucuguaucgcuuggagcaguuccucuugccacgaugggaaagccuggcuccauguguguguaacaggacacgacgagaaugcaaccgccagcuucauuuacgauggcaggcugguugacuccaucggcucauggaguaagaacauccugcggacgcaggaaagcgagugcguguguauuaaugggacuugcacagucgugaugaccgauggaucugcuuccgagcgcgcagacacuaaaauacucuuuaucgaagaggguaagauugugcacaucucaccauuaagcggcagugcccaacaugucgaagagugcucuuguuauccgagauaccccgggguuaggugcgugugucgggauaacuggaaaggauccaaccgcccuauaguagacauuaaugugaaggauuacagcaucgucucgucuuaugugugcuccggccugguuggugacacaccacgaaagaacgacagaucaaguagcuccuacuguaggaaucccaacaaugaaaaagggucucacggagugaagggcugggcuuucgaugacggcaacgaugucuggauggggcggaccaucgacgaggagcuucguagcggauaugaaacguuuaaagugauugguggcuggucaaccccuaauaguaaguugcagaucaaccgccagguaauuguugauuccgggaauagaagcggauacucuggcauauucucaguggaggguaaaaguugcaucaacagguguuuuuaugucgaacugauucgggggcgaaagcaggagacacgcgugugguggacuagcaauuccaucgucguguucugcggcaccucuggaacauacggcacugggucguggccagacggagccgauaucaaccuaaugcccauuuga

SEQ ID NO: 144030 - RNA, 1410 nt, Artificial Sequence
  derived and/or modified sequence opt3 from neuraminidase__InfluenzaA__AFG99328
augaaccccaaucagaagaucauuaccauaggcagcgugucccugacacucgccacuaucugcuuccuuaugcaaauugcuauccuggucacgaccguuacauugcacuuuaaacaguacgaguguucuucaccuccaaacaaucaggugaugccgugcgaacccacuauuaucgagagaaacauaaccgaaaucguauauuuaacaaauaccacuauugagaaggaaaucuguccuaaacugguggaguacaggaacuggaguaagccacagugcaaaauuacaggguucgcacccuuuagcaaggacaauuccauccggcuaucugccggaggugauauaugggucacccgcgagccuuaugugucgugugacccaucaaagugcuaccaauucgcgcucggccaggggacgacucugaacaaucgacauagcaacgauaccguucacgaccguacacccuauagaacucuucugaugaaugaauugggagugccuuuucaucucggcaccaggcaggucuguauggcuuggaguuccucuagcugccacgaugguaaagccuggcugcauguguguguaacagggcacgacgagaacgcaaccgccuccuucauuuacgauggacggcugguugacucaaucggcaguuggagcaagaaugugcuccgcacgcaggaaucugagugcgucuguauuaacggcacuugcacaguggugaugaccgauggguccgcuucagagagagcagacacuaaaaucuuauuuaucgaagagggaaagauuguccacauaagcccacugagugguaaugcccaacauguugaagagugcucuuguuauccgagguaccccggcgugcggugcguaugucgcgauaacuggaaaggguccaaccgaccuaucguggacauuaaugucaaggauuacagcaucgugucgucuuauguuugcuccggacuugugggcgacacaccaagaaagaacgacaggucaaguagcuccuacugucggaaucccaacaaugaaaaagguucucacggggucaagggaugggcuuucgaugacggcaacgauguguggaugggccguaccauaggggaggaguugcgcagcggauaugaaacguuuaaaguaauugguggcuggucaaccccuaauaguaagcugcagaucaacagacagguuaucguggacuccgggaauaggagcggauacucuggcauuuucucagucgaggguaaaaguugcaucaaccgguguuuuuauguggaacuaauucgagggcgcaagcaggagacaagagucugguggacuagcaauuccauagugguuuucugcggcaccucuggaacauacggcacugggucguggccagauggagccgacaucaaccucaugcccauuuga

SEQ ID NO: 144031 - RNA, 1410 nt, Artificial Sequence
  derived and/or modified sequence opt3 from neuraminidase__InfluenzaA__AFG99350
augaaccccaaucagaagaucauuaccauaggcagcgugucccugacacucgccacuaucugcuuccuuaugcaaauugcuauccuggucacgaccguuacauugcacuuuaaacaguacgaguguucuucaccuccaaacaaucaggugaugccgugcgaacccacuauuaucgagagaaacauaaccgaaaucguauauuuaacaaauaccacuauugagaaggaaaucuguccuaaacugguggaguacaggaacuggaguaagccacagugcaaaauuacaggguucgcacccuuuagcaaggacaauuccauccggcuaucugccggaggugauauaugggucacccgcgagccuuaugugucgugugacccaucaaagugcuaccaauucgcgcucggccaggggacgacucugaacaaucgacauagcaacgauaccguucacgaccguacacccuauagaacucuucugaugaaugaauugggagugccuuuucaucucggcaccaggcaggucuguauggcuuggaguuccucuagcugccacgaugguaaagccuggcugcauguguguguaacagggcacgacgagaacgcaaccgccuccuucauuuacgauggacggcugguugacucaaucggcaguuggagcaagaauauucuccgcacgcaggaaucugagugcguguguaucaacggcacuugcacagucgugaugaccgauggguccgcuucagagagagcagacacuaaaaucuuauuuauugaagagggaaagauagugcacaucagcccacugagugguucugcccaacaugucgaagagugcuccuguuauccgagguaccccggcguucggugcgugugucgcgauaauuggaaagggagcaaccgaccuauuguagacaucaacgugaaggauuacucgauagucucuuccuaugugugcucaggacuuguuggcgacacaccaagaaagaaugacaggaguagcuccucuuacugucggaaccccaauaacgaaaaagguagccacggggugaagggaugggcuuucgaugacggcaaugaugucuggaugggccguaccauuggggaggaguugcgcucaggauaugaaacguuuaaagugaucgguggcuggaguaccccuaacuccaagcugcagaucaauagacagguaauuguugacagcgggaacaggucuggauacucaggcaucuucaguguggaggguaaaagcugcauuaaucgguguuuuuaugucgaacuaauacgagggcgcaagcaggagacaagagugugguggacuuccaacucuaucgucguguucugcggcaccucgggaacauacggcacugggagcuggccagauggagccgacauuaaucucaugcccaucuga

SEQ ID NO: 144032 - RNA, 1410 nt, Artificial Sequence
  derived and/or modified sequence opt3 from neuraminidase__InfluenzaA__AFG99361
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaaaaugucccaagcuggcagaguacaggaauuggucaaaaccucagugcaagauuacaggguucgccccauuuaguaaggacaacagcauccggcuauccgcgggaggugauauaugggugacccgcgagcccuaugucucuugugacccuggcaaaugcuaccaauucgcucucgggcagggaacgacucugaauaaccgacauucgaaugauaccgugcacgaccguacaccauauagaacucuucugaugaacgaauugggcguucccuuucaucucgguaccaaacagguguguauugccuggucaagcaguuccugccacgaugggaaggcauggcugcaugucugugugacaggacacgacgagaaugccaccgcuucuuucaucuacgauggcaggcugguagacagcauuggcuccuggucaaagaacauccuccggacgcaggaaagugagugcguuuguaucaaugggacuugcacaguggucaugaccgauggaagcgcaucugagcgcgccgacacuaaaauuuuauuuauagaagaggguaagaucgugcacauuuccccucugucaggcagcgcucaacauguggaagagugcaguuguuauccaagauacccgggggucaggugcguuugucgggauaacuggaagggaucuaaccgccccaucguggacauaaauguaaaagauuacuccauugugagcucguaugucugcucuggccuugugggugacacaccucgaaagaacgacuccucaaguagcuccuacuguagaaauccaaacaaugaaaaagggucucacggaguuaagggcugggccuucgaugacggcaacgauguguggauggggaggaccaucagcgaggaguugcggucaggauaugaaacguuuaaagucaucgguggcuggaguaagcccaauuccaaacugcagauuaaccgucaggugaucguagaccgcgggaauagaagcggauacucuggcauuuucucaguugaggguaagaguugcauaaacagguguuuuuauguggaacuaauccgggggcgaaagcaggagaccgaagucugguggacaagcaauuccauuguggucuucugcggcacuucuggaaccuacggcacagggucguggccugauggagcggacaucaaccucaugccaaucuga

SEQ ID NO: 144033 - RNA, 1410 nt, Artificial Sequence
  derived and/or modified sequence opt3 from neuraminidase__InfluenzaA__AFG99383
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccacuaucauagagagaaacaucaccgaaauuguauauuugacaaauaccacuaucgagaaggaaauuuguccuaaauuaguggaguacaggaacuggaguaagccacagugcaaaaucacaggguucgcacccuuuagcaaggacaauuccauacggcugucugccggaggugauauuugggucacccgcgagccuuaugugucgugugacccaggcaagugcuaccaauucgcgcuagggcagggaacgacucucaacaaucgacauucaaacgauaccguucacgaccguacacccuauagaacucugcuuaugaaugaacugggcgugccuuuucauuuggguaccaaacaggucuguaucgcuuggagcaguuccucuugccacgaugggaaggccuggcuccauguguguguaacaggacacgacgagaacgcaaccgccagcuucauuuacgauggcaggcugguugacuccaucggcucauggaguaaaaauauccugcggacgcaggaaagcgagugcguguguauuaacgggacuugcacagucgugaugaccgauggaucugcuuccgagcgcgcagacacuaagauacucuuuaucgaagaggguaaaauugugcacaucucaccauuaagcggcagugcccaacaugucgaagagugcucuuguuauccgagauaccccgggguuaggugcgugugucgggauaauuggaagggauccaaccgcccuauaguagacauuaacgugaaggauuacagcaucgucucgucuuaugugugcuccggccugguuggugacacaccacgaaagaaugacucaaguagcuccucuuacuguagaaaccccaauaacgaaaaggggagccacggagugaaaggcugggcuuucgaugacggcaaugaugucuggauggggaggaccaucggagaggagcuucggucagguuaugaaacguuuaaggugauuggcggguggaguaccccuaacuccaaauugcagaucaaucgucagguaauuguugacagcggaaaccgcucuggcuacucagguauauucaguguggaggggaaaagcugcaucaauagauguuuuuaugucgaacugauuaggggccggaaacaggagacaaaggugugguggacuuccaacucuaucgucguguucugcggaaccucgggcacauacgggacuggaagcuggccagauggugccgacaucaaucuaaugcccauuuga

SEQ ID NO: 144034 - RNA, 1410 nt, Artificial Sequence; identical to SEQ ID NO: 144033
  derived and/or modified sequence opt3 from neuraminidase__InfluenzaA__AFG99394

SEQ ID NO: 144035 - RNA, 1410 nt, Artificial Sequence
  derived and/or modified sequence opt3 from neuraminidase__InfluenzaA__AFG99405
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccacuaucauagagagaaacaucaccgaaauuguauauuugacaaauaccacuaucgagaaggaaauuuguccuaaauuaguggaguacaggaacuggaguaagccacagugcaaaaucacaggguucgcacccuuuagcaaggacaauuccauacggcugucugccggaggugauauuugggucacccgcgagccuuaugugucgugugacccaggcaagugcuaccaauucgcgcuagggcagggaacgacucucaacaaucgacauucaaacgauaccguucacgaccguacacccuauagaacucugcuuaugaaugaacugggcgugccuuuucauuuggguaccaaacaggucuguaucgcuuggagcaguuccucuugccacgaugggaaggccuggcuccauguguguguaacaggacacgacaaaaacgcaaccgccagcuucauuuacgauggcaggcugguugacuccaucggcucauggaguaagaauauccugcggacgcaggagagcgaaugcguguguauuaacgggacuugcacagucgugaugaccgauggaucugcuuccgagcgcgcagacacuaaaauacucuuuaucgaggaagguaagauugugcacaucucaccauuaagcggcagugcccaacaugucgaggaaugcucuuguuauccgagauaccccgggguuaggugcgugugucgggauaauuggaagggauccaaccgcccuauaguagacauuaacgugaaagauuacagcaucaucucgucuuaugucugcuccggccuggugggugacacaccacgaaagaaugacagaucaaguagcuccuacuguaggaaccccaauaacgagaaagggucucacggaguuaagggcugggcuuucgaugacggcaaugauguguggauggggcggaccauuggagaggaacuucguagcgguuaugagacguuuaaagucaucggcggguggucaaccccuaacaguaaguugcagauuaaucgccaggugauaguagacuccggaaacagaagcggcuacucugguaucuucucaguugaagggaaaaguugcauuaauagguguuuuuauguggagcugauccggggccgagaacaggagacacgcgucugguggacuagcaacuccaucguggucuucugcggaaccucuggcacauacgggacuggaucguggccagauggugccgacauuaaucuaaugcccauauga

SEQ ID NO: 144036 - RNA, 1410 nt, Artificial Sequence
  derived and/or modified sequence opt3 from neuraminidase__InfluenzaA__AFG99416
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccacuaucauagagagaaacaucaccgaaauuguauauuugacaaauaccacuaucgagaaggaaauuuguccuaaauuaguggaguacaggaacuggaguaagccacagugcaaaaucacaggguucgcacccuuuagcaaggacaauuccauacggcugucugccggaggugauauuugggucacccgcgagccuuaugugucgugugacccaggcaagugcuaccaauucgcgcuagggcagggaacgacucucaacaaucgacauucaaacgauaccguucacgaccguacacccuauagaacucugcuuaugaaugaacugggcgugccuuuucauuuggguaccaaacaggucuguaucgcuuggagcaguuccucuugccacgaugggaaggccuggcuccauguguguguaacaggacacgacgagaacgcaaccgccagcuucauuuacgauggcaggcugguugacuccaucggcucauggaguaaaaauauccugcggacgcaggaaagcgagugcguguguauuaacgggacuugcacagucgugaugaccgauggaucugcuuccgagcgcgcagacacuaagauacucuuuaucgaagaggguaaaauuauccacauaucaccauuaagcggcagugcccaacauguggaagagugcucuuguuauccgagauaccccggggucaggugcguuugucgggauaauuggaagggauccaaccgcccuauuguggacaucaacguaaaggauuacagcaucgugucgucuuaugucugcuccggccuggugggugacacaccacgaaagaaugacucaaguagcuccucuuacuguagaaaccccaauaacgaaaaagggagccacggaguuaaaggcugggcuuucgaugacggcaaugauguguggauggggaggaccauuggagaggagcuucggucagguuaugaaacguuuaaggucaucggcggguggaguaccccuaacuccaaauugcagauuaaucgucaggugauaguagacggaggcaaccgcagcgguuacucugggaucuucucaguugagggcaagaguugcauuaauagauguuuuuauguggaacugaucaggggacggaaacaggagacaaaggucugguggacuagcaacuccaucguggucuucugcggcaccucugggacauacggaacugguucguggccagauggcgccgacauuaaucuaaugcccauauga

SEQ ID NO: 144037 - RNA, 1410 nt, Artificial Sequence
  derived and/or modified sequence opt3 from neuraminidase__InfluenzaA__AFG99427
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccacuaucauagagagaaacaucaccgaaauuguauauuugacaaauaccacuaucgagaaggaaguguguccuaaauuagucgaguacaggaacuggaguaagccacagugcaaaauuacaggguucgcacccuuuagcaaggacaauuccauccggcugucugccggaggugauauaugggugacccgcgagccuuauguuucgugugacccaggcaagugcuaccaauucgcgcuagggcagggaacgacucucaacaaucgacauucaaacgauaccgugcacgaccguacacccuauagaacucugcuuaugaaugaacugggcgucccuuuucauuuggguaccaaacagguguguauugcuuggagcaguuccucuugccacgaugggaaggccuggcuccauguauguguuacaggacacgacgagaacgcaaccgccagcuucaucuacgauggcaggcugguggacuccauuggcucauggaguaaaaauauccugcggacgcaggaaagcgagugcgucuguaucaacgggacuugcacaguggugaugaccgauggaucugcuuccgagcgcgcagacacuaagauucucuuuauagaagaggguaaaaucauucacaucucaccauuaagcggcagugcccaacaugucgaagagugcucuuguuauccgagauaccccgggguuaggugcgugugucgggauaauuggaagggauccaaccgcccuauaguagacauuaacgugaaggauuacagcaucgucucgucuuaugugugcuccggccugguuggugacacaccacgaaagaaugacucaaguagcuccucuuacuguagaaaccccaauaacgaaaaggggagccacggagugaaaggcugggcuuucgaugacggcaaugaugucuggauggggaggaccaucggagaggagcuucggucagguuaugaaacguuuaaggugauuggcggguggaguaccccuaacuccaaauugcagaucaaucgucagguaauuguugacagcggaaaccgcucuggcuacucagguauauucaguguggaggggaaaagcugcaucaauagauguuuuuaugucgaacugauuaggggccggaaacaggagacaaaggugugguggacuuccaacucuaucgucguguucugcggaaccucgggcacauacgggacuggaagcuggccagauggugccgacaucaaucuaaugcccauuuga

SEQ ID NO: 144038 - RNA, 1410 nt, Artificial Sequence
  derived and/or modified sequence opt3 from neuraminidase__InfluenzaA__AFG99438
augaaccccaaucagaagaucauuaccauaggcagcgugucccugacaaucgccacuauuugcuuccucaugcaaaucgcuauucuugucacgaccguuacacugcacuuuagacaguacgaguguucuucaccuccaaacaaucaggugaugccgugcgaacccacuaucauagagaggaacaucaccgaaauuguauauuugacaaauaccacuaucgagaaagaaauuuguccuaaguuaguggaguaccggaacuggaguaaaccacagugcaagaucacaggguucgcacccuuuagcaaagacaauuccauacgccugucugccggaggugauauuugggucacccgagagccuuaugugucgugugacccaggcaagugcuaccaauucgcgcuagggcagggaacgacucucaacaaucgucauucaaacgauaccguucacgacagaacacccuauaggacucugcuuaugaaugaacugggcgugccuuuucauuuggguaccaagcaggucuguauggcuuggagcaguuccucuugccacgaugggaaagccuggcuccauguguguguaacaggacacgacgagaacgcaaccgccagcuucaucuacgauggccggcugguugacuccauuggcucauggaguaagaauauccugcgcacgcaggaaagcgagugcguguguaucaacgggacuugcacagucgugaugaccgauggaucugcuuccgagagagcagacacuaaaauucucuuuauagaagaggguaagaucgugcacauuucaccauuaagcggcagugcccaacaugucgaagagugcucuuguuauccgagguaccccgggguucggugcgugugucgcgauaauuggaaaggauccaaccgaccuaucguagacauaaacgugaaggauuacagcauugucucgucuuaugugugcuccggccugguuggugacacaccaagaaagaaugacaggucaaguagcuccuacugucggaaccccaauaacgaaaaagggucucacggagugaagggcugggcuuucgaugacggcaaugaugucuggauggggcguaccaucggagaggagcuucgcagcgguuaugaaacguuuaaagugaucggcggguggucaaccccuaacaguaaguugcagauuaauagacagguaaucguugacuccggaaacaggagcggcuacucugguauuuucucaguggaggggaaaaguugcauaaaucgguguuuuuaugucgaacugauccgaggccgcaagcaggagacaagagugugguggacuagcaacuccauugucguguucugcggaaccucuggcacauacgggacuggaucguggccagauggugccgacaucaaucuaaugcccaucuga

SEQ ID NO: 144039 - RNA, 1410 nt, Artificial Sequence
  derived and/or modified sequence opt3 from neuraminidase__InfluenzaA__AFG99449
augaaccccaaucagaagaucauuaccauaggcagcgugucccugacaaucgccacuauuugcuuccucaugcaaaucgcuauucuugucacgaccguuacacugcacuuuagacaguacgaguguucuucaccuccaaacaaucaggugaugccgugcgaacccacuaucauagagaggaacaucaccgaaauuguauauuugacaaauaccacuaucgagaaagaaauuuguccuaaguuaguggaguaccggaacuggaguaaaccacagugcaagaucacaggguucgcacccuuuagcaaagacaauuccauacgccugucugccggaggugauauuugggucacccgagagccuuaugugucgugugacccaggcaagugcuaccaauucgcgcuagggcagggaacgacucucaacaaucgucauucaaacgauaccguucacgacagaacacccuauaggacucugcuuaugaaugaacugggcgugccuuuucauuuggguaccaagcaggucuguauggcuuggagcaguuccucuugccacgaugggaaagccuggcuccauguguguguaacaggacacgacgagaacgcaaccgccagcuucaucuacgauggccggcugguugacuccauuggcucauggaguaagaauauccugcgcacgcaggaaagcgagugcguguguaucaacgggacuugcacagucgugaugaccgauggaucugcuuccgagagagcagacacuaaaauucucuuuauagaagaggguaagaucgugcacauuucaccauuaagcggcagugcccaacaugucgaagagugcucuuguuauccgagguaccccgggguucggugcgugugucgcgauaauuggaaaggauccaaccgaccuaucguagacauaaacgugaaggauuacagcauugucucgucuuaugugugcuccggccugguuggugacacaccaagaaagaaugacaggucaaguagcuccuacugucggaaccccaauaacgaaaaagggucucacggagugaagggcugggcuuucgaugacggcaaugaugucuggauggggcguaccaucggagaggagcuucgcagcgguuaugaaacguuuaaagugaucggcggguggucaaccccuaacaguaaguugcagauuaauagacagguaaucguugacuccggaaacaggagcggcuacucugguauuuucucaguggaggggaaaaauugcauaaaccgguguuuuuaugucgaacugauccgaggccgcaagcaggagacaagagugugguggaccaguaauagcauugucguguucugcggaacuuccggcacauacgggacuggaucuuggccagauggugccgacaucaaccuaaugcccaucuga

SEQ ID NO: 144040 - RNA, 1410 nt, Artificial Sequence
  derived and/or modified sequence opt3 from neuraminidase__InfluenzaA__AFG99471
augaaccccaaucagaagaucauuaccauaggcagcgugucccugauccucgccacaauuugcuuccuuaugcaaaucgcuauucuggucacuacgguuaccuugcacuuuaaacaguacgaguguucuucaccuccaaacaaucaggugaugccgugcgaacccacaaucauagagagaaacaucacugaaauuguauauuuaaccaauacaaccaucgagaaggaaauuuguccuaaacugguggaguacaggaacuggaguaagccacagugcaaaaucacuggguucgcacccuuuagcaaggacaauuccauacggcuaucugccggaggugauauuugggucacacgcgagccuuaugugucgugugacccaggcaagugcuaccaauucgcgcucgggcagggaaccacgcugaacaaucgacauucaaacgauacuguucacgaccguaaucccuauagaacccuucugaugaacgaauugggcgugccuuuucaucucgguacaaggcaggucuguauggcuuggagcaguuccucuugccacgaugggaaagccuggcugcauguguguguaacuggacacgacgagaaugcaaccgccagcuucaucuacgauggccggcugguugacuccauuggcucauggaguaagaacauccuccgcacacaggaaagcgagugcguguguaucaaugggaccugcacggucgugaugacugauggaucugcuuccgagagagcagacacaaaaauuuuauuuauagaagaggguaagaucgugcacauuucaccacugagcggcagugcccaacaugucgaagagugcucuuguuauccgagguaccccgggguucggugcgugugucgcgauaacuggaaaggauccaaccgaccuaucguagacauaaaugugaaggauuacagcauugucucgucuuaugugugcuccggccuuguuggugacaccccaagaaagaacgacaggucaaguagcuccuacugucggaaucccaacaaugaaaaagggucucacggagugaagggcugggcuuucgaugacggcaacgaugucuggauggggcguacuaucggagaggaguugcgcagcgguuaugaaacauuuaaagugaucggcggguggucaaccccuaauaguaagcugcagauuaacagacagguaaucguugacuccggaaauaggagcggcuacucugguauuuucucaguggaggggaaaaguugcauaaaccgguguuuuuaugucgaacuaauccgaggccgcaagcaggagacgagagugugguggaccagcaauuccauugucguguucugcggaacaucuggcacuuacgggaccggaucguggccagauggugccgacaucaaccucaugcccaucuga

SEQ ID NO: 144041 - RNA, 1410 nt, Artificial Sequence
  derived and/or modified sequence opt3 from neuraminidase__InfluenzaA__AFG99482
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugaugccgugcgaacccacuaucauagagagaaauaucaccgaaauuguauauuugacaaacaccacuaucgagaaggaaauuuguccuaaauuaguggaguacaggaauuggucaaagccacagugcaaaaucacaggguucgcacccuuuaguaaggacaacagcauacggcuguccgccggaggugauauuugggucacccgcgagccuuaugugucuugugacccaggcaagugcuaccaauucgcgcuagggcagggaacgacucucaauaaccgacauucgaaugauaccguucacgaccguacacccuauagaacucugcuuaugaacgaacugggcgugccuuuucauuuggguaccaaacaggucuguaucgcuuggucaagcaguuccugccacgaugggaaggccuggcuccauguguguguaacaggacacgacgagaaugcaaccgccucuuucauuuacgauggcaggcugguugacagcaucggcuccuggaguaaaaacauccugcggacgcaggaaucagagugcguguguauuaaugggacuugcacagucgugaugaccgauggaagcgcuucuggucgcgcagacacuaagauacucuuuaucgaggaaggcaaaauugugcacaucuccccauuaucagggagcgcccaacaugucgaggaaugcaguuguuauccgagauaccccggaguuaggugcgugugucgggauaacuggaagggcucuaaccgcccuauaguagacauuaaugugaaggauuacuccaucgucagcucguaugugugcucuggucugguuggggacacaccacgaaagaacgacuccucaaguagcuccuacuguagaaaucccaacaaugagaaaggaucucacggcgugaaaggcugggcuuucgaugacgggaacgaugucuggaugggaaggaccaucggugaggaacuucggagcggcuaugagacguuuaaggugauugggggauggucaaccccuaauaguaaauugcagaucaaccgucagguaauuguugaccgcggcaauagauccgguuacagcgggauauucucuguggaaggcaagaacugcaucaauagguguuuuuaugucgagcugauucggggacgaaaacaggaaacaaaggugugguggacuucaaacaguaucgucguguucugcggcaccagcgggacauacggaacugguuccuggccagauggcgccgacaucaaucuaaugucuauuuga

SEQ ID NO: 144042 - RNA, 1410 nt, Artificial Sequence
  derived and/or modified sequence opt3 from neuraminidase__InfluenzaA__AFG99493
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugaugccgugcgaacccacuaucauagagagaaauaucaccgaaauuguauauuugacaaacaccacuaucgagaaggaaauuuguccuaaauuaguggaguacaggaauuggucaaagccacagugcaaaaucacaggguucgcacccuuuaguaaggacaacagcauacggcuguccgccggaggugauauuugggucacccgcgagccuuaugugucuugugacccaggcaagugcuaccaauucgcgcuagggcagggaacgacucucaauaaccgacauucgaaugauaccguucacgaccguacacccuauagaacucugcuuaugaacgaacugggcgugccuuuucauuuggguaccaaacaggucuguaucgcuuggucaagcaguuccugccacgaugggaaggccuggcuccauguguguguaacaggacacgacgagaaugcaaccgccucuuucauuuacgauggcaggcugguugacagcaucggcuccuggaguaaaaacauccugcggacgcaggaaagugagugcguguguauuaaugggacuugcacagucgugaugaccgauggaagcgcuucuggucgcgcagacacuaagauacucuuuaucgaggaaggcaaaauugugcacaucuccccauuaucagggagcgcccaacaugucgaggaaugcaguuguuauccgagauaccccggaguuaggugcgugugucgggauaacuggaagggcucuaaccgcccuauaguagacauuaaugugaaggauuacuccaucgucagcucguaugugugcucuggucugguuggggacacaccacgaaagaacgacuccucaaguagcuccuacuguagaaaucccaacaaugagaaaggaucucacggcgugaaaggcugggcuuucgaugacgggaacgaugucuggaugggaaggaccaucggugaggaacuucggagcggcuaugagacguuuaaggugauugggggauggucaaccccuaauaguaaauugcagaucaaccgucagguaauuguugaccgcggcaauagauccgguuacagcgggauauucucuguggaaggcaagucaugcaucaacagguguuuuuaugucgagcugauucggggacgaaaacaggaaacaaaggugugguggacuucaaauagcaucgucguguucugcggcaccuccgggacauacggaacugguucuuggccagauggcgccgacaucaaccuaaugcccauuuga

SEQ ID NO: 144043 - RNA, 1410 nt, Artificial Sequence
  derived and/or modified sequence opt3 from neuraminidase__InfluenzaA__AFG99504
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccacuaucauagagagaaacaucaccgaaauuguauauuugacaaauaccacuaucgagaaggaaauuuguccuaaauuaguggaguacaggaacuggaguaagccacagugcaaaaucacaggguucgcacccuuuagcaaggacaauuccauacggcugucugccggaggugauauuugggucacccgcgagccuuaugugucgugugacccaggcaagugcuaccaauucgcgcuagggcagggaacgacucucaacaaucgacauucaaacgauaccguucacgaccguacacccuauagaacucugcuuaugaaugaacugggcgugccuuuucauuuggguaccaaacaggucuguaucgcuuggagcaguuccucuugccacgaugggaaggccuggcuccauguguguguaacaggacacgacgagaacgcaaccgccagcuucauuuacgauggcaggcugguugacuccaucggcucauggaguaaaaauauccugcggacgcaggaaagcgagugcguguguauuaacgggacuugcacagucgugaugaccgauggaucugcuuccgagcgcgcagacacuaagauacucuuuaucgaagaggguaaaauugugcacaucucaccauuaagcggcagugcccaacaugucgaagagugcucuuguuauccgagauaccccgggguuaggugcgugugucgggauaauuggaagggauccaaccgcccuauaguagacauuaacgugaaggauuacagcaucgucucgucuuaugugugcuccggccugguuggugacacaccacgaaagaaugacagaucaaguagcuccuacuguaggaaccccaauaacgaaaaagggucucacggagugaaaggcugggcuuucgaugacggcaaugaugucuggauggggcggaccaucggagaggagcuucguagcgguuaugaaacguuuaaggugauuggcggguggucaaccccuaacaguaaauugcagaucaaucgccagguaauuguugacuccggaaacagaagcggcuacucugguauauucucaguggaggggaagaguugcaucaauagguguuuuuaugucgaacugauucggggccgaaaacaggagacacgcgugugguggacuagcaacuccaucgucguguucugcggaaccucuggcacauacgggacuggaucguggccagauggugccgacaucaaucuaaugcccauuuga

SEQ ID NO: 144044 - RNA, 1410 nt, Artificial Sequence
  derived and/or modified sequence opt3 from neuraminidase__InfluenzaA__AFG99515
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacauccuccggacgcaggaaagugagugcguuuguauuaaugggacuugcacaguggucaugaccgauggaagcgcaucugagcgcgccgacacuaagauauuauuuaucgaagaggguaaaauugugcacaucuccccucugucaggcagcgcucaacauguggaagagugcaguuguuauccaagauacccgggggucaggugcguuugucgggauaacuggaagggaucuaaccgccccauaguggacauuaauguaaaggauuacuccaucgugagcucguaugucugcucuggccuugugggugacacaccucgaaagaacgacuccucaaguagcuccuacuguagaaauccaaacaaugaaaaagggucucacggaguuaaaggcugggccuucgaugacggcaacgauguguggauggggaggaccaucggagaggaguugcggagcgguuaugaaacguuuaaggucauuggcggguggucaacccccaauaguaaacugcagaucaaccgucaggugauuguagaccgcggaaauagauccggcuacagcgguauauucucuguugaggggaagucaugcaucaacagguguuuuuauguggaacuaauucggggccgaaaacaggagacagaagucugguggacuucaaauagcaucguggucuucugcggaaccuccggcacauacgggacuggaucuuggccugauggugcggacaucaaccucaugccaauuuga

SEQ ID NO: 144045 - RNA, 1410 nt, Artificial Sequence
  derived and/or modified sequence opt3 from neuraminidase__InfluenzaA__AFG99526
augaaccccaaucagaagaucauuaccauaggcagcgugucccugacacucgccacuaucugcuuccuuaugcaaauugcuauccuggucacgaccguuacauugcacuuuaaacaguacgaguguucuucaccuccaaacaaucaggugaugccgugcgaacccacuauuaucgagagaaacauaaccgaaaucguauauuuaacaaauaccacuauugagaaggaaguguguccuaaacuggucgaguacaggaacuggaguaagccacagugcaaaaucacaggguucgcacccuuuagcaaggacaauuccauucggcuaucugccggaggugauaucugggugacccgcgagccuuauguuucgugugacccaggcaagugcuaccaauucgcgcucgggcagggaacgacucugaacaaucgacauucaaacgauaccgugcacgaccguacacccuauagaacucuucugaugaaugaauugggcgucccuuuucaucucgguaccaggcaaguguguauggcuuggagcaguuccucuugccacgaugggaaagccuggcugcauguauguguuacaggacacgacgagaacgcaaccgccagcuucauauacgauggccggcugguggacuccauuggcucauggaguaagaauauccuccgcacgcaggaaagcgagugcgucuguauuaacgggacuugcacaguggugaugaccgauggaucugcuuccgguagagcagacacuaaaaucuuauuuaucgaggaaggcaagauuguccacauaucaccacugagcgggagugcccagcauguugaggaaugcucuuguuauccgagguaccccggagugcggugcguaugucgcgauaauuggaaaggcuccaaccgaccuaucguggacauuaacgucaaggauuacagcaucgugucgucuuauguuugcuccggucuugugggggacacaccaagaaagaaugacaggucaaguagcuccuacugucggaaccccaauaacgagaaaggaucucacggcgucaagggcugggcuuucgaugacgggaaugauguguggaugggacguaccauaggugaagaguugcgcagcggcuaugagacguuuaaaguaauugggggauggucaaccccuaacaguaagcugcagaucaauagacagguuaucguggacuccggcaacaggagcgguuacucugggauuuucucagucgaaggcaaaaguugcaucaaucgguguuuuuauguggagcuaauucgaggacgcaagcaggaaacaagagucugguggacuagcaacuccauagugguuuucugcggcaccucugggacauacggaacugguucguggccagauggcgccgacaucaaucucaugcccauuuga

SEQ ID NO: 144046 - RNA, 1410 nt, Artificial Sequence; identical to SEQ ID NO: 143942
  derived and/or modified sequence opt3 from neuraminidase__InfluenzaA__AFG99537

SEQ ID NO: 144047 - RNA, 1410 nt, Artificial Sequence; identical to SEQ ID NO: 143942
  derived and/or modified sequence opt3 from neuraminidase__InfluenzaA__AFG99548

SEQ ID NO: 144048 - RNA, 1410 nt, Artificial Sequence; identical to SEQ ID NO: 143942
  derived and/or modified sequence opt3 from neuraminidase__InfluenzaA__AFG99559

SEQ ID NO: 144049 - RNA, 1410 nt, Artificial Sequence; identical to SEQ ID NO: 143942
  derived and/or modified sequence opt3 from neuraminidase__InfluenzaA__AFG99570

SEQ ID NO: 144050 - RNA, 1410 nt, Artificial Sequence; identical to SEQ ID NO: 143942
  derived and/or modified sequence opt3 from neuraminidase__InfluenzaA__AFG99581

SEQ ID NO: 144051 - RNA, 1410 nt, Artificial Sequence
  derived and/or modified sequence opt3 from neuraminidase__InfluenzaA__AFG99592
augaaccccaaucagaagaucauuaccauaggcagcgugucccugacaaucgccacuacgugcuuccucaugcaaauugcuauccuugucaccacaguuacucugcacuuuaaacaguacgaguguaacucuccuccaaauaaccaggugaugccgugcgaacccaccauuaucgagagaaauauaacagaaaucguauauuugaccaacacuacaauugagaaggaaaucuguccuaaauuaguggaguacaggaauuggucaaagccacagugcaaaauuaccggguucgcacccuuuaguaaggacaacagcauccggcuguccgccggaggugauauaugggucacgcgcgagccuuaugugucuugugacccaggcaagugcuaccaauucgcgcuagggcagggaacuacccucaauaaccgacauucgaaugauacaguucacgaccguacucccuauagaacccugcuuaugaacgaacugggcgugccuuuucauuuggguacaaaacaggucuguauugcuuggucaagcaguuccugccacgaugggaaggccuggcuccauguguguguaaccggacacgacgagaaugcaacggccucuuucaucuacgauggcaggcugguugacagcauuguguccuggaguaaaaacauccugcggacucaggaaucagagugcgucuguaucaauggcacaugcaccguggugaugacugaugggagcgcuucugagcgcgcagacacaaagauucucuuuauagaagagggaaaaaucguccacauuuccccauuaucagguagcgcccaacauguugaagagugcaguuguuauccgagauaccccggcgugaggugcguaugucgggauaacuggaaggggucuaaccgcccuaucguggacauaaaugucaaggauuacuccauugugagcucguauguuugcucuggacuggugggcgacaccccacgaaagaacgacuccucaaguagcuccuacuguagaaaucccaacaaugaaaaagguucucacggggucaaaggaugggcuuucgaugacggcaacgauguguggaugggcaggacgaucggggaggagcuucggagcggauaugaaaccuuuaagguaaucgguggcuggucaacaccuaauaguaaauugcagacuaaccgucagguuauuguggaccgcgggaauagauccggauacagcggcaucuucucugucgaggguaagucaugcauuaacagguguuuuuauguggaacugauacgggggcgaaaacaggagaccaaggucugguggacaaguaauagcaucgugguuuucugcggcacuuccggaaccuacggcacagggucuuggccagauggagccgacauuaaccuaaugcccaucuga

SEQ ID NO: 144052 - RNA, 1410 nt, Artificial Sequence; identical to SEQ ID NO: 143942
  derived and/or modified sequence opt3 from neuraminidase__InfluenzaA__AFG99603

SEQ ID NO: 144053 - RNA, 1410 nt, Artificial Sequence; identical to SEQ ID NO: 143942
  derived and/or modified sequence opt3 from neuraminidase__InfluenzaA__AFG99614

SEQ ID NO: 144054 - RNA, 1410 nt, Artificial Sequence; identical to SEQ ID NO: 143942
  derived and/or modified sequence opt3 from neuraminidase__InfluenzaA__AFG99625

SEQ ID NO: 144055 - RNA, 1410 nt, Artificial Sequence
  derived and/or modified sequence opt3 from neuraminidase__InfluenzaA__AFG99636
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucguuuccuggaguaaaaacauccuccggacgcaggaaucagagugcguguguauuaauggcacuugcacagucgugaugaccgaugggagcgcaucugagcgcgccgacacuaagauauuauuuaucgaagagggaaaaauugugcacaucuccccucugucagguagcgcucaacaugucgaagagugcaguuguuauccaagauacccgggcguuaggugcgugugucgggauaacuggaaggggucuaaccgccccauaguagacauuaaugugaaggauuacuccaucgucagcucguaugugugcucuggacuuguuggcgacacaccucgaaagaacgacuccucaaguagcuccuacuguagaaauccaaacaaugaaaaagguucucacggggugaaaggaugggccuucgaugacggcaacgaugucuggaugggcaggaccaucggggaggacuugcggagcggauaugagacguuuaaggugauugguggcuggucaacccccaauaguaaacugcagacaaaccgucagguaaucguugaucgcgggaauagauccggauacagcggcauuuucucuguggaagguaagucaugcauaaacagguguuuuuaugucgagcuaauccgggggcgaaaacaggaaacuaaggugugguggaccaguaauagcauugucguguucugcggcacauccggaacuuacggcaccgggucuuggccugacggagcggauaucaaccucaugccaaucuga

SEQ ID NO: 144056 - RNA, 1410 nt, Artificial Sequence
  derived and/or modified sequence opt3 from neuraminidase__InfluenzaA__AFG99658
augaaccccaaucagaagaucauuaccauaggcagcgugucccugacaaucgccacuauuugcuuccucaugcaaaucacgauucuugucaccacaguuacucugcacuuuaaacaguacgaguguaacucuccuccaaauaaccaggugauguugugcgaaccgaccaucauagagagaaauaucacagaaauuguauauuuaaccaacacuacaaucgagaaggaaauuugucccaaacugguggaguacaggaauuggucaaagccucagugcaaaaucaccggguucgcuccauuuaguaaggacaacagcauacggcuauccgcaggaggugauauuugggucacgcgcgagcccuaugugucuugugacccuggcaagugcuaccaauucgcccucgggcagggaacuacccugaauaaccgacauucgaaugauacaguucacgaccguacuccauauagaacccuucugaugaacgaauugggcgugcccuuucaucucgguacaaaacaggucuguaucgcguggucaagcaguuccugccacgaugggaaggcuuggcugcauguguguguaaccggacacgacgagaaugccacggcaucuuucauuuacgauggcaggcugguugacagcaucuccucauggaguaaaaacauccuccggacucaggaaagcgagugcguguguauuaauggcacaugcaccgucgugaugacugaugggucugccuccgagcgcgcugacacaaagauauuauuuaucgaagagggaaaaauugugcacaucucaccucugagcgguagugcacaacaugucgaagagugcucuuguuauccaagauacccgggcguuaggugcgugugucgggauaacuggaagggguccaaccgccccauaguagacauuaaugugaaggauuacagcaucgucucgucuuaugugugcuccggacuuguuggcgacaccccucgaaagaacgacucaaguagcuccucuuacuguagaaauccaaacaaugaaaaagguagccacggggugaaaggaugggccuucgaugacggcaacgaugucuggaugggcaggacgaucucagaggaguugcggaguggguaugaaaccuuuaaggugauuggagguugguccacacccaauagcaaacugcagaucaaccgucagguaauuguugaccgcggcaauagaucuggguacucaggaauauucaguguggagggcaagagcugcaucaacagguguuuuuaugucgaacuaauucggggucgaaaacaggagaauaaggugugguggacuuccaacucuaucgucguguucugcgggaccucgggcacauacggaacuggcagcuggccugauggggcugacaucaaucucaugccaauuuga

SEQ ID NO: 144057 - RNA, 1410 nt, Artificial Sequence
  derived and/or modified sequence opt3 from neuraminidase__InfluenzaA__AFG99680
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaucuugugccagccgacuauaaucgaaagaaacauuaccgagaucguauauuuaacaaauaccacuauugaaaaggagaucugucccaaacugguggaauacaggaacuggaguaagccucaaugcaaaauaacaggguucgcaccauuuagcaaggacaauuccauucggcuaucugccggaggugauaucugggucacccgcgagcccuaugugucgugugacccuucaaagugcuaccaguucgcgcucggccaggggacgacucugaacaaucgacauagcaacgauaccguucacgaccguacaccauauagaacucuucugaugaaugaguugggagugcccuuucaucucggcaccaaacaggucuguauugcuuggaguuccucuagcugccacgaugguaaggccuggcugcauguguguguaacagggcacgacgaaaacgcaaccgccuccuucaucuacgauggaaggcugguugacucaaucggcaguuggagcaaaaauauucuccggacgcaagagucugaaugcguguguauaaacggcacuugcacagucgugaugaccgauggguccgcuucagagcgcgcagacacuaagaucuuauuuauugaggaaggaaaagugguccacaucagcccucugagugguucugcccagcauguugaggaaugcuccuguuauccaagauacccgggcgugaggugcguaugucgggauaauuggaaggggagcaaccgccccauaguggacauuaacgucaaggauuacucgaucgugucuuccuauguuugcucaggacuugugggcgacacaccucgaaagaaugacaguagcuccucuagcuacuguagaaacccaaauaacgagaaagguucacacggggucaaaggaugggcuuucgaugacggcaaugauguguggaugggcaggaccaucagugaagaguugcgguccggguaugagacguuuaagguaauuggagguuggagcacccccaacucuaaacugcagaucaaucgucagguuauuguggacucaggcaaccgcaguggguacagcggaauauucuccgucgaaggcaagucuugcaucaauagauguuuuuauguggagcuaauuaggggucggaaacaagaaacaaaggucugguggacuucgaacagcaucgugguuuucugcgggaccuccggcacauacggaacuggcucauggccugauggggccgacaucaaucucaugccaauuuga

SEQ ID NO: 144058 - RNA, 1410 nt, Artificial Sequence
  derived and/or modified sequence opt3 from neuraminidase__InfluenzaA__AFG99691
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugaugccgugcgaacccacuaucauagagagaaauaccacagaaaucguauauuugaccaacacuacaauugagaaggaaaucuguccuaaauuaguggaguacaggaauuggucaaagccacagugcaaaauuaccggguucgcacccuuuaguaaggacaacagcauccggcuguccgccggaggugauauaugggucacgcgcgagccuuaugugucuugugacccaggcaagugcuaccaauucgcgcuagggcagggaacuacccucaauaaccgacauucgaaugauacaguucacgaccguacucccuauagaacccugcuuaugaacgaacugggcgugccuuuucauuuggguacaaaacaggucuguauugcuuggucaagcaguuccugccacgaugggaaggccuggcuccauguguguguaaccggacacgacgagaaugcaacggccucuuucaucuacgauggcaggcugguugacagcauuguguccuggaguaaaaacauccugcggacucaggaaucagagugcgucuguaucaauggcacaugcaccguggugaugacugaugggagcgcuucugagcgcgcagacacaaagauucucuuuauagaagagggaaaaaucguccacauuuccccauuaucagguagcgcccaacauguugaagagugcaguuguuauccgagauaccccggcgugaggugcguaugucgggauaacuggaaggggucuaaccgcccuaucguggacauaaaugucaaggauuacuccauugugagcucguauguuugcucuggacuggugggcgacaccccacgaaagaacgacuccucaaguagcuccuacuguagaaaucccaacaaugaaaaagguucucacggggucaaaggaugggcuuucgaugacggcaacgauguguggaugggcaggacgaucggggaggagcuucggagcggauaugaaaccuuuaagguaaucgguggcuggucaacaccuaauaguaaauugcagacuaaccgucagguuauuguggaccgcgggaauagauccggauacagcggcaucuucucugucgaggguaagucaugcauuaacagguguuuuuauguggaacugauacgggggcgaaaacaggagaccaaggucugguggacaaguaauagcaucgugguuuucugcggcacuuccggaaccuacggcacagggucuuggccagauggagccgacauuaaccuaaugcccaucuga

SEQ ID NO: 144059 - RNA, 1410 nt, Artificial Sequence; identical to SEQ ID NO: 143942
  derived and/or modified sequence opt3 from neuraminidase__InfluenzaA__AFG99704

SEQ ID NO: 144060 - RNA, 1410 nt, Artificial Sequence; identical to SEQ ID NO: 143942
  derived and/or modified sequence opt3 from neuraminidase__InfluenzaA__AFG99715

SEQ ID NO: 144061 - RNA, 1410 nt, Artificial Sequence; identical to SEQ ID NO: 143942
  derived and/or modified sequence opt3 from neuraminidase__InfluenzaA__AFG99726

SEQ ID NO: 144062 - RNA, 1410 nt, Artificial Sequence
  derived and/or modified sequence opt3 from neuraminidase__InfluenzaA__AFG99737
augaaccccaaucagaagaucauuaccauaggcagcgugucccugacaaucgccacuauuugcuuccucaugcaaaucacgauucuugucaccacaguuacucugcacuuuaaacaguacgaguguaacucuccuccaaauaaccaggugauguugugcgaaccgaccaucauagagagaaauaucacagaaauuguauauuuaaccaacacuacaaucgagaaggaaauuugucccaaacugguggaguacaggaauuggucaaagccucagugcaaaaucaccggguucgcuccauuuaguaaggacaacagcauacggcuauccgcaggaggugauauuugggucacgcgcgagcccuaugugucuugugacccuggcaagugcuaccaauucgcccucgggcagggaacuacccugaauaaccgacauucgaaugauacaguucacgaccguacuccauauagaacccuucugaugaacgaauugggcgugcccuuucaucucgguacaaaacaggucuguaucgcguggucaagcaguuccugccacgaugggaaggcuuggcugcauguguguguaaccggacacgacgagaaugccacggcaucuuucauuuacgauggcaggcugguugacagcaucggcuccuggaguaaaaacauccuccggacucaggaaucagagugcguguguauuaaugggacaugcaccgucgugaugacugauggaagcgccucugagcgcgcugacacaaagauauuauuuaucgaagaggguaaaauugugcacaucuccccucugucaggcagcgcacaacaugucgaagagugcaguuguuauccaagauacccggggguuaggugcgugugucgggauaacuggaagggaucuaaccgccccauaguagacauuaaugugaaggauuacuccaucgucagcucguaugugugcucuggccuuguuggugacaccccucgaaagaacgacuccucaaguagcuccuacuguagaaauccaaacaaugaaaaagggucucacggagugaaaggcugggccuucgaugacggcaacgaugucuggauggggaggacgaucagcgaggaguugcggucaggauaugaaaccuuuaaggugauugguggcuggaguacacccaauuccaaacugcagaucaaccgucagguaauuguugaccgcgggaauagaagcggauacucuggcauauucucaguggaggguaagaguugcaucaacagguguuuuuaugucgaacuaauucgggggcgaaaacaggagaauaaggugugguggacuagcaacuccaucgucguguucugcggcaccucuggaacauacggcacugggucguggccugauggagcugacaucaaucucaugccaauuuga

SEQ ID NO: 144063 - RNA, 1410 nt, Artificial Sequence
  derived and/or modified sequence opt3 from neuraminidase__InfluenzaA__AFG99748
augaaccccaaucagaagaucauuaccauaggcagcgugucccugacaaucgccacuauuugcuuccucaugcaaaucgcuauucuugucacgaccguuacacugcacuuuaaacaguacgacuguaacucuccuccaaauaaccaggcaauguugugcgagccgacuaucauagaaagaaauaucaccgagauuguguauuuaacaaacaccacuaucgaaaaggagauuugucccaaacuggccgaauacaggaauuggucaaagccucagugcaaaaucacaggguucgcgccauuuaguaaggauaacagcauacggcuauccgcuggaggugacauuuggguaacccgcgagcccuaugugucuugugauccuggcaagugcuaccaauucgcccucgggcagggaacgacucugaauaaccgacauucgaaugacaccguccacgaucguacaccauauagaacucuucugaugaacgaguugggcgugcccuuucaucucgguaccaaacagguuuguaucgcauggucaagcaguuccugccacgacgggaaggccuggcugcaugugugugucacaggacacgaugaaaaugcuaccgcaucuuucauuuacgacggcaggcugguggauagcaucggcuccuggaguaaaaacauccuccggacgcaggagucagaaugcguauguauuaaugggacuugcacaguugugaugaccgacggaagcgccucugagcgcgcugauacuaagauauuauuuaucgaggaagguaaaauuguccacaucuccccucugucaggcagcgcccaacauguggaggaaugcaguuguuauccaagauacccgggggugaggugcgucugucgggacaacuggaagggaucuaaccgccccauaguugauauuaaugugaaggacuacuccaucguaagcucguaugugugcucuggccuugucggugacacaccucgaaagaacgauuccucaaguagcuccuacuguagaaauccaaacaaugagaaagggucucacggagugaaaggcugggcguucgacgauggcaacgacguuuggauggggaggaccaucggagaagaguugcggagcgguuaugagacguuuaaggugauuggcggguggucaacccccaauaguaaacugcagaucaaccgucaggucauuguggaucgcggaaauagauccggcuacagcgguauauucucuguagaagggaagucaugcacaaacagguguuuuuauguugagcuaauccggggccgaaaacaggaaacugaggugugguggaccaguaauagcauugucguguucugcggaacauccggcacuuacgggaccggaucuuggccugacggugcagauaucaaccucaugccaaucuga

SEQ ID NO: 144064 - RNA, 1410 nt, Artificial Sequence; identical to SEQ ID NO: 143942
  derived and/or modified sequence opt3 from neuraminidase__InfluenzaA__AFG99759

SEQ ID NO: 144065 - RNA, 1410 nt, Artificial Sequence
  derived and/or modified sequence opt3 from neuraminidase__InfluenzaA__AFG99770
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccagaucauguugugcgaaccgacuauaaucgagagaaauauuaccgaaaucguguauuuaacaaacaccacuauugagagggaaaucugucccaagcugguagaguaccggaauuggucaaaaccucagugcaagauaacaggguucgcaccauuuaguaaagacaacagcauucgccuauccgccggaggugauaucugggugacccgagagcccuaugucucuugugacccuggcaagugcuaccaauucgcgcucgggcagggaacgacucugaauaaccgucauucgaaugauaccgugcacgacagaacaccauauaggacucuucugaugaacgaauugggcguucccuuucaucucgguaccaaacagguguguauugcuuggucaagcaguuccugccacgaugggaaggccuggcugcaugucugugugacaggacacgacgagaaugcaaccgccucuuucaucuacgauggccggcugguagacagcaucggcuccuggucaaagaacauucuccgcacgcaggaaagugagugcguuuguauaaaugggacuugcacaguggucaugaccgauggaagcgcuucugagagagcagacacuaaaaucuuauuuauugaagaggguaagaucgugcacauauccccucugucaggcagcgcccaacauguggaagagugcaguuguuauccaagguacccggggguccggugcguuugucgcgauaacuggaaaggaucuaaccgacccauuguggacaucaauguaaaggauuacuccaucgugagcucguaugucugcucuggccuugugggugacacaccuagaaagaacgacuccucaaguagcuccuacuguaggaauccaaacaaugaaaaagggucucacggaguuaagggcugggcuuucgaugacggcaacgauguguggauggggcggaccauuggagaggaguugcguagcgguuaugaaacguuuaaagucaucggcggguggucaacccccaauaguaagcugcagauuaaccgccaggugauaguagacagaggaaauagguccggcuacagcgguaucuucucuguugaggggaaaucaugcauuaaccgguguuuuuauguggaacuaauccgaggccgcaagcaggagacagaagucugguggaccaguaauagcaucguggucuucugcggaacuuccggcacauacgggacuggaucuuggccugauggugccgacauuaaccucaugccaauauga

SEQ ID NO: 144066 - RNA, 1410 nt, Artificial Sequence
  derived and/or modified sequence opt3 from neuraminidase__InfluenzaA__AFG99781
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugauguugugccagccgacuaucauagaaagaaacaucaccgagauuguauauuuaacaaauaccacuaucgaaaaggagauuugucccaaacugguggaauacaggaacuggaguaagccucaaugcaaaaucacaggguucgcaccauuuagcaaggacaauuccauacggcuaucugccggaggugauauuugggucacccgcgagcccuaugugucgugugacccuggcaagugcuaccaguucgcgcucgggcagggaacgacucugaacaaucgacauucaaacgauaccguucacgaccguacaccauauagaacucuucugaugaaugaguugggcgugcccuuucaucucgguaccaaacaggucuguaucgcuuggagcaguuccucuugccacgaugggaaggccuggcugcauguguguguaacaggacacgacgaaaacgcaaccgccagcuucauuuacgauggcaggcugguugacuccaucggcucauggaguaaaaauauccuccggacgcaagagagcgaaugcguguguauuaacgggacuugcacagucgugaugaccgauggaucugcuuccaagcgcgcagacacuaaaauauuauuuaucgaggaggguaagauugugcacaucucaccucugagcggcagugcccagcaugucgaagagugcucuuguuauccaagauacccggggguuaggugcgugugucgggauaauuggaagggauccaaccgccccauaguagacauuaacgugaaagauuacagcaucgucucgucuuaugugugcuccggccuuguuggugacacaccucgaaagaaugacucaaguagcuccucuuacuguagaaacccaaauaacgaaaaagggagccacggagugaagggcugggcuuucgaugacggcaaugaugucuggauggggaggaccaucucagaggaauugcggaguggauaugagacguuuaaagugauugguggcugguccacccccaacagcaagcugcagacaaaucgucagguaaucguugacucugggaaccgcucaggauacaguggcauuuucagcguggaggguaaauccugcauaaauagauguuuuuaugucgaacuaaucagggggcggaagcaagagacuaaggugugguggaccucuaacucgauugucguguucugcggcacaagcggaacuuacggcaccggguccuggccugauggagccgacaucaaucucaugccaaucuga

SEQ ID NO: 144067 - RNA, 1410 nt, Artificial Sequence; identical to SEQ ID NO: 143942
  derived and/or modified sequence opt3 from neuraminidase__InfluenzaA__AFG99792

SEQ ID NO: 144068 - RNA, 1410 nt, Artificial Sequence; identical to SEQ ID NO: 144062
  derived and/or modified sequence opt3 from neuraminidase__InfluenzaA__AFG99803

SEQ ID NO: 144069 - RNA, 1410 nt, Artificial Sequence; identical to SEQ ID NO: 143942
  derived and/or modified sequence opt3 from neuraminidase__InfluenzaA__AFG99825

SEQ ID NO: 144070 - RNA, 1410 nt, Artificial Sequence; identical to SEQ ID NO: 143942
  derived and/or modified sequence opt3 from neuraminidase__InfluenzaA__AFG99836

SEQ ID NO: 144071 - RNA, 1410 nt, Artificial Sequence; identical to SEQ ID NO: 143942
  derived and/or modified sequence opt3 from neuraminidase__InfluenzaA__AFG99847

SEQ ID NO: 144072 - RNA, 1410 nt, Artificial Sequence; identical to SEQ ID NO: 143942
  derived and/or modified sequence opt3 from neuraminidase__InfluenzaA__AFG99858

SEQ ID NO: 144073 - RNA, 1410 nt, Artificial Sequence; identical to SEQ ID NO: 143942
  derived and/or modified sequence opt3 from neuraminidase__InfluenzaA__AFG99869

SEQ ID NO: 144074 - RNA, 1410 nt, Artificial Sequence; identical to SEQ ID NO: 143942
  derived and/or modified sequence opt3 from neuraminidase__InfluenzaA__AFG99880

SEQ ID NO: 144075 - RNA, 1410 nt, Artificial Sequence
  derived and/or modified sequence opt3 from neuraminidase__InfluenzaA__AFG99891
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuucacaaacaccacuaucgagaaggaaauuugucccaaauuagcagaguacaggaauuggucaaagccucagugcaaaaucacaggguuugccccauucaguaaggacaacagcauacggcuguccgcgggaggugauauuugggugacccgcgagcccuaugucucuugugacccuggcaagugcuaccaauuugcucuagggcagggaacgacucucaauaaccgacauucgaaugauaccgugcacgaccguacaccauauagaacucugcuuaugaacgaacugggcguucccuuccauuuggguaccaaacagguguguaucgccuggucaagcaguuccugccacgaugggaaggcauggcuccaugucugugugacaggacacgacgagaaugccaccgcuucuuuuauuuacgauggcaggcugguagacagcaucggcuccuggaguaaaaacauccugcggacgcaggaaucagagugcguuuguauuaaugggacuugcacaguggucaugaccgauggaagcgcaucugagcgcgccgacacuaagauacucuucaucgaagaggguaaaauugugcacaucuccucauuaagcggcagugcucaacauguggaagagugcucuuguuauccuagauacccaggggucaggugcguuugucgggauaacuggaagggauccaaccgcccgauaguggacauuaauguaaaggauuacagcaucgugucgucuuaugucugcuccggccuggugggugacacaccccgaaagaacgacucaaguagcuccucuuacuguagaaauccuaacaaugaaaaagggagccacggaguuaaaggcugggccuuugaugacggcaacgauguguggauggggaggaccaucggagaggagcuucggucagguuaugaaacguuccgugucauuggcggguggaguaccccaaauuccaaguugcagaucaaccgccaggugauuguagacagaggaaauaggagcggcuacucugguauauuuucaguugaggggaaaaguugcaucaaccgguguuucuauguggaacugauucgaggccgcaagcaggagacagaagucugguggacuagcaauuccaucguggucuuuugcggaaccucuggcacauacgggacuggaucguggcccgauggugcggacaucaaccuaaugccuauuuga

SEQ ID NO: 144076 - RNA, 1410 nt, Artificial Sequence; identical to SEQ ID NO: 143942
  derived and/or modified sequence opt3 from neuraminidase__InfluenzaA__AFG99902

SEQ ID NO: 144077 - RNA, 1410 nt, Artificial Sequence; identical to SEQ ID NO: 143942
  derived and/or modified sequence opt3 from neuraminidase__InfluenzaA__AFG99913

SEQ ID NO: 144078 - RNA, 1410 nt, Artificial Sequence; identical to SEQ ID NO: 143942
  derived and/or modified sequence opt3 from neuraminidase__InfluenzaA__AFG99924

SEQ ID NO: 144079 - RNA, 1410 nt, Artificial Sequence
  derived and/or modified sequence opt3 from neuraminidase__InfluenzaA__AFG99935
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucguagagagaaauauaaccgaaaucguguauuuaacaaacaccacuauugagaaggaaaucugucccaaacuggcagaguacaggaauuggucaaagccucagugcaaaauuacaggguucgccccauuuaguaaggacaacagcauccggcuauccgcgggaggugauauaugggucacccgcgagcccuaugugucuugugacccuucgaagugcuaccaauucgcucucggccaggggacgacucugaauaaccgacauucaaaugauaccguucacgaccguacaccauauagaacucuucugaugaacgaauugggagugcccuuucaucucggcaccaaacaggucuguauugccuggagcaguuccucuugccacgaugguaaggcauggcugcauguguguguaacagggcacgacgagaaugccaccgcuagcuucaucuacgauggaaggcugguugacuccauuggcucauggaguaaaaacauccuccggacgcaggaaagcgagugcguguguaucaauggcacuugcacagucgugaugaccgaugggucugcauccgagcgcgccgacacuaagauuuuauuuauagaagagggaaaaaucgugcacauuucaccucugagcgguagugcucaacaugucgaagagugcucuuguuauccaagauacccgggcguuaggugcgugugucgggauaacuggaagggguccaaccgccccaucguagacauaaauaugaaggauuacagcauugugucgucuuaugucugcuccggacuugugggcgacacaccucgaaacaaugacucaaguagcuccucuuacuguagaaacccaaauaacgaaaaagguagccacgggguuaagggaugggccuucgaugacggcaaugauguguggaugggcaggaccaucggggaggaguugcggucaggauaugaaacguuuaaagucaucgguggcuggaguacccccaacuccaagcugcagauuaaucgucaggugaucguagaccgcgggaacagaagcggauacucuggcauuuucucaguugaggguaaaaguugcauaaauagguguuuuuauguggaacuaauccgggggcgaaagcaggagacagaagucugguggacuagcaacuccauuguggucuucugcggcaccucuggaacauacggcacugggucguggccugauggagcggacaucaaucucaugccaaucuga

SEQ ID NO: 144080 - RNA, 1410 nt, Artificial Sequence; identical to SEQ ID NO: 143942
  derived and/or modified sequence opt3 from neuraminidase__InfluenzaA__AFG99946

SEQ ID NO: 144081 - RNA, 1410 nt, Artificial Sequence
  derived and/or modified sequence opt3 from neuraminidase__InfluenzaA__AFG99957
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggcaauguugugcgaaccgacuaucauagagagaaauaucaccgaaauuguguauuuaacaaacaccacuaucgagaaggaaauuugucccaaacuggccgaguacaggaauuggucaaagccucagugcaaaaucacaggguucgcgccauuuaguaaggacaacagcauacggcuauccgcuggaggugauauuuggguaacccgcgagcccuaugugucuugugacccuggcaagugcuaccaauucgcccucgggcagggaacgacucugaauaaccgacauucgaaugauaccguccacgaccguacaccauauagaacucuucugaugaacgaauugggcgugcccuuucaucucgguaccaaacagguuuguaucgcauggucaagcaguuccugccacgaugggaaggccuggcugcaugugugugucacaggacacgacgagaaugcuaccgcaucuuucauuuacgauggcaggcugguggacagcaucggcuccuggaguaaaaacauccuccggacgcaggaaucagagugcguauguauuaaugggacuugcacaguugugaugaccgauggaagcgccucugagcgcgcugacacuaagauauuauuuaucgaagaggguaaaauuguccacaucuccccucugucaggcagcgcccaacauguggaagagugcaguuguuauccaagauacccgggggugaggugcgucugucgggauaacuggaagggaucuaaccgccccauaguugacauuaaugugaaggauuacuccaucguaagcucguaugugugcucuggccuugucggugacacaccucgaaagaacgacuccucaaguagcuccuacuguagaaauccaaacaaugaaaaagggucucacggagugaaaggcugggcguucgaugacggcaacgauguuuggauggggaggaccaucggagaggaguugcggagcgguuaugaaacguuuaaggugauuggcggguggucaacccccaauaguaaacugcagaucaaccgucaggucauuguggaccgcggaaauagauccggcuacagcgguauauucucuguagaggggaagucaugcacaaacagguguuuuuauguugaacuaauccggggccgaaaacaggagacugaagugugguggaccaguaauagcauugucguguucugcggaacauccggcacuuacgggaccggaucuuggccugauggugcagacaucaaccucaugccaaucuga

SEQ ID NO: 144082 - RNA, 1410 nt, Artificial Sequence; identical to SEQ ID NO: 143942
  derived and/or modified sequence opt3 from neuraminidase__InfluenzaA__AFG99968

SEQ ID NO: 144083 - RNA, 1410 nt, Artificial Sequence
  derived and/or modified sequence opt3 from neuraminidase__InfluenzaA__AFG99979
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugaugccgugcgaacccacuaucauagagagaaauaucaccgaaauuguauauuugacaaacaccacuaucgagaaggaaauuuguccuaaauuaguggaguacaggaauuggucaaagccacagugcaaaaucacaggguucgcacccuuuaguaaggacaacagcauacggcuguccgccggaggugauauuugggucacccgcgagccuuaugugucuugugacccaggcaagugcuaccaauucgcgcuagggcagggaacgacucucaauaaccgacauucgaaugauaccguucacgaccguacacccuauagaacucugcuuaugaacgaacugggcgugccuuuucauuuggguaccaaacaggucuguaucgcuuggucaagcaguuccugccacgaugggaaggccuggcuccauguguguguaacaggacacgacgagaaugcaaccgccucuuucauuuacgauggcaggcugguugacagcaucguguccuggaguaaaaacauccugcggacgcaggaaucagagugcgucuguauuaauggcacuugcacaguggugaugaccgaugggagcgcuucugagcgcgcagacacuaagauacucuuuaucgaagagggaaaaauuguccacaucuccccauuaucagguagcgcccaacauguugaagagugcaguuguuauccgagauaccccggcgugaggugcguaugucgggauaacuggaaggggucuaaccgcccuauaguggacauuaaugucaaggauuacuccaucgugagcucguauguuugcucuggacuggugggcgacacaccacgaaagaacgacuccucaaguagcuccuacugucuuaaucccaacaaugaaaaagguucucacggggucaaaggaugggcuuucgaugacggcaacgauguguggaugggcagaaccaucggggaggaguugaggagcggauaugaaacguuuaagguaauugguggcuggucaaccccuaauaguaaacugcagacaaaccggcagguuaucguggaccgugggaaucgcuccggauacagcggcauuuucucugucgagucaaagaguugcauaaacagauguuuuuauguggaacuaaucaggggucggaaacaggagacuaaggucugguggaccagcaauuccauugugguuuucugcgggacaucuggcacuuacggaaccggcucguggccagauggggccgacaucaaccucaugcccaucuga

SEQ ID NO: 144084 - RNA, 1410 nt, Artificial Sequence
  derived and/or modified sequence opt3 from neuraminidase__InfluenzaA__AFG99990
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggcaauguugugcgaaccgaagaucauagagagaaauaucacugaaauuguguauuuaaccaacacaaccaucgagaaagaaauuugucccaagcuggccgaguacaggaauuggucaaaaccucagugcaagaucacuggguucgcgccauuuaguaaggacaacagcauacggcuauccgcuggaggugauauuuggguaacacgcgagcccuaugugucuugugacccuggcaaaugcuaccaauucgcccucgggcagggaaccacgcugaauaaccgacauucgaaugauacuguccacgaccguaccccauauagaacacuucugaugaacgaauugggcgugcccuuucaucucgguacuaagcagguuuguaucgcauggucaagcaguuccugccacgaugggaaagccuggcugcaugugugugucaccggacacgacgagaaugcuacagcaucuuucauuuacgauggcaggcugguggacagcaucggcuccuggucaaagaacauccuccggacccaggaaagugagugcguauguauuaaugggacgugcacuguugugaugacagauggaagcgccucugagcgcgcugacaccaaaauauuauuuaucgaagaggguaagauuguccacaucuccccucugucaggcagcgcccaacauguggaagagugcaguuguuauccaagauacccgggggugaggugcgucugucgggauaacuggaagggaucuaaccgccccauaguugacauuaaugugaaagauuacuccaucguaagcucguaugugugcucuggccuugucggugacacuccucgaaagaacgacuccucaaguagcuccuacuguagaaauccaaacaaugaaaaagggucucacggagugaagggcugggcguucgaugacggcaacgauguuuggauggggaggacaaucagcgaggaguugcggucaggauaugaaaccuuuaaagugauugguggcuggaguaagcccaauuccaaacugcagaucaaccgucaggucauuguggaccgcgggaauagaagcggauacucuggcauauucucaguagaggguaagaguugcaucaacagguguuuuuauguugaacuaauucgggggcgaaagcaggagacggaagugugguggaccagcaauuccaucgucguguucugcggcacaucuggaacuuacggcaccgggucguggccugauggagcagacaucaaccucaugccaauuuga

SEQ ID NO: 144085 - RNA, 1410 nt, Artificial Sequence
  derived and/or modified sequence opt3 from neuraminidase__InfluenzaA__AFH00002
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaucccgugccagcccacuauaaucgaaagaaacauuaccgagaucguauauuugacaaauaccacuauugaaaaggagaucuguccuaaauuaguggaauacaggaacuggaguaagccacaaugcaaaauaacaggguucgcacccuuuagcaaggacaauuccauucggcugucugccggaggugauaucugggucacccgcgagccuuaugugucgugugacccaggcaagugcuaccaguucgcgcuagggcagggaacgacucucaacaaucgacauucaaacgauaccguucacgaccguacacccuauagaacucugcuuaugaaugagcugggcgugccuuuucauuuggguaccaaacaggucuguauugcuuggagcaguuccucuugccacgaugggaaggccuggcuccauguguguguaacaggacacgacgaaaacgcaaccgccagcuucaucuacgauggcaggcugguugacuccaucggcucauggaguaaaaauauucugcggacgcaagagagcgaaugcguguguauaaacgggacuugcgcugucgugaugacagauggaucugcauccgagcgcgccgacaccaagauccucuuuauugaggaagguaaagugguccacaucucaccauuaagcggcagugcucagcauguugaggaaugcucuuguuauccgagauaccccggggugaggugcguaugucgggauaauuggaagggauccaaccgcccuauaguggacauuaacgucaagaauuacagcaucgugucgucuuauguuugcuccggccuggugggugauacuccacgaaagaacgacucaaguagcuccucuuacuguagaaaucccaacaaugagaaagggagccacggagucaaaggcugggccuucgacgauggcaacgacguguggauggggaggacaaucucagaggaacuucggaguggauaugagaccuuuaagguaauugguggcugguccacgccuaauagcaaauugcagaucaaccgucagguuauuguggauucugggaaucgcucaggauacaguggcauauucagcgucgaagguaaguccugcaucaacagauguuuuuauguggagcugauuagggggcggaaacaagaaaccaaggucugguggacaucuaauucgaucgugguuuucugcggcacuagcggaaccuacggcacaggguccuggccagacggagcggauaucaaccuaaugcccauuuga

SEQ ID NO: 144086 - RNA, 1410 nt, Artificial Sequence; identical to SEQ ID NO: 137201
  derived and/or modified sequence opt3 from neuraminidase__InfluenzaA__AFH00013

SEQ ID NO: 144087 - RNA, 1410 nt, Artificial Sequence
  derived and/or modified sequence opt3 from neuraminidase__InfluenzaA__AFH00024
augaaccccaaucagaagaucauuaccauaggcagcgugucccugacaaucgccacuauuugcuuccucaugcaaaucacgauucuugucaccacaguuacucugcacuuuaaacaguacgaguguaacucuccuccaaauaaccaggugauguugugcgaaccgaccaucauagagagaaauaucacagaaauuguauauuuaaccaacacuacaaucgagaaggaaauuugucccaaacugguggaguacaggaauuggucaaagccucagugcaaaaucaccggguucgcuccauuuaguaaggacaacagcauacggcuauccgcaggaggugauauuugggucacgcgcgagcccuaugugucuugugacccuggcaagugcuaccaauucgcccucgggcagggaacuacccugaauaaccgacauucgaaugauacaguucacgaccguacuccauauagaacccuucugaugaacgaauugggcgugcccuuucaucucgguacaaaacaggucuguaucgcguggucaagcaguuccugccacgaugggaaggcuuggcugcauguguguguaaccggacacgacgagaaugccacggcaucuuucauuuacgauggcaggcugguugacagcaucggcuccuggaguaaaaacauccuccggacucaggaaucagagugcguguguauuaaugggacaugcaccgucgugaugacugauggaagcgccucugagcgcgcugacacaaagauauuauuuaucgaagaggguagaauugugcacaucuccccucugucaggcagcgcacaacaugucgaagagugcaguuguuauccaagguacccggggguucggugcgugugucgcgauaacuggaaaggaucuaaccgacccauaguagacauuaaugugaaggauuacuccaucgucagcucguaugugugcucuggccuuguuggugacaccccuagaaagaacgacuccucaaguagcuccuacuguaggaauccaaacaaugaaaaagggucucacggagugaagggcugggccuucgaugacggcaacgaugucuggauggggcggacgaucagcgaggaguugcguucaggauaugaaaccuuuaaagugauugguggcuggaguacacccaauuccaagcugcagaucaaccgccagguaauuguugacagagggaauaggagcggauacucuggcauauucucaguggaggguaaaaguugcaucaaccgguguuuuuaugucgaacuaauucgagggcgcaagcaggagaauaaagugugguggacuagcaacuccaucgucguguucugcggcaccucuggaacauacggcacugggucguggccugauggagcugacaucaaucucaugccaauuuga

SEQ ID NO: 144088 - RNA, 1410 nt, Artificial Sequence; identical to SEQ ID NO: 137201
  derived and/or modified sequence opt3 from neuraminidase__InfluenzaA__AFH00035

SEQ ID NO: 144089 - RNA, 1410 nt, Artificial Sequence; identical to SEQ ID NO: 137201
  derived and/or modified sequence opt3 from neuraminidase__InfluenzaA__AFH00046

SEQ ID NO: 144090 - RNA, 1410 nt, Artificial Sequence
  derived and/or modified sequence opt3 from neuraminidase__InfluenzaA__AFH00057
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacguucuccggacgcaggaaucagagugcguguguaucaaugggacuugcacagucgugaugaccgauggaagcgcaucugagcgcgccgacacuaagauuuuauuuauagaagaggguaaaaucgugcacauuuccccucugucaggcagcgcucaacaugucgaagagugcaguuguuauccaagauacccggggguuaggugcgugugucgggauaacuggaagggaucuaaccgccccaucguagacauaaaugugaaggauuacuccauugucagcucguaugugugcucuggccuuguuggugacacaccucgaaagaacgacuccucaaguagcuccuacuguagaaauccaaacaaugaaaaagggucucacggagugaaaggcugggccuucgaugacggcaacgaugucuggauggggaggaccaucagcgaggaguugcggucaggauaugaaacguuuaaggugaucgguggcuggaguaaucccaacuccaaacugcagauuaaucgucagguaaucguugaccgcgggaacagaagcggauacucuggcauuuucucaguggaggguaagaguugcauaaauagguguuuuuaugucgaacuaauccgggggcgaaaacaggagaccgaagugugguggacaagcaacuccauugucguguucugcggcacuucuggaaccuacggcacagggucguggccugauggagcggacaucaaucucaugccaaucuga

SEQ ID NO: 144091 - RNA, 1410 nt, Artificial Sequence; identical to SEQ ID NO: 137201
  derived and/or modified sequence opt3 from neuraminidase__InfluenzaA__AFH00068

SEQ ID NO: 144092 - RNA, 1410 nt, Artificial Sequence
  derived and/or modified sequence opt3 from neuraminidase__InfluenzaA__AFH00079
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacauccuccggacgcaggaaucagagugcguuuguauuaaugggacuugcacaguggucaugaccgauggaagcgcaucugagcgcgccgacacuaagauauuauuuaucgaagaggguaaaauugugcacaucuccccucugucaggcagcgcucaacauguggaagagugcaguuguuauccaagauacccgggggucaggugcguuugucgggauaacuggaagggaucuaaccgccccauaguggacauuaauguaaaggauuacuccaucgugagcucguaugucugcucuggccuugugggugacacaccucgaaagaacgacuccucaaguagcuccuacuguagaaauccaaacaaugaaaaagggucucacggaguuaaaggcugggccuucgaugacggcaacgauguguggauggggaggaccaucagcgaggaguugcggucaggauaugaaacguuuaaggucauugaggguuggaguaaacccaauuccaagcugcagaucaaccgucaggugauuguagaccgcggcaauagaagcggguacucuggaauauucucaguugaaggcaaaaguugcaucaacagguguuuuuauguggagcuaauucggggucgaaagcaggaaaccgaggucugguggacaagcaauuccaucguggucuucugcgggacuucuggcaccuacggaacaggcucguggccugauggggcggacaucaaccucaugccaauuuga

SEQ ID NO: 144093 - RNA, 1410 nt, Artificial Sequence
  derived and/or modified sequence opt3 from neuraminidase__InfluenzaA__AFH00090
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacauccuccggacgcaggaaucagagugcguuuguauuaaugggacuugcacaguggucaugaccgauggaagcgcaucugagcgcgccgacacuaagauauuauuuaucgaagaggguaaaauugugcacaucuccccucugucaggcagcgcucaacauguggaagagugcaguuguuauccaagauacccgggggucaggugcguuugucgggauaacuggaagggaucuaaccgccccauaguggacauuaauguaaaggauuacuccaucgugagcucguaugucugcucuggccuugugggugacacaccucggaaaaacgacuccucaaguagcuccuacuguuggaauccaaacaaugaaaaggggucucacggaguuaaaggcugggccuucgaugacggcaacgauguguggauggggagaaccaucagcgaggaguugaggucaggauaugaaacguuuaaggucauugguggcuggaguaaacccaauuccaagcugcagaucaaccgacaggugauuguagaccgugggaaucgcagcggauacucuggcauauucucaguugaggguaaaaguugcaucaacagauguuuuuauguggaacuaauuagggggcggaagcaggagaccgaagucugguggacaagcaauuccaucguggucuucugcggcacuucuggaaccuacggcacagggucguggccugauggagcggacaucaaccucaugccaauuuga

SEQ ID NO: 144094 - RNA, 1410 nt, Artificial Sequence
  derived and/or modified sequence opt3 from neuraminidase__InfluenzaA__AFH00101
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaagauccuccggacgcaggaaucagagugcguuuguauuaacgggacuugcacaguggucaugaccgauggaagcgcaucugagcgcgccgacacuaaaauauuauuuaucgaagaggguaagauugugcacaucuccccucugucaggcagcgcucaacauguggaagagugcaguuguuauccaagauacccgggggucaggugcguuugucgggauaauuggaagggaucuaaccgccccauaguggacauuaacguaaaagauuacuccaucgugagcucguaugucugcucuggccuugugggugacacaccucgaaagaaugacuccucaaguagcuccuacuguagaaacccaaauaacgaaaaagggucucacggaguuaagggcugggccuucgaugacggcaaugauguguggauggggaggaccaucagcgaggaguugcggucaggauaugaaacguuuaaagucauugguggcuggaguaagcccaacuccaaacugcagaucaaucgucaggugauuguagaccgcgggaacagaagcggauacucuggcauauucucaguugaggguaagaguugcaucaauagguguuuuuauguggaacuaauucgggggcgaaagcaggagaccgaagucugguggacaagcaacuccaucguggucuucugcggcacuucuggaaccuacggcacagggucguggccugauggagcggacaucaaucucaugccaauuuga

SEQ ID NO: 144095 - RNA, 1410 nt, Artificial Sequence; identical to SEQ ID NO: 137117
  derived and/or modified sequence opt3 from neuraminidase__InfluenzaA__AFH00112

SEQ ID NO: 144096 - RNA, 1410 nt, Artificial Sequence; identical to SEQ ID NO: 137117
  derived and/or modified sequence opt3 from neuraminidase__InfluenzaA__AFH00123

SEQ ID NO: 144097 - RNA, 1410 nt, Artificial Sequence
  derived and/or modified sequence opt3 from neuraminidase__InfluenzaA__AFH00156
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacauccuccggacgcaggaaucagagugcguuuguauuaaugggacuugcacaguggucaugaccgauggaagcgcaucugagcgcgccgacacuaagauauuauuuaucgaagaggguaaaauugugcacaucuccccucugucaggcagcgcucaacauguggaagagugcaguuguuauccaagauacccgggggucaggugcguuugucgggauaacuggaagggaucuaaccgccccauaauugacaucaaugugaaggauuacuccaucguaagcucguaugugugcucuggccuugucggugacacaccucgaaagaacgacuccucaaguagcuccuacuguagaaauccaaacaaugaaaaagggucucacggagugaaaggcugggccuucgaugacggcaacgauguuuggauggggaggaccauuagcgaggaguugcggucaggauaugaaacguuuaaggugaucgguggcuggaguaaacccaauuccaagcugcagauuaaccgucaggucauaguggaccgcgggaauagaagcggauacucuggcaucuucucaguagaggguaaaaguugcauuaacagguguuuuuauguugaacuaauccgggggcgaaagcaggagaccgaagugugguggacaagcaauuccaucgucguguucugcggcacuucuggaaccuacggcacagggucguggccugauggagcggacauuaaccucaugccaauauga

SEQ ID NO: 144098 - RNA, 1410 nt, Artificial Sequence
  derived and/or modified sequence opt3 from neuraminidase__InfluenzaA__AFH00167
augaaccccaaucagaagaucauuaccauaggcagcgugucccugacaaucgccacuaugugcuuccucaugcaaauugcuauccuugucacgaccguuacacugcacuuuaaacaguacgaguguaacucuccuccaaauaaccaggugauguugugcgaaccgacuauuaucgagagaaauauaaccgaaaucguauauuuaacaaacaccacuauugagaaggaaaucugucccaaacuggcagaguacaggaauuggucaaagccucagugcaaaauuacaggguucgccccauuuaguaaggacaacagcauccggcuauccgcgggaggugauauaugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguauugccuggucaagcaguuccugccacgaugggaaggcauggcugcaugucugugugacaggacacgacgagaaugccaccgcuucuuucaucuacgauggcaggcugguagacagcauuggcuccuggaguaaaaacauccuccggacgcaggaaucagagugcguuuguaucaaugggacuugcacaguggucaugaccgauggaagcgcaucugagcgcgccgacacuaagauuuuauuuauagaagaggguaaaaucgugcacauuuccccucugucaggcagcgcucaacauguggaagagugcaguuguuauccaagauacccgggggucaggugcguuugucgggauaacuggaagggaucuaaccgccccaucguggacauaaauguaaaggauuacuccauugugagcucguaugucugcucuggccuugugggugacacaccucgaaagaacgacuccucaaguagcuccuacuguagaaauccaaacaaugaaaaagggucucacggaguuaaaggcugggccuucgaugacggcaacgauguguggauggggaggaccaucagcgaggaguugcggucaggauaugaaacguuuaaggucaucgguggcuggaguaaacccaauuccaagcugcagauuaaccgucaggugaucguagaccgcgggaauagaagcggauacucuggcauuuucucaguugaggguaaaaguugcauaaacagguguuuuuauguggaacuaauccgggggcgaaagcaggagaccgaagucugguggacaagcaauuccauuguggucuucugcggcacuucuggaaccuacggcacagggucguggccugauggagcggacaucaaccucaugccaaucuga

SEQ ID NO: 144099 - RNA, 1410 nt, Artificial Sequence; identical to SEQ ID NO: 144097
  derived and/or modified sequence opt3 from neuraminidase__InfluenzaA__AFH00178

SEQ ID NO: 144100 - RNA, 1410 nt, Artificial Sequence
  derived and/or modified sequence opt3 from neuraminidase__InfluenzaA__AFH00189
augaaccccaaucagaagaucauuaccauaggcagcgugucccugacaaucgccacuauuugcuuccucaugcaaaucgcuauucuugucacgaccguuacacugcacuuuaaacaguacgaguauaacucuccuccaaauaaccaggugauguugugugaaccgaagaucauagagagaaauaucacugaaauuguauacuuaaccaacacaaccaucgagaaagaaauuugccccaagcuggcagaguauaggaauuggucaaaaccucaguguaagaucacuggguucgccccauuuaguaaggacaacagcauacggcuauccgcgggaggugauauuugggugacacgcgagcccuacgucucuugcgacccuggcaaauguuaucaauucgcucucgggcagggaaccacgcugaauaaccgacauucgaaugauacugugcacgaccguaccccauacagaacacuucugaugaacgaauugggcguucccuuucaucucgguacuaaacaggugugcaucgccuggucaagcaguuccugucacgaugggaaggcauggcugcaugucugcgugaccggacacgacgagaaugccacagcuucuuucauuuaugauggcaggcugguagacagcaucggcuccuggucaaagaacauccuccggacccaggaaagugaguguguuugcauuaaugggacguguacuguggucaugacagauggaagcgcaucugagcgcgccgacaccaaaauauuauuuaucgaagaggguaagauugugcacaucuccccucugucaggcagcgcucaacauguggaagagugcaguugcuacccaagauacccgggggucagguguguuugccgggauaacuggaagggaucuaaccgccccauaguggacauuaauguaaaagauuauuccaucgugagcucguacgucuguucuggccuugugggugacacuccucgaaagaacgacuccucaaguagcuccuauugcagaaauccaaacaaugaaaaagggucucacggaguuaagggcugggccuucgaugacggcaacgauguguggauggggaggacaaucagcgaggaguugcggucaggauacgaaaccuuuaaagucauugguggcuggaguaagcccaauuccaaacugcagaucaaccgucaggugauuguagaccgcgggaauagaagcggauauucuggcauauucucaguugaggguaagaguuguaucaacaggugcuuuuacguggaacuaauucgggggcgaaagcaggagacggaagucugguggaccagcaauuccaucguggucuucuguggcacaucuggaacuuauggcaccgggucguggccugauggagcggacaucaaccucaugccaauuuga

SEQ ID NO: 144101 - RNA, 1410 nt, Artificial Sequence; identical to SEQ ID NO: 137201
  derived and/or modified sequence opt3 from neuraminidase__InfluenzaA__AFH00200

SEQ ID NO: 144102 - RNA, 1410 nt, Artificial Sequence; identical to SEQ ID NO: 144098
  derived and/or modified sequence opt3 from neuraminidase__InfluenzaA__AFH00211

SEQ ID NO: 144103 - RNA, 1410 nt, Artificial Sequence
  derived and/or modified sequence opt3 from neuraminidase__InfluenzaA__AFH00222
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaauaacaccgugcacgaucguacaccauauagaacucuucugaugaaugaauugggcguucccuuucaucucgguaccaaacagguguguaucgccuggucaagcaguuccugccacgacgggaaggcauggcugcaugucugugugacaggacacgaugagaacgccaccgcuucuuucauuuacgacggcaggcugguagauagcaucggcuccuggaguaaaaauauccuccggacgcaggaaucagagugcguuuguauuaacgggacuugcacaguggucaugaccgacggaagcgcaucugagcgcgccgauacuaagauauuauuuaucgaagaggguaaaauugugcacaucuccccucugucaggcagcgcucaacauguggaagagugcaguuguuauccaagauacccgggggucaggugcguuugucgggacaacuggaagggaucuaaucgccccauaguggauauuaacguaaaggacuacuccaucgugagcucguaugucugcucuggccuugugggugauacaccucgaaagaaugacuccucaaguagcuccuacuguagaaacccaaauaacgaaaaagggucucacggaguuaaaggcugggccuucgacgauggcaaugacguguggauggggaggaccaucagcgaggaguugcggucaggauaugaaacguuuaaggucauugguggcuggaguaaacccaacuccaagcugcagaucaaucgucaggugauuguagaucgcgggaacagaagcggauacucuggcauauucucaguugaggguaaaaguugcaucaauagguguuuuuauguggaacuaauucgggggcgaaagcaggagaccgaagucugguggacaagcaacuccaucguggucuucugcggcacuucuggaaccuacggcacagggucguggccugacggagcggauaucaaucucaugccaauuuga

SEQ ID NO: 144104 - RNA, 1410 nt, Artificial Sequence; identical to SEQ ID NO: 137117
  derived and/or modified sequence opt3 from neuraminidase__InfluenzaA__AFH00233

SEQ ID NO: 144105 - RNA, 1410 nt, Artificial Sequence
  derived and/or modified sequence opt3 from neuraminidase__InfluenzaA__AFH00244
augaaccccaaucagaagaucauuaccauaggcagcgugucccugacaaucgccacuauuugcuuccucaugcaaaucgcuauucuugucacgaccguuacacuguacuuuaaacaguaugaguguaacucuccuccaucaaaucaggugauguugugcgaaccgacuaucguagagagaaacauaaccgaaaucguguacuuaacaaauaccacuauugagaaggaaaucugucccaaacuggcagaguauaggaacuggaguaagccucagugcaaaauuacaggguucgccccauuuagcaaggacaauuccauccggcuaucugcgggaggugauauaugggucacccgcgagcccuacgugucgugugacccuggcaagugcuaucaauucgcucucgggcagggaacgacucugaacaaucgacacucaaacgauaccguucaugaccguacaccauacagaacucuucugaugaaugaauugggcgugcccuuucaccucgguaccaaacaggucuguauugccuggagcaguuccucuugccaugaugggaaggcauggcugcacguguguguaacaggacaugacgagaacgccaccgcuagcuucaucuaugauggcaggcugguugacuccauuggcucauggaguaaaaauauccuccggacgcaggaaagcgagugcguguguaucaacgggacuugcacagucgugaugaccgauggaucugcauccgagcgcgccgacacuaagauuuuauuuauagaagaggguaaaaucgugcacauuucaccucugagcggcagugcuaagcacgucgaagagugcucuuguuacccaagauacccggggguuaggugcgugugucgggauaauuggaagggauccaaccgccccaucguagacauaaacgugaaagauuauagcauugucucgucuuacgugugcuccggccuuguuggugacacaccucgaaagaaugacucaaguagcuccucuuauuguagaaacccaaauaacgaaaaagggagccauggagugaagggcugggccuucgaugacggcaaugaugucuggauggggaggaccaucucagaggaguugcggaguggauacgaaacguuuaaagugaucgguggcugguccaagcccaacagcaaacugcaaauuaaucgucagguaaucguugaccgcgggaacagaucuggauauucaggcauuuucaguguggaggguaagagcugcauaaauagguguuuuuacgucgaacuaauccgggggcgaaagcaggagaccgaagugugguggacauccaacucuauugucguguucugcggcacuucgggaaccuauggcacagggagcuggccugauggagcggacaucaaucucaugccaaucuga

SEQ ID NO: 144106 - RNA, 1410 nt, Artificial Sequence; identical to SEQ ID NO: 137201
  derived and/or modified sequence opt3 from neuraminidase__InfluenzaA__AFH00255

SEQ ID NO: 144107 - RNA, 1410 nt, Artificial Sequence; identical to SEQ ID NO: 137201
  derived and/or modified sequence opt3 from neuraminidase__InfluenzaA__AFH00266

SEQ ID NO: 144108 - RNA, 1410 nt, Artificial Sequence
  derived and/or modified sequence opt3 from neuraminidase__InfluenzaA__AFH00277
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaucaaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucgugugacccuggcaagugcuaccaauucgcucucgggcagggaacgacucugaacaaucgacauucaaacgauaccgugcacgaccguacaccauauagaacucuucugaugaaugaauugggcguucccuuucaucucgguaccaaacagguguguaucgccuggagcaguuccucuugccacgaugggaaggcauggcugcaugucugugugacaggacacgacgagaacgccaccgcuagcuucauuuacgauggcaggcugguagacuccaucggcucauggaguaaaaauauccuccggacgcaggaaagcgagugcguuuguauuaacgggacuugcacaguggucaugaccgauggaucugcauccgagcgcgccgacacuaagauauuauuuaucgaagaggguaaaauugugcacaucucaccucugagcggcagugcucaacauguggaagagugcucuuguuauccaagauacccgggggucaggugcguuugucgggauaauuggaagggauccaaccgccccauaguggacauuaacguaaaggauuacagcaucgugucgucuuaugucugcuccggccuugugggugacacaccucgaaagaaugacucaaguagcuccucuuacuguagaaaaccaaacaaugaaaaagggagccacggauugaagggcugggccuucgaugacggcaacgauguuuggauggggaggaccaucucagaggagcugcggaguggauaugaaacguuuaaagugauugguggcugguccaagcccaauagcaaacuacagaucaaccgucaggucauuguggaccgcgggaauagaucuggauacucaggcauauucaguguagaggguaagagcugcaucaacagguguuuuuauguugaacucauucgggggcgaaagcaggagaccgaagugugguggacauccaauucuaucgucguguucugcggcacuucgggaaccuacggcacagggagcuggccugauggagcggacaucaaccugaugccaauuuga

SEQ ID NO: 144109 - RNA, 1410 nt, Artificial Sequence; identical to SEQ ID NO: 137201
  derived and/or modified sequence opt3 from neuraminidase__InfluenzaA__AFH00288

SEQ ID NO: 144110 - RNA, 1410 nt, Artificial Sequence; identical to SEQ ID NO: 144033
  derived and/or modified sequence opt3 from neuraminidase__InfluenzaA__AFH00299

SEQ ID NO: 144111 - RNA, 1410 nt, Artificial Sequence
  derived and/or modified sequence opt3 from neuraminidase__InfluenzaA__AFH00310
augaaccccaaucagaagaucauuaccauaggcagcgugucccugacaaucgccacuauuugcuuccucaugcaaaucgcuauucuugucacgaccguuacacugcacuuuaaacaguacgaguguucuucaaguccuaacaaucaggugaucccaugccagccgacuauaaucgaaagaaacauuaccgagaucguauauuugacaaauaccacuauugaaaaggagaucugucccaaauuaguggaauacaggaacuggagcaagccucaaugcaaaauaacaggguucgcaccauuuuccaaggacaauucuauucggcugucggccggaggugauaucugggucacccgcgagcccuaugugucaugugacccuggcaagugcuaccaguucgcgcuagggcagggaacgacucucaacaaucgacauagcaacgauaccguucacgaccguacaccauauagaacucugcuuaugaaugagcugggcgugcccuuucauuuggguaccaaacaggucuguauugcuuggaguuccucuagcugccacgaugggaaggccuggcuccauguguguguaacaggacacgacgaaaacgcaaccgccuccuucaucuacgauggcaggcugguugacucaaucggcaguuggagcaaaaauauucugcggacgcaagagucugaaugcguguguauaaacgggacuugcacagucgugaugaccgauggauccgcuucagagaaggcagacacuaaaauccucuuuauugaggaagguaaggugguccacaucagcccuuuaaguggcucugcccagcauguugaggaaugcuccuguuauccacgcuacccgggggugagaugcguauguagggauaauuggaagggaagcaaccggcccauaguggacauuaacgucaaaaauuacucgaucgugucuuccuauguuugcucaggccuggugggugauacaccucgcaagaacgacaguagcuccucuagcuacugucgaaauccaaacaaugagaaagggucacacggagucaagggcugggcuuucgacgauggcaacgacguguggauggggagaaccaucagugaggaacuuagguccggauaugagacguuuaaaguaauugguggcuggagcacccccaauucuaaguugcagaucaaccggcagguuauuguggauucagggaaucguaguggauacagcggcauauucuccgucgaagguaaaucuugcaucaaccgcuguuuuuauguggagcugauuagagggaggaagcaagaaacaaaggucugguggacuucgaauagccuagugguuuucugcggcaccuccggaacauacggcacugggucauggccugacggagccgauaucaaccucaugccaaucuga

SEQ ID NO: 144112 - RNA, 1410 nt, Artificial Sequence; identical to SEQ ID NO: 144111
  derived and/or modified sequence opt3 from neuraminidase__InfluenzaA__AFH00321

SEQ ID NO: 144113 - RNA, 1410 nt, Artificial Sequence
  derived and/or modified sequence opt3 from neuraminidase__InfluenzaA__AFH00332
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacauccuccggacgcaggaaucagagugcguuuguauuaaugggacuugcacaguggucaugaccgauggaagcgcaucugagcgcgccgacacuaagauauuauuuaucgaagaggguaaaauugugcacaucuccccucugucaggcagcgcucaacauguggaagagugcaguuguuauccaagauacccgggggucaggugcguuugucgggauaacuggaagggaucuaaccgccccauaguggacauuaauguaaaggauuacuccaucgugagcucguaugucugcucuggccuugugggugacacaccucggaaaaacgacuccucaaguagcucccacuguuugaauccaaacaaugaagaagggggacauggcguuaagggcugggccuucgaugacgggaacgauguguggaugggaagaaccaucucugagaaacugaggagcgguuacgagacguuuaaggucauuggcggguggucaaaacccaauaguaagcuacagaucaaccgacaggugauuguagaccguggaaaucgcuccggcuauagcgguauauucucuguugaggggaaaggcugcaucaacagauguuuuuacguggaacucauuaggggacggaagcaggagaccgaagucugguggacaucaaauaguaucguggucuucugcggcacuagcgggaccuauggaacagguuccuggccugauggcgcggacaucaaccugaugccaauuuga

SEQ ID NO: 144114 - RNA, 1410 nt, Artificial Sequence
  derived and/or modified sequence opt3 from neuraminidase__InfluenzaA__AFH00343
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaucaaaucaggcaauguugugcgaaccgacuaucauagagagaaacaucaccgaaauuguguauuuaacaaauaccacuaucgagaaggaaauuugucccaaacuggccgaguacaggaacuggaguaagccucagugcaaaaucacaggguucgcgccauuuagcaaggacaauuccauacggcuaucugcuggaggugauauuuggguaacccgcgagcccuaugugucgugugacccuggcaagugcuaccaauucgcccucgggcagggaacgacucugaacaaucgacauucaaacgauaccguccacgaccguacaccauauagaacucuucugaugaaugaauugggcgugcccuuucaucucgguaccaaacagguuuguaucgcauggagcaguuccucuugccacgaugggaaggccuggcugcaugugugugucacaggacacgacgagaacgcuaccgccagcuucauuuacgauggcaggcugguggacuccaucggcucauggaguaaaaauauccuccggacgcaggaaagcgagugcguauguauuaacgggacuugcacaguugugaugaccgauggaucugcauccgagcgcgcugacacuaagauauuauuuaucgaagaggguaaaauuguccacaucucaccucugagcggcagugcccaacauguggaagagugcucuuguuauccaagauacccgggggugaggugcgucugucgggauaauuggaagggauccaaccgccccauaguugacauuaacgugaaggauuacagcaucguaucgucuuaugugugcuccggccuugucggugacacaccucgaaagaaugacucaaguagcuccucuuacuguagaaacccaaauaacgaaaaagggagccacggagugaaaggcugggcguucgaugacggcaaugauguuuggauggggaggaccaucucagaggaguugcggaguggauaugaaacguuuaaggugauugguggcugguccaaacccaacagcaagcugcagaucaaucgucaggucauuguggaccgcgggaacagaucuggauacucaggcauauucaguguagaggguaaaagcugcaucaauagguguuuuuauguugaacuaauucgggggcgaaagcaggagaccgaagugugguggacauccaacucuaucgucguguucugcggcacuucgggaaccuacggcacagggagcuggccugauggagcagacaucaaucucaugccaauuuga

SEQ ID NO: 144115 - RNA, 1410 nt, Artificial Sequence
  derived and/or modified sequence opt3 from neuraminidase__InfluenzaA__AFH00354
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccaagauuguauauuuaacaaacaccacuaucgaaaaagagauuugucccaagcuggcagaauacaggaauuggucaaaaccucagugcaagaucacaggguucgccccauuuaguaaggacaacagcauacggcuauccgcgggaggugauauuugggugacccgcgagcccuaugucucuugugacccuggcaaaugcuaccaauucgcucucgggcagggaacgacucugaauaaccgacauucgaaugauaccgugcacgaccguacaccauauagaacucuucugaugaacgaguugggcguucccuuucaucucgguaccaaacagguguguaucgccuggucaagcaguuccugccacgaugggaaggcauggcugcaugucugugugacaggacacgacgaaaaugccaccgcuucuuucauuuacgauggcaggcugguagacagcaucggcuccuggucaaagaacauccuccggacgcaggagagugaaugcguuuguauuaaugggacuugcacaguggucaugaccgauggaagcgcaucugagcgcgccgacacuaaaauauuauuuaucgaggaagguaagauugugcacaucuccccucugucaggcagcgcucaacauguggaggaaugcaguuguuauccaagauacccgggggucaggugcguuugucgggauaacuggaagggaucuaaccgccccauaguggacauuaauguaaaagauuacuccaucgugagcucguaugucugcucuggccuugugggugacacaccucgaaagaacgacuccucaaguagcuccuacuguuugaauccaaacaaugaggaagggggacacggcguuaaaggcugggccuucgaugacgggaacgauguguggaugggaagaaccaucucugagaagcugaggagcgguuaugagacguuuaaagucauuggcggguggucaaagcccaauaguaaacuacagaucaaccgucaggugauuguagaccggggaaaucgcuccggcuacagcgguauauucucuguugaagggaagucaugcgugaacagauguuuuuaugucgagcucaucaggggccggaagcaggaaaccgaggugugguggacaaguaauagcauugucguguucugcggaacuuccggcaccuacgggacaggaucuuggccugauggugcggacaucaaccugaugccaaucuga

SEQ ID NO: 144116 - RNA, 1410 nt, Artificial Sequence; identical to SEQ ID NO: 136996
  derived and/or modified sequence opt3 from neuraminidase__InfluenzaA__AFH00365

SEQ ID NO: 144117 - RNA, 1410 nt, Artificial Sequence
  derived and/or modified sequence opt3 from neuraminidase__InfluenzaA__AFH00376
augaaccccaaucagaagaucauuaccauaggcagcgugucccugacaaucgccacuauuugcuuccucaugcaaaucgcuauucuugucacgaccguuacacugcacuuuaaacagugugagugcaacucuccuccaaauaaccaggugauguugugugaaccgacuaucauagagagaaauaucaccgaaauuguauacuuaacaaacaccacuaucgagaaggaaauuugccccaaacuggcagaguauaggaauuggucaaagccucaguguaaaaucacaggguucgccccauuuaguaaggacaacagcauacggcuauccgcgggaggugauauuugggugacccgcgagcccuacgucucuugcgacccuggcaaguguuaucaauucgcucucgggcagggaacgacucugaauaaccgacauucgaaugauaccgugcacgaccguacaccauacagaacucuucugaugaacgaauugggcguucccuuucaucucgguaccaaacaggugugcaucgccuggucaagcaguuccugucacgaugggaaggcauggcugcaugucugcgugacaggacacgacgagaaugccaccgcuucuuucauuuaugauggcaggcugguagacagcaucggcuccuggaguaaaaacauccuccggacgcaggaaucagaguguguuugcauuaaugggacuugcacaguggucaugaccgauggaagcgcaucuggucgcgccgacacuaagauauuauuuaucgaggaaggcaaaauugugcacaucuccccucugucagggagcgcucaacauguggaggaauguaguugcuacccaagauauccgggagucagguguguuugccgggauaacuggaagggcucuaaccgccccauaguggacauuaauguaaaggauuacuccaucgugagcucguacgucuguucuggucuugugggggacacaccucggaaaaacgacuccucaaguagcuccuauugcuugaauccaaacaaugaggaaggaggccacggcguuaaggggugggccuucgaugacggaaacgauguguggauggguagaaccaucucugagaaacugaggagcggcuacgagacguuuaaggucauugggggauggucaaaacccaauaguaagcuacagaucaaccgacaggugauuguagaccguggcaaucgcuccgguuauagcgggauauucucuguugaaggcaaaucauguaucaacagaugcuuuuacguggagcucauuaggggacggaagcaggaaaccgaggucugguggacaaguaauagcaucguggucuucuguggcacuuccgggaccuauggaacagguucuuggccugauggcgcggacaucaaccugaugccaauuuga

SEQ ID NO: 144118 - RNA, 1410 nt, Artificial Sequence
  derived and/or modified sequence opt3 from neuraminidase__InfluenzaA__AFH00387
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucuccucauggaguaaaaacauccuccggacgcaggaaagcgagugcguuuguauuaauggcacuugcacaguggucaugaccgacggcucugcauccgagcgcgccgauacuaagauauuauuuaucgaagaggggaaaauugugcacaucucaccucugagcggaagugcucaacauguggaagagugcucuuguuauccaagauacccgggugucaggugcguuugucgggacaacuggaagggcuccaaccgccccauaguggauauuaauguaaaggacuacagcaucgugucgucuuaugucugcuccgggcuugugggagacacaccucggaaaaacgauucaaguagcuccucuuacuguuugaauccaaacaaugaagagggcggucacgggguuaagggaugggccuucgacgauggcaacgacguguggaugggcagaaccaucagcgagaaacugaggucaggguaugaaacguuuaaggucauuggagguuggaguaaacccaauuccaagcuacagaucaaccgacaggugauuguagaucguggcaaucgcagcggguacucuggaauauucucaguugagggcaaaaguugcgugaacagauguuuuuaugucgaacucaucaggggucggaagcaggagaccgaagugugguggacaagcaauuccauugucguguucugcgggacuucuggcaccuacggaacaggcucguggccugacggggcggauaucaaccugaugccaaucuga

SEQ ID NO: 144119 - RNA, 1410 nt, Artificial Sequence
  derived and/or modified sequence opt3 from neuraminidase__InfluenzaA__AFH00398
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacauccuccggacgcaggaaucagagugcguuuguauuaaugggacuugcacaguggucaugaccgauggaagcgcaucugagcgcgccgacacuaagauauuauuuaucgaagaggguaaaauugugcacaucuccccucugucaggcagcgcucaacauguggaagagugcaguuguuauccaagauacccgggggucaggugcguuugucgggauaacuggaagggaucuaaccgccccauaguggacauuaauguaaaggauuacuccaucgugagcucguaugucugcucuggccuugugggugacacaccucggaaaaacgacuccucaaguagcuccuacuguuugaauccaaacaaugaagaagggggacacggcguuaagggcugggccuucgaugacgggaacgauguguggaugggaagaaccaucucugagaaacugaggagcgguuaugagacguuuaaggucauuggcggguggucaaaacccaauaguaagcuacagaucaaccgacaggugauuguagaccguggaaaucgcuccggcuacagcgguauauucucuguugaggggaaaucaugcgugaacagauguuuuuaugucgaacucaucaggggccggaagcaggagaccgaagugugguggacaaguaauagcauugucguguucugcggaacuuccggcaccuacggggcgggaucuuggccugauggugcagacaucaaccugaugccaaucuga

SEQ ID NO: 144120 - RNA, 1410 nt, Artificial Sequence
  derived and/or modified sequence opt3 from neuraminidase__InfluenzaA__AFH00409
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacaaugagaacgccaccgcuucuuucauuuacgacggcaggcugguagauagcaucggcuccuggaguaaaaauauccuccggacgcaggaaucagagugcguuuguauuaacgggacuugcacaguggucaugaccgacggaagcgcaucuggucgcgccgauacuaagauauuauuuaucgaggaaggcaaaauugugcacaucuccccucugucagggagcgcucaacauguggaggaaugcaguuguuauccaagauacccgggagucaggugcguuugucgggacaacuggaagggcucuaaucgccccauaguggauauuaacguaaaggacuacuccaucgugagcucguaugucugcucuggucuugugggggauacaccucggaaaaaugacuccucaaguagcuccuacuguuugaacccaaauaacgaggaaggaggccacggcguuaaggggugggccuucgacgauggaaaugacguguggauggguagaaccaucucugagaaacugaggagcggcuaugagacguuuaaggucauugggggauggucaaaacccaacaguaagcuacagaucaaucgacaggugauuguagaucguggcaaccgcuccgguuacagcgggauauucucuguugaaggcaaaucaugcaucaauagauguuuuuauguggagcucauuaggggacggaagcaggaaaccgaggucugguggacaaguaacagcaucguggucuucugcggcacuuccgggaccuacggaacagguucuuggccugacggcgcggauaucaaucugaugccaauuuga

SEQ ID NO: 144121 - RNA, 1410 nt, Artificial Sequence; identical to SEQ ID NO: 136996
  derived and/or modified sequence opt3 from neuraminidase__InfluenzaA__AFH00420

SEQ ID NO: 144122 - RNA, 1410 nt, Artificial Sequence; identical to SEQ ID NO: 137129
  derived and/or modified sequence opt3 from neuraminidase__InfluenzaA__AFH00431

SEQ ID NO: 144123 - RNA, 1410 nt, Artificial Sequence
  derived and/or modified sequence opt3 from neuraminidase__InfluenzaA__AFH00442
augaaccccaaucagaagaucauuaccauaggcagcgugucccugacaaucgccacuauuugcuuccucaugcaaaucgcuauucuugucaucacgguuacccugcacuuuaaacaguacgaguguaacucuccuccaaauaaccaggugauguugugcgaaccgacaauaaucgagagaaauauuacugaaaucguauauuuaaccaacacaaccauugagaaggaaaucugucccaaacuggcagaguacaggaauuggucaaagccucagugcaaaauaacuggguucgccccauuuaguaaggacaacagcauucggcuauccgcgggaggugauaucugggugacacgcgagcccuaugucucuugugacccuggcaagugcuaccaauucgcucucgggcagggaaccacgcugaauaaccgacauucgaaugauacugugcacgaccguaccccauauagaacacuucugaugaacgaauugggcguucccuuucaucucgguacuaaacagguguguauugccuggucaagcaguuccugccacgaugggaaggcauggcugcaugucugugugaccggacacaaugagaacgccacagcuucuuucaucuacgacggcaggcugguagauagcaucggcuccuggaguaaaaauauucuccggacccaggaaucagagugcguuuguauaaacgggacgugcacuguggucaugacagacggaagcgcaucuggucgcgccgauaccaagaucuuauuuauugaggaaggcaaaaucgugcacauauccccucugucagggagcgcucaacauguggaggaaugcaguuguuauccaagauacccgggagucaggugcguuugucgggacaacuggaagggcucuaaucgccccauuguggauaucaacguaaaggacuacuccaucgugagcucguaugucugcucuggucuugugggggauacuccucggaaaaaugacuccucaaguagcucccacuguuugaacccaaauaacgaggaaggaggccauggcguuaaggggugggccuucgacgauggaaaugacguguggauggguagaacaauuucugagaaacugaggagcggcuacgagaccuuuaaggucaucgggggauggucaaaacccaacaguaagcuacagauuaaucgacaggugauaguagaucguggcaaccgcuccgguuauagcgggaucuucucuguugaaggcaaaucaugcauuaauagauguuuuuacguggagcucaucaggggacggaagcaggaaacggaggucugguggaccaguaacagcaucguggucuucugcggcacauccgggacuuauggaaccgguucuuggccugacggcgcggauauuaaucugaugccaauauga

SEQ ID NO: 144124 - RNA, 1410 nt, Artificial Sequence
  derived and/or modified sequence opt3 from neuraminidase__InfluenzaA__AFH00453
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaguaguguauuuaacaaacaccacuauugagaaggaaaucugucccaaacuggcagaguacaggaauuggucaaagccucagugcaaaauuacaggguucgccccauuuaguaaggacaacagcauccggcuauccgcgggaggugauauaugggucacccgcgagcccuaugugucuugugacccugauaagugcuaccaauucgcucucggccaggggacgacucugaauaaccgacauucgaaugacauuguucacgaucguaccccauauagaacacuucugaugaacgaauugggagugcccuuucaucucggcacuaaacaggucuguaucgccuggucaagcaguuccugccacgacgguaaggcauggcugcauguguguguaaccgggcacgaugagaaugccacagcuucuuucauuuacgacggaaggcugguugauagcaucggcuccuggaguaaaaagauccuccggacccaggaaucagagugcguguguauuaacggcacgugcacugucgugaugacagacgggagcgcaucuggacgcgccgauaccaaaauauuauuuaucgaggaagguaagauugugcacaucuccccucugucaggcagcgcucaacaugucgaggaaugcaguuguuauccaagauacccggggguuaggugcgugugucgggacaauuggaagggaucuaaccgccccauaguagauauuaacgugaaagacuacuccaucgucagcucguaugugugcucuggccuuguuggugacacuccucgaaagaaugauuccucaaguagcucccacuguuugaacccaaauaacgaggaagggggacauggcgugaaaggcugggccuucgacgaugggaaugacgucuggaugggaagaacaaucucugagaagcugaggagcgguuacgagaccuuuaaagugauuggcggguggucaaagcccaacaguaaacuacagaucaaucggcagguaauuguugaucguggaaaccgcuccggcuauagcgguauauucucuguggaagggaagucaugcaucaauagauguuuuuacgucgagcucauuaggggccggaagcaggaaacggaggugugguggaccaguaacagcaucgucguguucugcggaacauccggcacuuaugggaccggaucuuggccugacggugcggauaucaaucugaugccaauuuga

SEQ ID NO: 144125 - RNA, 1410 nt, Artificial Sequence
  derived and/or modified sequence opt3 from neuraminidase__InfluenzaA__AFH00464
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaaaaaucgacauucgaacgauaccgugcacgaccguacaccauauagaacucuucugaugaaugaauugggcguucccuuucaucucgguaccaaacagguguguaucgccuggucaagcaguuccugccacgaugggaaggcauggcugcaugucugugugacaggacacgacgagaacgccaccgcuucuuucauuuacggcggcaggcugguagauagcaucggguccuggucaaagaaaauccuccggacgcaggaaagugagugcguuuguauuaauggaacuugcacaguggucaugaccgacgguagcgcaucuggccgcgccgauacuaagauauuauuuaucgaggaagggaagauugugcacaucuccccucugucaggaagcgcucaacauguggaggaaugcaguuguuauccaagauacccgggcgucaggugcguuugucgggacaacuggaaagguucuaaucgccccauaguggauauuaacguaaaggacuacuccaucgugagcucguaugucugcucugggcuugugggagauacaccucggaaaaacgacuccucaaguagcuccuacuguuugaauccaaacaaugaggaaggcggccacgggguuaagggaugggccuucgacgaugguaacgacguguggaugggcagaaccaucucugagaaacugaggagcggguaugagacguuuaaggucauuggaggcuggucaaaacccaauaguaagcuacagaucaaccgacaggugauuguagaucgugguaaucgcuccggguacagcggcauauucucuguugaaggaaagucaugcaucaacagauguuuuuauguggagcucauuaggggccggaaacaggaaaccgaggucugguggacaaguaauagcaucguggucuucugcgggacuuccggaaccuacgguacaggcucuuggccugacggggcggauaucaaccugaugccaauuuga

SEQ ID NO: 144126 - RNA, 1410 nt, Artificial Sequence
  derived and/or modified sequence opt3 from neuraminidase__InfluenzaA__AFH00475
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuuguaauccugacaagugcuaccaauucgcucucggccaggggacgacucugaacaaucgacauucgaacgauaccgugcacgaccguacaccauauagaacucuucugaugaaugaauugggaguucccuuucaucucggcaccaaacagguguguaucgccuggucaagcaguuccugccacgaugguaaggcauggcugcaugucugugugacagggcacgacgagaacgccaccgcuucuuucauuuacgauggaaggcugguagacagcaucggcuccuggaguaaaaagauccuccggacgcaggaaucagagugcguuuguauuaauggcacuugcacaguggucaugaccgaugggagcgcaucuggacgcgccgacacuaaaauauuauuuaucgaggaagguaagauugugcacaucuccccucugucaggcagcgcucaacauguggaggaaugcaguuguuauccaagauacccgggggucaggugcguuugucgggauaacuggaagggaucuaaccgccccauaguggacauuaauguaaaagauuacuccaucgugagcucguaugucugcucuggccuugugggugacacaccucgaaagaacgacuccucaaguagcucccacuguuugaauccaaacaaugaggaagggggacauggcguuaaaggcugggccuucgaugacgggaacgauguguggaugggaagaaccaucucugagaagcugaggagcgguuacgagacguuuaaagucauugaaggcuggucaaagcccaauaguaaacuacagaucaaccgucaggugauuguagaccgggggaaucgcuccggauauagcggcauauucucuguugaggguaagucaugcaucaacagauguuuuuacguggaacucauuagggggcggaagcaggagaccgaagucugguggacaaguaauagcaucguggucuucugcggcacuuccggaaccuauggcacagggucuuggccugauggagcggacaucaaccugaugccaauuuga

SEQ ID NO: 144127 - RNA, 1410 nt, Artificial Sequence
  derived and/or modified sequence opt3 from neuraminidase__InfluenzaA__AFH00486
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucggcuccuggaguaaaaagauccuccggacgcaggaaucagagugcguuuguauuaacggcacuugcacaguggucaugaccgacgggagcgcaucuggacgcgccgauacuaaaauauuauuuaucgaggaagguaagauugugcacaucuccccucugcuuggcucagcucaacauguggaggaaugcagcuguuauccaagauacccgggggucaggugcguuugucgggacaauuggaagggaaguaaccgccccauaguggauauuaacguaaaagacuacucuaucguguccagcuaugucugcucgggcuuggugggugacacaccucgaaagaaugauucuuccucaaguagccacugucugaacccaaauaacgaggaagggggacauggcguuaaaggcugggccuucgacgaugggaaugacguguggaugggaagaaccaucuccgagaagcuaaggucugguuacgagacguuuaaagucauugaaggcuggagcaagcccaacucaaaacuccagaucaaucgucaggugauuguagaucgggggaaccgcaguggauauuccggcauauucagcguugaggguaagucuugcaucaauagauguuuuuacguggaacugauuagggggcggaagcaggagaccgaagucugguggacaucaaacaguaucguggucuucugcggcacuagcggaaccuauggcacaggguccuggccugacggagcggauaucaaucuuaugccaauuuga

SEQ ID NO: 144128 - RNA, 1410 nt, Artificial Sequence
  derived and/or modified sequence opt3 from neuraminidase__InfluenzaA__AFH00497
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucaagaaagagauuugucccaagcuggcagaauacaggaauuggucaaaaccucagugcaagaucacaggguucgccccauuuaguaaggacaacagcauacggcuauccgcgggaggugauauuugggugacccgcgagcccuaugucucuugugacccuggcaaaugcuaccaauucgcucucgggcagggaacgacucugaauaaccgacauucgaaugauaccgugcacgaccguacaccauauagaacucuucugaugaacgaguugggcguucccuuucaucucgguaccaaacagguguguaucgccuggucaagcaguuccugccacgaugggaaggcauggcugcaugucugugugacaggacacgacgaaaaugccaccgcuucuuucauuuacgauggcaggcugguagacagcaucggcuccuggucaaagaacauccuccggacgcaggagagugaaugcguuuguauuaaugggacuugcacaguggucaugaccgauggaagcgcaucugagcgcgccgacacuaaaauauuauuuaucgaggaagguaagauugugcacaucuccccucugucaggcagcgcucaacauguggaggaaugcaguuguuauccaagauacccgggggucaggugcguuugucgggauaacuggaagggaucuaaccgccccauaguggacauuaauguaaaagauuacuccaucgugagcucguaugucugcucuggccuugugggugacacaccucgaaagaacgacuccucaaguagcuccuacuguuggaauccaaacaaugagaaagggggacacggcguuaagggcugggccuucgaugacgggaacgauguguggaugggaagaaccaucucugaagaguugaggagcgguuaugagacguuuaaagucauuggcggguggucaaagcccaauaguaaacugcagaucaaccgucaggugauuguagaccggggaaaucgcuccggcuacagcgguauauucucuguugaagggaagucaugcaucaacagauguuuuuauguggagcuaauuaggggccggaagcaggaaaccgaggucugguggacaaguaauagcaucguggucuucugcggaacuuccggcaccuacgggacaggaucuuggccugauggugcggacaucaaccucaugccaauuuga

SEQ ID NO: 144129 - RNA, 1410 nt, Artificial Sequence
  derived and/or modified sequence opt3 from neuraminidase__InfluenzaA__AFH00508
augaaccccaaucagaagaucauuaccauaggcagcgugucccugacaaucgccacuauuugcuuccucaugcaaaucgcuauucuugucaucacgguuacccugcacuuuaaacaguacgaguguaacucuccuccaaauaaccaggugauguugugcgaaccgacaauaaucgagagaaauauuacugaaaucguauauuuaaccaacacaaccauugagaaggaaaucugucccaaacuggcagaguacaggaauuggucaaagccucagugcaaaauaacuggguucgccccauuuaguaaggacaacagcauucggcuauccgcgggaggugauaucugggugacacgcgagcccuaugucucuugugacccuggcaagugcuaccaauucgcucucgggcagggaaccacgcugaauaaccgacauucgaaugauacugugcacgaccguaccccauauagaacacuucugaugaacgaauugggcguucccuuucaucucgguacuaaacagguguguauugccuggucaagcaguuccugccacgaugggaaggcauggcugcaugucugugugaccggacacaaugagaacgccacagcuucuuucaucuacgacggcaggcugguagauagcaucggcuccuggaguaaaaauauucuccggacccaggaaucagagugcguuuguauaaacgggacgugcacuguggucaugacagacggaagcgcaucuggucgcgccgauaccaagaucuuauuuauugaggaaggcaaaaucgugcacauauccccucugucagggagcgcucaacauguggaggaaugcaguuguuauccaagauacccgggagucaggugcguuugucgggacaacuggaagggcucuaaucgccccauuguggauaucaacguaaaggacuacuccaucgugagcucguaugucugcucuggucuugugggggauacuccucgaaagaaugacuccucaaguagcucccacuguuugaacccaaauaacgaggaaggaggccauggcguuaaagggugggccuucgacgauggaaaugacguguggauggguagaacaauuucugagaaacugaggagcggcuacgagaccuuucgggucaucgggggauggucaaagcccaacaguaaacuacagauuaaucgucaggugauaguagaucgcggcaacagauccgguuauagcgggaucuucucuguugaaggcaagucaugcauuaauagguguuuuuacguggagcucauccggggacgaaaacaggaaacggaggucugguggaccaguaacagcaucguggucuucugcggcacauccgggacuuauggaaccgguucuuggccugacggcgcggauauuaaucugaugccaauauga

SEQ ID NO: 144130 - RNA, 1410 nt, Artificial Sequence
  derived and/or modified sequence opt3 from neuraminidase__InfluenzaA__AFH00519
augaaccccaaucagaagaucauuaccauaggcagcgugucccugacaaucgccacuaugugcuuccucaugcagauugcuauccuugucacgaccguuacacugcacuuuaaacaguacgaguguaacucuccuccaaauaaccaggugauguugugcgaaccgacuauuaucgagagaaauauaaccgaaaucguauauuuaacaaacaccacuauugagaaggaaaucugucccaaacuggcagaguacaggaauuggucaaagccucagugcaaaauuacaggguucgccccauuuaguaaggacaacagcauccggcuauccgcgggaggugauauaugggugacccgcgagcccuaugucucuugugacccuggcaagugcuaccaauucgcucucgggcagggaacgacucugaauaacggccauucgaaugauaccgugcacgaccgaacaccauaucguacucuucugaugaacgaauuggguguucccuuucaucucgggaccaaacagguguguauugccuggucaagcaguuccugccacgauggaaaggcauggcugcaugucugugugacaggccacgacgagaaugccaccgcuucuuucaucuacgauggcagacugguagacagcauuggguccuggaguaaaaacauccucaggacgcaggaaucagagugcguuuguaucaauggaacuugcacaguggucaugaccgaugguagcgcaucuggccgggccgacacuaagauuuuauuuauagaggaagggaaaaucgugcacauuuccccucugucaggaagcgcucaacauguggaggaaugcaguuguuauccacgcuacccgggcgucagaugcguuuguagggauaacuggaaggguucuaaccggcccaucguggacauaaauguaaaggauuacuccauugugagcucguaugucugcucugggcuugugggagacacaccucgcaaaaacgacuccucaaguagcucccacuguuugaauccaaacaaugaggaaggcggccaugggguuaagggaugggccuucgaugacgguaacgauguguggaugggccgaaccaucucugagaaacugagaagcggguacgagacguuuaaggucaucggaggcuggucaaaacccaauaguaagcuacagauuaacaggcaagugaucguagaccgggguaaucguuccggguauagcggcauuuucucuguugaaggaaaaucaugcauaaaccgcuguuuuuacguggagcucaucagaggcaggaagcaggaaaccgaggucugguggacaaguaauagcauuguggucuucugcgggacuuccggaaccuaugguacaggcucuuggccugauggggcggacaucaaccugaugccaaucuga

SEQ ID NO: 144131 - RNA, 1410 nt, Artificial Sequence; identical to SEQ ID NO: 136589
  derived and/or modified sequence opt3 from neuraminidase__InfluenzaA__AFH00530

SEQ ID NO: 144132 - RNA, 1410 nt, Artificial Sequence; identical to SEQ ID NO: 136589
  derived and/or modified sequence opt3 from neuraminidase__InfluenzaA__AFH00541

SEQ ID NO: 144133 - RNA, 1410 nt, Artificial Sequence
  derived and/or modified sequence opt3 from neuraminidase__InfluenzaA__AFH00552
augaaccccaaucagaagaucauuaccauaggcagcgugucccugacaaucgccacuauuugcuuccucaugcaaaucgcuauucuugucacgaccguuacacugcacuuuaaacaguacgaguguaacucuuugccuaauaaccaggugauguuaugcgaaccaacuaucauagagagaaauaucaccgaaauuguauaucugacaaacaccacuaucgagaaggaaauuuguccgaaacuagcagaguacaggaauuggucaaagccccagugcaaaaucacaggguucgccccuuuuaguaaggacaacagcauacggcucuccgcgggaggugauauuugggugacccgcgagccauaugucucuugugaccccgauaagugcuaccaauucgcucugggccaggggacgacucuuaauaaccgacauucgaaugacaccgugcacgaucguacaccuuauagaacucuguugaugaacgaacucggaguuccauuucaucugggcaccaaacagguguguaucgccuggucaagcaguuccugccacgacgguaaggcauggcugcaugucugugugacagggcacgaugagaaugccaccgcuucuuucauuuacgacggaaggcucguagauagcaucggcuccuggaguaaaaagaucuuacggacgcaggaaagugagugcguuuguauuaacggcacuugcacaguggucaugaccgacgggagcgcaucuggacgcgccgauacuaaaauacuguuuaucgaggaagguaagauuauccacauaucccaacuuucaggcagcacacagcauguggaggaaugcaguuguuaucccagauacccuggggugaggugcgucugucgggacaauuggaagggaucuaaccgcccaauuguugauaucaacgugaaagacuacuccaucguaagcucguaugugugcucuggcuuggucggugacaccccgcgaaagaaugauuccucaaguagcucccacugucugaaccccaauaacgaggaagggggacauggcgugaaaggcugggcuuucgacgaugggaaugacguuuggaugggaagaacgauuucugagaaguuuaggagcgguuacgagaccuucaaagugaucgaaggcuggucaaagccuaacaguaaacuacagauuaaucggcaggucauaguggaucgugacaaccgcuccggguauagcggaaucuuuucuguagagggcaagucaugcauuaauagauguuucuacguugaacucaucaggggucggaagcaagagacagaagugugguggacuucaaacagcaucgucguguuuugcgggaccuccggcacauauggaacuggcucuuggccagauggggccgacauuaaucugaugcccauauga

SEQ ID NO: 144134 - RNA, 1410 nt, Artificial Sequence
  derived and/or modified sequence opt3 from neuraminidase__InfluenzaA__AFH00563
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaacgaacaccauaucguacucuucugaugaaugaguugggcguucccuuucaucucgguaccaaacagguguguaucgccuggucaagcaguuccugccacgaugggaaggcauggcugcaugucugugugacaggagacgaugaaaacgccaccgcuucuuucauuuacaauggcagacugguagacagcaucggcuccuggucaaagaaaauccucaggacgcaggagagugagugcguuuguauuaacgggacuugcacaguggucaugaccgauggaagcgcaucugguaaggccgacacuaaaauauuauuuaucgaagagggcaagauugugcacacauccccucugucagggagcgcucaacacguggaagagugcaguuguuauccacgguacccgggaguccgcugcguuuguagagauaacuggaagggcucuaauaggcccaucguggacauaaacguaaaagauuacuccauugugagcucguaugucugcucuggucuugugggggacaccccucggaagaaugacuccucaaguagcucccauuguuuggauccaaacaaugaagagggaggccacggcguuaaagggugggccuucgacgauggaaacgacguguggaugggucgcacgaucucugagaagcugcgaagcggcuacgaaaccuuuaaagucaucgagggguggucaaagcccaauaguaaacuacagauuaacagacaggugaucguagauaggggaaaucgguccggcuauagcgguauuuucucuguugaagggaagucaugcauaaaccguuguuuuuacguggagcucauccgcggcagaaagcaggaaacagagguccuguggaccaguaauagcauuguggucuucugcggaacuuccggcacauaugggacuggaucuuggccugacggugcggauaucaaccuuaugccaaucuga

SEQ ID NO: 144135 - RNA, 1410 nt, Artificial Sequence
  derived and/or modified sequence opt3 from neuraminidase__InfluenzaA__AFH00574
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgaagaucauagagagaaauaucacugaaauuguauauuuaaacaauaccacaaucgagaaagaaauuugucccaagcuggcagaguacaggaacuggucaaaaccucagugcaauaucaccggguucgccccauuuaguaaggacaacagcauacggcuauccgcgggaggugauauuugggugacucgcgagcccuaugucucuugugacccugauaagugcuaccaauucgcucucggccaggggacaacccugaauaacggacauucgaaugacacggugcacgaucgaacuccauaucguacccuucugaugaacgaauugggcguucccuuucaucucgguacaaaacagguguguaucgccuggucaagcaguuccugccacgacgggaaggcauggcugcaugucugugugacuggagaugacgagaaugccaccgcuucuuucauuuacaacggcagacugguagauagcaucggcuccuggaguaaaaagauccucaggacacaggaaucagagugcguuuguauuaacgggaccugcacgguggucaugacugacggaagcgcaucugguaaagccgauacaaagauauuauuuaucgaggaaggcaagauugugcacaccucccugcuuucagggagcgcucaacacguggaggaaugcaguuguuauccucgguacccaggaguccgcugcguuuguagagacaauuggaaaggcucuaacaggccgaucguggauauaaauguaaaggacuacuccauugugagcucguaugucugcucugguuuggugggggacacuccccggaaaaacgauuccucaaguagcucccauugucuggacccuaauaacgaggaaggaggccacggcguuaaggggugggccuucgaugacggaaaugauguguggaugggucgcacaaucucugagaaacuacgaagcggcuacgagaccuuuaaggucaucgaaggguggucaaaaccaaacaguaagcuccagauuaauagacaggugaucguagacaggggaaaccgguccggcuauagcgguauuuucucuguugaggggaagucaugcauaaaucguuguuuuuacguggaacugauccgcggcagaaaacaggagacggaaguccuuuggaccaguaacagcauuguggucuucugcggaacauccggcacuuaugggaccggaucuuggcccgauggugcggacaucaaucugaugccuaucuga

SEQ ID NO: 144136 - RNA, 1410 nt, Artificial Sequence
  derived and/or modified sequence opt3 from neuraminidase__InfluenzaA__AFH00585
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucaagaaagagauuugucccaagcuggcagaauacaggaauuggucaaaaccucagugcaacaucacaggguucgccccauuuaguaaggacaauagcauacggcuauccgcgggaggugauauuugggugacccgcgagcccuaugucucuugugacccugauaagugcuaccaauucgcucucggccaggggacgacucugaacaaucgacauucgaacgacaaagugcacgaucguaccccauauagaacacuucugaugaaugaguugggaguucccuuucaucucggcacuaaacagguguguaucgccuggucaagcaguuccugccacgacgguaaggcauggcugcaugucugugugaccggggaugacgaaaacgccacagcuucuuucauuuacaauggaaggcugguagauagcaucggcuccuggucaaagaaaauccuccggacccaggagagugaaugcguuuguauuaacggcacgugcacuguggucaugacagacgggagcgcaucuggaaaggccgauaccaagauauuauuuaucaaagaggguaagauugugcacacuuccucacugagcggcagugcucaacacguggaggaaugcucuuguuauccucgcuacccaggggucagaugcguuuguagggacaacuggaaaggauccaaucggccgaucguggauauaaacguaaaggacuacagcauugugucgucuuaugucugcuccggccuugugggugacacaccccgcaaaaaugauucaaguagcuccucucauuguuuggacccuaacaaugaggaagggggacacggcguuaagggcugggccuucgaugacgggaacgauguguggaugggacgaaccaucagcgagaaacugagaucagguuacgaaacguuuaaggucaucgagggcuggaguaaggcaaauuccaaacuacagauuaacaggcaagugaucguagaccgggggaaucguagcggauauucuggcauuuucucaguugagaguaagagcugcauaaaccgcuguuuuuacguggaacucaucagagguaggaaacaggagaccgaaguccuguggacauccaauucuauuguggucuucugcgggacuucgggcaccuauggaacaggcagcuggccagauggggcggacaucaaccuuaugcccaucuga

SEQ ID NO: 144137 - RNA, 1410 nt, Artificial Sequence; identical to SEQ ID NO: 136724
  derived and/or modified sequence opt3 from neuraminidase__InfluenzaA__AFH00596

SEQ ID NO: 144138 - RNA, 1410 nt, Artificial Sequence
  derived and/or modified sequence opt3 from neuraminidase__InfluenzaA__AFH00607
augaaccccaaucagaagaucauuaccauaggcuucguguuuuucacaaucgccacuauuugcuuucugaugcagaucgcuauucucgucacgaccguuacacuucacuucaaacaguacgaguguaacccuccaccgaauaaccaggugaugcugugcgaacccacuaucauagagagaaauaucaccgaaauuguauauuugacaaacaccacuaucgagaaggaaauuuguccuaaauuagcagaguacaggaauuggagcaagccacagugcaacaucacaggguuugcccccuucuccaaagacaauucuauacggcugucagcgggaggugauauuugggugacccgcgagccuuaugucaguugugacccagauaagugcuaccaauuugcucuaggccaggggacgacucucaacaauggacauagcaacgacaccgugcacgaucgaacacccuaucguacucugcuuaugaaugaacugggcguuccuuuccauuuggguaccagacagguguguaucgccugguccucuucgucaugccacgacgggaaggcauggcuccaugucugugugacaggagaugacgagaacgccaccgcuagcuuuauuuacaauggcaggcugguagauaguaucggcuccuggucuaaaaagauccugcggacgcaggaaagcgagugcguuuguauuaacgggacuugcacaguggucaugaccgacggauccgcaucagguaaagccgauacuaagauacucuucaucgaggaaggcaaaauugugcacaucaguacauuaagcgggucugcucaacacguggaggaaugcuccuguuauccacgcuacccgggagucagaugcguuuguagggacaacuggaagggcucaaaucggcccauaguggauauuaacguaaaggacuacagcaucgugaguucuuaugucugcuccggucuggugggggacaccccucgcaaaaaugauagcuuuucgucuucccauugucuugacccaaacaaugaggaaggaggccacggcguuaaggggugggccuucgaugacggaaacgauguguggaugggucgaacgaucucagagaaauugagaaguggcuacgagaccuuuaaggucauugaaggguggagcaaacccaauuccaagcugcagacaaacaggcaagugaucguagagcggggaaaucguucuggcuauagcgguauuuucucaguugaagggaaaaguugcauaaaccgcuguuucuacguggagcuaaucagaggcaggaaggaagagacugaggucugguggaccuccaauagcauuguggucuuuugcggaacaucuggcacuuaugggaccggaucauggccugacggugcggauaucaaccucaugccaaucuga

SEQ ID NO: 144139 - RNA, 1410 nt, Artificial Sequence; identical to SEQ ID NO: 137945
  derived and/or modified sequence opt3 from neuraminidase__InfluenzaA__AFH00618

SEQ ID NO: 144140 - RNA, 1410 nt, Artificial Sequence
  derived and/or modified sequence opt3 from neuraminidase__InfluenzaA__AFH00629
augaaccccaaucagaagaucauuaccauaggcagcgugucccugacaaucgccacuauuugcuuccucaugcaaaucacgauucuugucaccacaguuacucugcacuuuaaacaguacgaguguaacucuccuccaaauaaccaggugauguugugcgaaccgaccaucauagagagaaauaucacagaaauuguauauuuaaccaacacuacaaucgagaaggggauuugucccaaacuggcugaauacaggaauuggucaaagccucagugcaacaucaccggauucgcaccauuuaguaaagacaauagcauacggcuauccgccgguggcgauauuugggugacgcgcgagcccuaugucucuugugacccugauaagugcuaccaauucgcgcucgggcagggaacuacccugaacaauggccauucgaacgacacagugcacgaucgaacuccauaucguacccuucugaugaaugaguuggguguucccuuucaucucgggacaagacagguguguaucgcuuggucaagcaguuccugccacgacggaaaggccuggcugcaugucugugugaccggcgaugacaaaaacgcaacggccucuuucauuuacaauggcaggcugguagauagcaucggguccuggucaaagaaaauccuccggacucaggaaagugagugcguuuguauuaacggaacaugcaccguggucaugacugacgguagcgcuucuggcaaggcagauacaaaaauauuauuuaucgaagaggggaagauuauccacauauccacccugcuuggaucagcccaacacguggaggaaugcagcuguuauccucgcuacccaggcgugagaugcgucuguagggacaacuggaaggguaguaaucggccgauuguugauaucaacgugaaagacuacucuaucguauccagcuaugugugcucgggguuggucggagacacgccccgcaagaaugauucuuccucaaguagccauugucuggacccuaacaaugaggaaggcggccacggggugaaaggaugggcuuucgaugacgguaacgauguuuggaugggccgaaccauuuccgagaagcuaagaucuggguacgaaacauuuaaagugaucgagggauggagcaagccaaauucaaaacuccagauuaacaggcaggucauaguggagcggggcaaucguagugguuauuccgggaucuucagcguagaaggcaagucuugcauuaaccgcuguuuuuacguugagcugaucagaggaaggaaggaagagacugaagugugguggaccucaaauaguaucgucguguucugcggcacaagcgggacuuauggaaccgguuccuggcccgacggcgccgauauuaaccuuaugccuauauga

SEQ ID NO: 144141 - RNA, 1410 nt, Artificial Sequence; identical to SEQ ID NO: 136343
  derived and/or modified sequence opt3 from neuraminidase__InfluenzaA__AFH00640

SEQ ID NO: 144142 - RNA, 1410 nt, Artificial Sequence; identical to SEQ ID NO: 138472
  derived and/or modified sequence opt3 from neuraminidase__InfluenzaA__AFH00651

SEQ ID NO: 144143 - RNA, 1410 nt, Artificial Sequence; identical to SEQ ID NO: 136343
  derived and/or modified sequence opt3 from neuraminidase__InfluenzaA__AFH00662

SEQ ID NO: 144144 - RNA, 1410 nt, Artificial Sequence
  derived and/or modified sequence opt3 from neuraminidase__InfluenzaA__AFH00673
augaaccccaaucagaagaucauuaccauaggcagcgugucccugacaaucucuacuauuugcuucuuuaugcaaaucgccauucucaucacgaccgucacacuucacuucaaacaguacgaguuuucaaguccuccaaacaaucagguuaugcugugugaaccgacuauaaucgagagaaacauuaccgaaaucguguauuugacaaauaccacuauugagaaggaaacaugccccaaauuagcugaguacaggaacuggagcaagccucagugugacaucaccggguucgcaccauuuuccaaagauaauucuauacggcugucggccggaggugacauuuggguaacgcgcgagcccuaugugucaugcgauccugacaaguguuaccaauucgcgcuaggccaggggacuacccucaacaauguccauagcaacgauacagugcacgaccgaacuccauaucguacccugcuuaugaaugaacugggaguucccuuucauuugggcacaaaacaggugugcaucgcuuggaguuccucuagcugucacgaugguaaggccuggcuccaugucugcgugaccggggacgauaagaacgcaacggccuccuucauuuacaauggaagacugguagacucaaucguuaguuggagcaaagagauccugaggacucaggaaucugagugugugugcauuaacggcacauguaccgucgugaugacugauggcuccgcuucagggaaggcagacacaaaaauacucuuuaucgaggaaggaaagauugugcacaccagcacguuaagugguucugcccaacacgucgaggaaugcuccugcuauccucgguacccaggcguucgcugugugugcagagauaauuggaaggggagcaacaggccgaucguagacauaaacauuaaagacuacucgaucgugucucgguaugucuguuccggacuggugggcgauacaccccgcaagaaugacucaaguagcuccucucauugccuugauccuaacaaugaggaaggugggcacggaguuaaaggcugggcuuucgacgauggcaacgacguguggauggggcgaaccaucagcgucaagucaagaaguggauacgagacuuuuaaagugauugaggguugguccaauccaaacagcaaguugcagaucaauaggcagguaauuguugaucggggcaaccguucuggguauucaggaauauucaguguggaaggcaaaagcuguaucaaucgcugcuuuuacgucgagcugauuagagguaggaaggaagagaccgaagugcuauggacauccaacucuaucgucguguucugugggacuucgggcaccuauggaacaggcagcuggcccgacggggccgauaucaaucucaugccuauuuga

SEQ ID NO: 144145 - RNA, 1410 nt, Artificial Sequence
  derived and/or modified sequence opt3 from neuraminidase__InfluenzaA__AFH00684
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaacguacaccauauagaacucugcuuaugaaugagcugggaguucccuuucacuugggcaccaaacaggugugcauugcuuggagcaguuccucuugucaugaugguaaggccuggcuccacgucugcaucacaggggacgauaagaacgcaaccgccagcuucaucuacaauggaaggcugguggacuccauuguaucauggaguaaagaaauacugcggacgcaggagagcgaguguguuugcaucaacggcacuuguacaguggucaugaccgauggcucugcuuccgggaaggcagacacuaaaauucucuuuaucgaagagggaaagauagugcauacaucaaccuuaagcgguagugcccaacacguggaagagugcucuugcuauccucgcuacccaggcgucagauguguuugcagggauaacuggaagggguccaaucggccgauuguggacaucaacaucaaagaucacagcauuguaucgucuuacguguguuccggacuggucggcgacacgccccgcaagaaugacucaaguagcuccucucauugccuugauccuaacaaugaagagggugggcacggagugaaaggcugggcuuucgacgauggcaacgacguuuggauggggcgaaccaucagcgagaagucaagauugggauaugaaacauuuaaagugauugaggguuggaguaauccaaaguccaaacugcagauaaacaggcaggucaucguggaucggggcaaucguagcggguacucuggaauuuucucaguagaaggcaagaguuguaucaaccgcugcuuuuauguugagcuaaucagagguaggaaggaagagacugaggugcucuggaccagcaauuccauugucguguucugugggacaucuggcacuuacggaaccggcucguggcccgacggggccgauauaaaccugaugccuaucuga

SEQ ID NO: 144146 - RNA, 1410 nt, Artificial Sequence
  derived and/or modified sequence opt3 from neuraminidase__InfluenzaA__AFH00695
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaacguacaccauauagaacucugcuuaugaacgagcugggaguucccuuucacuugggcaccaaacaggugugcauugcuuggagcaguuccucuugucaugacgguaaggccuggcuccacgucugcaucacaggggaugacaagaaugcaaccgccagcuucaucuacaacggaaggcugguggauuccauuguaucauggaguaaagaaauacugcggacgcaggagagcgaguguguuugcaucaauggcacuuguacaguggucaugaccgacggcucugcuuccgggaaggcagauacuaaaauucucuuuaucgaagagggaaagauagugcauacaucaaccuuaagcgguagugcccaacacguggaagagugcucuugcuauccucgcuacccaggcgucagauguguuugcagggacaacuggaagggguccaaccggccgauuguggauaucaauaucaaagaccacagcauuguaucgucuuacguguguuccggacuggucggcgacacgccccgcaagaacgauucaaguagcuccucucauugccuugacccuaauaacgaagagggugggcacggagugaaaggcugggcuuucgaugacggcaaugauguuuggauggggcgaaccaucagcgagaagucaagauugggauaugaaacauuuaaagugauugaggguuggaguaacccaaaguccaaacugcagauaaauaggcaggucaucguggaccggggcaaccguagcggguacucuggaauuuucucaguagaaggcaagaguuguaucaaucgcugcuuuuauguugagcuaaucagagguaggaaggaagagacugaggugcucuggaccagcaacuccauugucguguucugugggacaucuggcacuuacggaaccggcucguggcccgauggggccgacauaaaucugaugccuaucuga

SEQ ID NO: 144147 - RNA, 1410 nt, Artificial Sequence
  derived and/or modified sequence opt3 from neuraminidase__InfluenzaA__AFH00706
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaacggcacuuguacagucgugaugaccgauggcucugcuuccgggaaggcagacacuaaaauccucuuuauugaggaaggaaagaucgugcauacaucaaccuuaagcgguagugcccaacacgucgaggaaugcucuugcuauccucgcuacccaggcguuagaugugugugcagggauaauuggaagggguccaaccggccgauaguagacauuaauaugaaagaucacagcaucgugucgucuuacgucuguuccggacuggugggcgacacgccccgcaagaacgacucaaguagcuccucucauugcuucgauccuaauaacgaggaaggugggcacggaguuaaaggcugggcuuuugacgauggcaaugacguguggauggggcgaaccaucagcgagaagucaagacuuggauaugagacauucaaagucauugaagguuggaguaacccaaaguccaaauugcagaucaauaggcaagugauuguagaucggggcgaccguagcggguacucuggaauauuuucaguugagggcaagaguuguaucaaccgcugcuucuauguggaacugauuagagguagcaaggaggaaacugagguccuauggaccuccaauucuaucguggucuucugugggacaucgggcacuuacggaaccggcagcuggcccgauggggccgacaucaaccucaugccuauuuga

SEQ ID NO: 144148 - RNA, 1410 nt, Artificial Sequence
  derived and/or modified sequence opt3 from neuraminidase__InfluenzaA__AFH00728
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccaucauaaucgagagaaacauuacugaaaucguauauuugaccaauacaaccauugagaaggaaaucuguccuaaauuaguggaguacaggaacuggaguaagccacagugcaaaauaacuggguucgcacccuuuagcaaggacaauuccauucggcugucugccggaggugauaucugggucacacgcgagccuuaugugucgugugacccaggcaagugcuaccaauucgcgcuagggcagggaaccacgcucaacaauaaacauucaaacgauacuauucacgaccgaacccccuaucguacacugcuuaugaaugaacugggcguuccuuuucauuuggguacuagacagguguguaucgcuuggagcaguuccucuugccacgaugggaaggccuggcuccaugucugugugaccggacacgacaaaaacgcaacagccagcuucaucuacaauggcaggcugguagauuccauuggcucauggaguaagaacauacugcggacccaggagagcgaaugcguuuguaucaaugggacgugcacuguggucaugacagacggaucugcuuccgagcgcgcagauaccaaaauucucuuuaucgaggaagguaagauagugcacauuucaccauuaagcggcagugcccaacauguggaggaaugcucuuguuauccgagauaccccggggucaggugcguuugucgggacaacuggaagggauccaaccgcccuaucguggauaucaauguaaaagacuacagcauugugucgucuuaugucugcuccggccuggugggugauacuccacgaaagaacgacagaucaaguagcuccuacuguaggaaucccaacaaugagaaagggaaccacggaguuaagggcugggcuuucgacgauggcaaugacguguggauggggcggacaaucggagaggaacuucguucugguuaugagaccuuuaaagucauuggcggguggagcacgccuaacucaaaguugcagauaaaucgccaggugaucguagauagugacaacagauccggauacagcggcauuuucucuguugaagguaaaucaugcaucaauagguguuuuuauguggagcugauccgggggcgagaacaggagacccgcguccuauggacaaguaacagcauuguggucuucugcggcacuuccggaaccuacggcacagggucuuggccagauggagccgacauaaaucucaugcccaucuga

SEQ ID NO: 144149 - RNA, 1410 nt, Artificial Sequence
  derived and/or modified sequence opt3 from neuraminidase__InfluenzaA__AFH00739
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccacuaucauagagagaaacaucaccgaaauuguauauuugacaaauaccacuaucgagaaggaaauuuguccuaaauuaguggaguacaggaacuggaguaagccacagugcaaaaucacaggguucgcacccuuuagcaaggacaauuccauacggcugucugccggaggugauauuugggucacccgcgagccuuaugugucgugugacccaggcaagugcuaccaauucgcgcuagggcagggaacgacucucaacaaucgacauucaaacgauaccguucacgaccguacacccuauagaacucugcuuaugaaugaacugggcgugccuuuucauuuggguaccaaacaggucuguaucgcuuggagcaguuccucuugccacgaugggaaggccuggcuccauguguguguaacaggacacgacaaaaacgcaaccgccagcuucauuuacgauggcaggcugguugacuccaucggcucauggaguaagaauauccugcggacgcaggagagcgaaugcguguguauuaacgggacuugcacagucgugaugaccgauggaucugcuuccgagcgcgcagacacuaaaauacucuuuaucgaggaagguaagauugugcacaucucaccauuaagcggcagugcccaacaugucgaggaaugcucuuguuauccgagauaccccgggguuaggugcgugugucgggauaauuggaagggauccaaccgcccuauaguagacauuaacgugaaagauuacagcaucgucucgucuuaugugugcuccggccugguuggugacacaccacgaaagaaugacagaucaaguagcuccuacuguaggaaccccaauaacgagaaagggucucacggagugaagggcugggcuuucgaugacggcaaugaugucuggauggggcggaccaucggagaggaacuucguagcgguuaugagacguuuaaagugauuggcggguggucaaccccuaacaguaaguugcagaucaaucgccagguaauuguugacuccggaaacagaagcggcuacucugguauauucucaguggaagggaaaaguugcaucaauagguguuuuuaugucgagcugauucggggccgaggacaggaaacacgcgugugguggacuagcaacuccaucgucguguucugcggcaccucugggacauacggaacugguucguggccagauggcgccgacaucaaucuaaugcccauuuga

SEQ ID NO: 144150 - RNA, 1410 nt, Artificial Sequence
  derived and/or modified sequence opt3 from neuraminidase__InfluenzaA__AFH00750
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccacuaucauagagagaaacaucaccgaaauuguauauuugacaaauaccacuaucgagaaggaaauuuguccuaaauuaguggaguacaggaacuggaguaagccacagugcaaaaucacaggguucgcacccuuuagcaaggacaauuccauacggcugucugccggaggugauauuugggucacccgcgagccuuaugugucgugugacccaggcaagugcuaccaauucgcgcuagggcagggaacgacucucaacaaucgacauucaaacgauaccguucacgaccguacacccuauagaacucugcuuaugaaugaacugggcgugccuuuucauuuggguaccaaacaggucuguaucgcuuggagcaguuccucuugccacgaugggaaggccuggcuccauguguguguaacaggacacgacaaaaacgcaaccgccagcuucauuuacgauggcaggcugguugacuccaucggcucauggaguaagaauauccugcggacgcaggagagcgaaugcguguguauuaacgggacuugcacagucgugaugaccgauggaucugcuuccgagcgcgcauauacuaaaauacucuuuaucaaggaggguaagauugugcacaucucaccauuaagcggcagugcccaacaugucgaagagugcucuuguuacccgagauaccccgggguuaggugcgugugucgggacaauuggaaaggauccaaccgcccuauaguagauauuaacgugaaggacuauagcaucgucucgucuuacgugugcuccggccugguuggugauacaccacgaaagaaugacagaucaaguagcuccuauuguaggaaccccaauaacgaaaaagggucucacggagugaaaggcugggcuuucgacgauggcaaugacgucuggauggggcggaccaucggagaggaacuucguagcgguuacgagacguuuaaggugauuggcggguggucaaccccuaacaguaaauugcagaucaaucgccagguaauuguugaguccggaaacagaagcggcuauucugguauauucucaguggaagggaagaguugcaucaauagguguuuuuacgucgagcugauucggggccgagaacaggagacacgcgugugguggacuagcaacuccaucgucguguucugcggaaccucuggcacauaugggacuggaucguggccagauggugccgacaucaaucuaaugcccauuuga

SEQ ID NO: 144151 - RNA, 1410 nt, Artificial Sequence
  derived and/or modified sequence opt3 from neuraminidase__InfluenzaA__AFH00761
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugaugccgugcgaacccacuaucauagagagaaauaucaccgaaauuguauauuugacaaacaccacuaucgagaaggaaauuuguccuaaauuaguggaguacaggaauuggucaaagccacagugcaaaaucacaggguucgcacccuuuaguaaggacaacagcauacggcuguccgccggaggugauauuugggucacccgcgagccuuaugugucuugugacccaggcaagugcuaccaauucgcgcuagggcagggaacgacucucaauaaccgacauucgaaugauaccguucacgaccguacacccuauagaacucugcuuaugaacgaacugggcgugccuuuucauuuggguaccaaacaggucuguaucgcuuggucaagcaguuccugccacgaugggaaggccuggcuccauguguguguaacaggacacgacgagaaugcaaccgccucuuucauuuacgauggcaggcugguugacagcaucggcuccuggaguaaaaacauccugcggacgcaggaaagugagugcguguguauuaaugggacuugcacagucgugaugaccgauggaagcgcuucugagcgcgcagacacuaagauacucuuuaucgaagaggguaaaauugugcacaucuccccauuaucaggcagcgcccaacaugucgaagagugcaguuguuauccgagauaccccgggguuaggugcgugugucgggauaacuggaagggaucuaaccgcccuauaguagacauuaaugugaaggauuacuccaucgucagcucguaugugugcucuggccugguuggugacacaccacgaaagaacgacuccucaaguagcuccuacuguagaaaucccaacaaugaaaaagggucucacggagugaaaggcugggcuuucgaugacggcgaugacgucuggauggggaggaccaucggagaggagcuucggagcgguuaugaaacguuuaaggugauuggcggguggucaaccccuaacaguaaauugcagaucaaucgucagguaauuguugaucgcggaaacagauccggcuacagcgguauauucucuguggaggggaagucaugcaucaauagguguuuuuaugucgaacugauucggggccgaaaacaggagacaaaggugugguggacuucaaacagcaucgucguguucugcggaaccuccggcacauacgggacuggaucuuggccagacggugccgauaucaaucuaaugcccauuuga

SEQ ID NO: 144152 - RNA, 1410 nt, Artificial Sequence
  derived and/or modified sequence opt3 from neuraminidase__InfluenzaA__AFH00783
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccgagggacgacucugaauaaccgucauucgaaugacaccgugcacgauagaacaccauauaggacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggacggcugguagauagcaucggcuccuggaguaaaaagauccuccgcacgcaggaaucagagugcguuuguauuaacggcacuugcacaguggucaugaccgacgggagcgcaucugguagagccgauacuaaaauauuauuuaucgaggaaggaaagauugugcacaucuccccucugucaggcagcgcucagcauguggaggaaugcaguuguuauccaagguacucugggguccggugcguuugucgcgacaauuggaagggauccaaccgaccgauaguggauauuaacguaaaagacuacagcaucgugucgucuuaugucugcuccggccuugugggugacacacccagaaagaaugauucaaguagcuccucucacuguuugaacccuaauaacgaggaagggggacauggcguuaaaggcugggccuucgacgaugggaaugacguguggaugggaaggaccaucagcgagaaguuucggucagguuacgagacguucaaagucauuggcggguggaguaagccaaacuccaaacugcaaaucaaucgucaggugauuguagaucgcggaaacagaagcggcuauucugguauauuuucaguugaagggaagaguugcaucaauagguguuucuacguggagcuaauucggggccgaaagcaggaaaccgaggucugguggacaagcaacuccaucguggucuuuugcggaacuucuggcaccuaugggacaggaucguggcccgacggugcggauaucaaucucaugccuauuuga

SEQ ID NO: 144153 - RNA, 1410 nt, Artificial Sequence
  derived and/or modified sequence opt3 from neuraminidase__InfluenzaA__AFH00794
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuagcggcuggaggugauauuugggugacccgcgagcccuaugucuccugugacccugauaagugcuaccaauucgcccucggccaggggacgacucugaauaaccgacauucuaaugacaccgugcacgaucguacaccauauagaacucuucugaugaacgaauugggaguucccuuucaucucggcaccaaacagguguguaucgcauggucgucaagcaguugccacgacgguaaggccuggcugcaugucugugugacagggcacgaugagaaugcuaccgcauccuucauuuacgacggaaggcugguagauucuaucggcagcugguccaaaaagauccuccggacgcaggaaucagagugcguuuguauuaacggcacuugcacaguggucaugaccgacgggagugccagcgagcgcgcugauacuaaaauauuauuuaucgaagagggaaagauugugcacaucucucaacuguccgguucagcccagcauguggaagagugcagcuguuauccuagauacccaggcgucaggugcguuugucgggacaauuggaaggggaguaaccgcccgauaguggauauuaacguaaaagacuacucuaucguguccagcuaugucugcucgggacuugugggcgacacaccccgaaagaaugauucuuccucaaguagccacuguuugaacccuaauaacgaagagggugggcauggaguuaaaggcugggcguucgacgauggcgacgauguguggauggggagaaccaucuccgagaagcugaggucuggauacgaaacguuuaaagucauugaggguuggagcaagccaaauucaaaacuacagaccaaccgucaggugaucguagaccggggcaaucgcaguggguauuccggaauuuucagcguugaaggcaagucuugcauaaacagauguuuuuacguggagcucaucaggggucggaagcaagaaacagaggucugguggacuucaaauaguauuguggucuucugcgggaccagcggcacauauggaacuggcuccuggcccgauggggcagacaucaaccugaugccuaucuga

SEQ ID NO: 144154 - RNA, 1410 nt, Artificial Sequence; identical to SEQ ID NO: 137504
  derived and/or modified sequence opt3 from neuraminidase__InfluenzaA__AFH00805

SEQ ID NO: 144155 - RNA, 1410 nt, Artificial Sequence; identical to SEQ ID NO: 141534
  derived and/or modified sequence opt3 from neuraminidase__InfluenzaA__AFH00816

SEQ ID NO: 144156 - RNA, 1410 nt, Artificial Sequence
  derived and/or modified sequence opt3 from neuraminidase__InfluenzaA__AFH00827
augaaccccaaucagaagaucauuaccauaggcagcgugucccugacaaucucuacuacgugcuucuuuaugcagauugccauccucauuaccacagucacucuucacuucaaacaguacgaguuuaacucaccuccaaauaaccagguuaugcugugugaaccgaccaucauagagagaaauaugacagaaaucguguauuugaccaacacuacaauugagaaggaaaucugccccaaaccugcugaguacaggaauuggaguaagccacagugugacauuaccggguucgcacccuuuagcaaagauaacuccauccgguuaucugccggaggugacauauggguaacgcgcgagccuuaugugucgugcgauccagacaaguguuaccaauucgcgcugggccaggggacuacccuaaauaacguccauucaaauaacacagugcgagaucguacucccuauagaacccuccugaugaaugaacuuggaguuccuuuucaccugggcacaaaacaggugugcauugcuuggagcaguuccucuugucaugacgguaaggccugguugcacgucugcaucaccggggaugacaagaacgcaacggccagcuucauuuacaauggaaggcucguggauuccguaguuucauggaguaaagagauccugcggacucaggaaagcgagugugugugcaucaacggcacauguaccgucgugaugacugacggcucugcuuccgggaaggcagauacaaaaauucuguuuauagaggaaggaaagaucgugcauaccucaacgcucagcgguagugcccaacacgucgaggaaugcucuugcuauccacgcuacccgggcguuagaugugugugcagggacaacuggaagggguccaaucggcccauuguagauaucaacauaaaagaccacagcauugugucgucuuacgucuguuccggauuagugggcgacaccccucgcaagaaugauucaaguagcuccucucauugccuggacccaaacaaugaggaaggugggcacggaguuaaaggcugggcuuucgaugacggcaacgauguguggauggggcgaacaaucaaugagacuagcagacuuggauaugagaccuuuaaggucaucgaagguuggucaaaccccaaaaguaaguugcagauuaauaggcaagugaucguagaccggggcgaucguuccggguacagcggaauuuucucuguugagggcaaaucauguauaaaccgcugcuuuuauguggaacugaucagagguaggaaggaggaaacagagguccuauggaccaguaauagcauuguggucuucugugggacuuccggcacauacggaaccggcucuuggccugacggggccgaucucaaccugaugccacuuuga

SEQ ID NO: 144157 - RNA, 1410 nt, Artificial Sequence; identical to SEQ ID NO: 137945
  derived and/or modified sequence opt3 from neuraminidase__InfluenzaA__AFH01410

SEQ ID NO: 144158 - RNA, 1410 nt, Artificial Sequence
  derived and/or modified sequence opt3 from neuraminidase__InfluenzaA__AFH34942
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgaagauaaucgagagaaauauuacugaaaucguguauuugaccaacacaaccauugagaaagaaaucugccccaagccugcugaguacaggaauuggaguaaaccacagugugacauaacuggguucgcacccuuuagcaaggauaacuccauucgguuaucugccggaggugacaucuggguaacacgcgagccuuaugugucgugcgauccagacaaguguuaccaauucgcgcugggccaggggaccacgcuaaauaacguccauucaaauaacacugugcgaaaucguacccccuauagaacacuccugaugaacgaacuuggaguuccuuuucaccugggcacuaaacaggugugcauugcuuggagcaguuccucuugucaugaugguaaggccugguugcacgucugcaucaccggggacgauaaaaaugcaacagccagcuucaucuacaacggaaagcucguggacuccguaguuucauggaguaaagagauucugaggacccaggaaagcgagugugugugcauaaacggcacguguacugucgugaugacagauggcucugcuuccgggaaggcagacaccaagauccuguuuauugaggaaggaaaaaucgugcauacuucaacacucagcgguagugcccaacacgucgaggaaugcucuugcuauccacgguacccgggcguucgcugugugugcagagauaauuggaagggguccaacaggcccauaguagacauuaauaucaaagaucacagcaucgugucgucuuacgucuguuccggauuagugggcgacaccccucggaagaacgacucaaguagcuccucucauugccuggauccaaauaacgaggaaggugggcacggaguuaaaggcugggcuuucgacgauggcaaugacguguggauggggcgcacgauuaacgagaccagccgacuuggauaugagacauuuaaggucaucgaagguuggucaaaucccaaaaguaaguugcagauuaacagacaggugauaguagauaggggcgaccgguccggguacagcggaaucuucucuguugagggcaagucauguauuaaucguugcuuuuauguggaacugauccgcgguagaaaagaggaaacugagguccuauggaccaguaacagcaucguggucuucugugggacauccggcacuuacggaaccggcucuuggccugauggggccgaccucaaucugaugccaauuuga

SEQ ID NO: 144159 - RNA, 1410 nt, Artificial Sequence
  derived and/or modified sequence opt3 from neuraminidase__InfluenzaA__AFH34956
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgaggacguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcagauuaauaggcaagugauaguagaucguggggaccgguccggauacagcggcaucuucucuguugaggguaaaucauguauuaaccgcugcuuuuauguggaacugaucagagggaggaaggaggaaaaugagguccuauggaccaguaacagcaucguggucuucuguggcacauccggaacuuacggcaccgggucuuggccugauggagccgaccucaaucugaugccaauuuga

SEQ ID NO: 144160 - RNA, 1410 nt, Artificial Sequence
  derived and/or modified sequence opt3 from neuraminidase__InfluenzaA__AFH34963
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacauugugcgagaucguacccccuauagaacacuccugaugaaugaacuuggaguuccuuuucaccugggcacuaaacaggugugcaucgcuuggagcaguuccucuugucaugacgguaaggccugguugcacgucugcaucaccggggaugacaagaacgcaacagccagcuucauuuacaauggaaggcucguggauuccguaguuucauggaguaaagagauacugcggacccaggaaagcgagugugugugcaucaacggcacguguacugucgugaugacagacggcucugcuuccgggaaggcagauaccaaaauucuguuuaucgaggaaggaaagauagugcauacuucaacacucagcgguagugcccaacacgucgaggaaugcucuugcuauccacgcuacccgggcguuagaugugugugcagggacaacuggaagggguccaaucggcccauuguagauaucaacaucaaagaccacagcauugugucgucuuacgucuguuccggauuagugggcgacaccccucgcaagaaugauucaaguagcuccucucauugccuggacccaaacaaugaggaaggugggcacggaguuaaaggcugggcuuucgaugacggcaacgauguguggauggggcgaacgaucaaugagaccagcagacuuggauaugagacauuuaaggucauugaagguuggucaaaccccaaaaguaaguugcagauaaauaggcaagugaucguagaccggggcgaucguuccggguacagcggaauuuucucuguugagggcaaaucauguaucaaccgcugcuuuuauguggaacugaucagagguaggaaggaggaaaaugagguccuauggaccaguaacagcauuguggucuucugugggacuuccggcacauacggaacuggcucuuggccugacggggccgaucucaaucugaugccaauauga

SEQ ID NO: 144161 - RNA, 1410 nt, Artificial Sequence
  derived and/or modified sequence opt3 from neuraminidase__InfluenzaA__AFH34970
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcuguaugaaccgacuauaaucgagagaaauauuaccgaaaucguguacuugacaaacaccacuauugagaaggaaaucugucccaaaccugcugaguauaggaauuggaguaagccacagugcgacauaacaggguucgcacccuuuagcaaagauaacuccauucgguuaucugccggaggugacaucuggguaacccgcgagccuuacgugucgugugauccagacaagugcuaucaauucgcgcugggccaggggacgacucuaaauaacguccauucaaauaacaccgugcgagaucguacacccuacagaacucuccugaugaaugaacuuggaguuccuuuucaccugggcaccaaacagguguguauugcuuggagcaguuccucuugccaugacgguaaggccugguugcacgucuguaucacaggggaugacaagaacgcaaccgccagcuucaucuauaauggaaggcucguggauuccguaguuucauggaguaaagagauucugcggacgcaggaaagcgagugcguguguauaaacggcacuugcacagucgugaugaccgacggcucugcuuccgggaaggcagauacuaaaauccuguuuauugaggaaggaaagaucgugcauacaucaacccucagcgguagugcccaacacgucgaggaauguucuugcuacccacgcuacccgggcguuagaugcguguguagggacaacuggaagggguccaaucggcccauaguagauauuaacaucaaagaccacagcaucgugucgucuuaugucugcuccggauuagugggcgacacgccucgcaagaaugauucaaguagcuccucucauugucuggacccaaacaaugaggaaggugggcacggaguuaaaggcugggcuuucgaugacggcaacgauguguggauggggcgaaccauuaaugagacaagcagacuuggauacgagacuuuuaaggucaucgaagguuggucaaaccccaaaaguaaguugcagauuaauaggcaagugauaguagaccggggcgaucguuccggguauagcggaaucuucucuguugagggcaaaucaugcauuaaccgcuguuuuuacguggaacugaucagagguaggaaggaggaaaaugagguccuauggaccaguaacagcaucguggucuucugcgggacauccggcacuuauggaaccggcucuuggccugacggggccgaucucaaucugaugccaauuuga

SEQ ID NO: 144162 - RNA, 1410 nt, Artificial Sequence
  derived and/or modified sequence opt3 from neuraminidase__InfluenzaA__AFH34977
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcagauuaauaggcaagugauaguagaucguggggaccgguccggauacagcggcaucuucucuguugaggguaaaucauguauuaaccgcugcuuuuauguggaacugaucagagggaggaaggaggaaaccgagguccuauggacaaguaauagcaucguggucuucuguggcacuuccggaaccuacggcacagggucuuggccugauggagccgaccucaaccugaugccaauuuga

SEQ ID NO: 144163 - RNA, 1410 nt, Artificial Sequence
  derived and/or modified sequence opt3 from neuraminidase__InfluenzaA__AFH74468
augaaccccaaucagaagaucauuaccauaggcagcgugucccugacaaucucuacuauuugcuucuuuaugcaaacggccauccucauuaccacagucacucuucacuucaaacagugugaguuuaacucaccuccaaauaaccagguuaugcugugcgaaccgaccaucauagagagaaauaucacagaaauuguguacuugaccaacacuacaaucgagaaggaaauuugucccaaauuagcugaguauaggaauuggaguaagccucagugcgacaucaccggguucgcaccauuuagcaaagauaacuccauacggcugucugccggaggugacauuuggguaacgcgcgagcccuacgugucgugugauccugacaagugcuaucaauucgcgcuaggccaggggacuacccucaauaacguccauucaaauaacacagugcgagaucguacuccauacagaacccugcuuaugaaugaacugggaguucccuuucacuugggcacaaaacagguguguaucgcuuggagcaguuccucuugccaugacgguaaggccuggcuccacgucuguauuaccggggaugacaagaacgcaacggccagcuucaucuauaauggaaggcugguggauuccguaguuucauggaguaaagagauccugcggacucaggaaagcgagugcguguguauuaacggcacaugcaccgucgugaugacugacggcucugcuuccgggaaggcagauacaaaaauacucuuuaucgaggaaggacgcauugugcauaccucaacguuaagcgguagugcccaacacgucgaggaaugcucuuguuacccuagauauccaggcguuaggugcgugugucgggacaacuggaagggguccaaucgcccgaucguagauauaaacauuaaggaccacagcaucgugucgucuuacgucugcuccggacuggugggcgacacaccccggaaaaaugauucaaguagcuccucucauugucuugacccuaacaaugaggaaggugauaacgggguuaagggaugggcuuucgacgauggcaaugacguguggaugggcagaaccaucagcgagaaaucaagguugggguacgagacuuuuaaggucauugaaggauggaguaacccaaaauccaagcugcagaucaaucgacaggugauuguagaucgugguaaccgcagcggcuauucugggauauucucaguugagggaaaaaguugcaucaauagauguuuuuacguggaacuaauuaggggccggaaggaggaaaccgagguccucuggacaagcaacuccaucguggucuucugcgguacuucugggaccuauggcacaggaucguggcccgacggcgccgauaucaaucugaugccuauuuga

SEQ ID NO: 144164 - RNA, 1410 nt, Artificial Sequence; identical to SEQ ID NO: 140667
  derived and/or modified sequence opt3 from neuraminidase__InfluenzaA__AFH74469

SEQ ID NO: 144165 - RNA, 1410 nt, Artificial Sequence; identical to SEQ ID NO: 138615
  derived and/or modified sequence opt3 from neuraminidase__InfluenzaA__AFH74480

SEQ ID NO: 144166 - RNA, 1410 nt, Artificial Sequence; identical to SEQ ID NO: 138615
  derived and/or modified sequence opt3 from neuraminidase__InfluenzaA__AFH74491

SEQ ID NO: 144167 - RNA, 1410 nt, Artificial Sequence; identical to SEQ ID NO: 143658
  derived and/or modified sequence opt3 from neuraminidase__InfluenzaA__AFH74502

SEQ ID NO: 144168 - RNA, 1410 nt, Artificial Sequence
  derived and/or modified sequence opt3 from neuraminidase__InfluenzaA__AFH74513
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaacaugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaauaacacagugcgagaucguacuccauauagaacccugcuuaugaaugaacugggaguucccuuucacuugggcacaaaacaggugugcaucgcuuggagcaguuccucuugucaugacgguaaggccuggcuccacgucugcauuaccggggaugacaagaacgcaacggccagcuucaucuacaauggaaggcugguggauuccguaguuucauggaguaaagagauccugcggacucaggaaagcgagugugugugcauuaacggcacauguaccgucgugaugacugacggcucugcuuccgggaaggcagauacaaaaauacucuuuaucgaggaaggaaagauugugcauaccucaacguuaagcgguagugcccaacacgucgaggaaugcucuugcuauccucgcuacccaggcguuagaugugugugcagggacaacuggaagggguccaaucggccgaucguagauauaaacauuaaagaccacagcaucgugucgucuuacgucuguuccggacuggugggcgacacccccaggaagaaugauucaaguagcuccucucauugccuugacccuaacaaugaggaaggugggcacggaguuaaaggcugggcuuucgaugacggcaacgauguguggauggggcgaacaaucagcgagaagucaagauugggauaugagacuuuuaaagucauugaagguuggaguaauccaaaguccaaacugcagaucaaccgccaggugauuguagaccggggcaaucguagcggguacucuggaauauucucaguugagggcaagaguuguaucaaccgcugcuuuuauguggaacuaauuagagguaggaaggaggaaaccgagguccucuggacaagcaauuccaucguggucuucugugggacuucuggcaccuacggaacaggcucguggcccgauggggccgacaucaaccugaugccuguguga

SEQ ID NO: 144169 - RNA, 1410 nt, Artificial Sequence
  derived and/or modified sequence opt3 from neuraminidase__InfluenzaA__AFH74524
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacuauuaauaacguccauucaaauaacaccgugcgagaucguacaccauauagaacucuccugaugaaugaacuuggaguucccuuucaccugggcaccaaacaggugugcaucgcuuggagcaguuccucuugucaugacgguaaggccugguugcacgucugcaucacaggggaugacaagaacgcaaccgccagcuucauuuacaauggaaggcucguggauuccguaguuucauggaguaaagagauacugcggacgcaggaaagcgagugugugugcaucaacggcacuuguacagucgugaugaccgacggcucugcuuccgggaaggcagauacuaaaauucuguuuaucgaggaaggaaagauagugcauacaucaacccucagcgguagugcccaacacgucgaggaaugcucuugcuauccucgcuacccaggcguuagaugugugugcagggacaacuggaagggguccaaucggccgauuguagauaucaacaugaaagaccacagcaucgugucgucuuacgucuguuccggauuagugggcgacacgccccgcaagaaugauucaaguagcuccucucauugccuggacccuaacaaugaggaaggugggcacggaguuaaaggcugggcuuucgaugacggcaacgauguguggauggggcgaaccauuagcgagaagucaagacuuggauaugagacauuuaaagucaucgaagguuggaguaauccaaaguccaaauugcagauuaacaggcaagugauaguagaccggggcaaucguagcggguacucuggaaucuucucaguugagggcaagaguuguauuaaccgcugcuuuuauguggaacugaucagagguaggaaggaggaaacugagguccuauggaccagcaauuccguggucguguucugugggacaucuggcacuuacggaaccggcucguggcccgauggggccgacaucaaccucaugccuauuuga

SEQ ID NO: 144170 - RNA, 1410 nt, Artificial Sequence; identical to SEQ ID NO: 138615
  derived and/or modified sequence opt3 from neuraminidase__InfluenzaA__AFH74535

SEQ ID NO: 144171 - RNA, 1410 nt, Artificial Sequence; identical to SEQ ID NO: 143651
  derived and/or modified sequence opt3 from neuraminidase__InfluenzaA__AFH74546

SEQ ID NO: 144172 - RNA, 1410 nt, Artificial Sequence; identical to SEQ ID NO: 143651
  derived and/or modified sequence opt3 from neuraminidase__InfluenzaA__AFH74557

SEQ ID NO: 144173 - RNA, 1410 nt, Artificial Sequence; identical to SEQ ID NO: 143651
  derived and/or modified sequence opt3 from neuraminidase__InfluenzaA__AFH74568

SEQ ID NO: 144174 - RNA, 1410 nt, Artificial Sequence; identical to SEQ ID NO: 143654
  derived and/or modified sequence opt3 from neuraminidase__InfluenzaA__AFH74579

SEQ ID NO: 144175 - RNA, 1410 nt, Artificial Sequence
  derived and/or modified sequence opt3 from neuraminidase__InfluenzaA__AFH74590
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaagucaagauugggauaugagacauuuaaagucaucgaagguuggaguaauccaaaguccaaacugcagauuaacaggcaagugauaguagaccggggcaaucguagcggguacucuggaaucuucucaguugagggcaagaguuguauuaaccgcugcuuuuauguggaacuaaucagagguaggaaggaggaaacugagguccucuggaccagcaauuccaucguggucuucugugggacaucuggcacuuacggaaccggcucguggcccgauggggccgacauuaaccugaugagcguguga

SEQ ID NO: 144176 - RNA, 1410 nt, Artificial Sequence; identical to SEQ ID NO: 143651
  derived and/or modified sequence opt3 from neuraminidase__InfluenzaA__AFH74601

SEQ ID NO: 144177 - RNA, 1410 nt, Artificial Sequence
  derived and/or modified sequence opt3 from neuraminidase__InfluenzaA__AFH74612
augaaccccaaucagaagaucauuaccauaggcagcgugucccugacaaucucuacuauuugcuucuuuaugcaaacggccauccucauuaccacagucacucuucacuucaaacagugugaguuuaacucaccuccaaauaaccagguuaugcugugcgaaccgaccaucauagagagaaauaucacagaaauuguguacuugaccaacacuacaaucgagaaggaaauuugucccaaauuagcugaguauaggaauuggaguaagccucagugcgacaucaccggguucgcaccauuuagcaaagauaacuccauacggcugucugccggaggugacauuuggguaacgcgcgagcccuacgugucgugugauccugacaagugcuaucaauucgcgcuaggccaggggacuacccucucaaauguccauagcaacaauacagugcgagaucguacuccauacagaacccugcuuaugaacgaacugggaguucccuuucacuugggcacaaaacagguguguaucgcuuggaguuccucuagcugccaugacgguaaggccuggcuccacgucuguauuaccggggaugacaagaaugcaacggccuccuucaucuauaacggaaggcugguggauucaguaguuaguuggagcaaagagauccugcggacucaggaaucugagugcguguguauuaauggcacaugcaccgucgugaugacugacggcuccgcuucagggaaggcagauacaaaaauacucuuuaucgaggaaggaaagauugugcauaccagcacguuaagugguucugcccaacacgucgaggaaugcuccuguuacccucgcuauccaggcguuagaugcguguguagggacaacuggaaggggagcaaccggccgaucguagauauaaauauuaaagaccacucgaucgugucuuccuacgucugcucaggacuggugggcgacacccccaggaagaacgauaguagcuccucuagccauugucuugacccuaauaacgaggaaggugggcacggaguuaaaggcugggcuuucgaugacggcaaugauguguggauggggcgaacaaucucagagaagaguagauugggauacgagacuuuuaaagucauugaagguugguccaacccaaagagcaaacugcagaucaaucgccaggugauuguagaccggggcaaccguucuggguauucaggaauauucaguguugagggcaagagcugcaucaaucgcuguuuuuacguggaacuaauuagagguaggaaggaggaaaccgagguccucuggacauccaacucuaucguggucuucugcgggacuucgggcaccuauggaacaggcagcuggcccgauggggccgacaucaaucugaugccuauuuga

SEQ ID NO: 144178 - RNA, 1410 nt, Artificial Sequence; identical to SEQ ID NO: 143651
  derived and/or modified sequence opt3 from neuraminidase__InfluenzaA__AFH74623

SEQ ID NO: 144179 - RNA, 1410 nt, Artificial Sequence; identical to SEQ ID NO: 143651
  derived and/or modified sequence opt3 from neuraminidase__InfluenzaA__AFH74634

SEQ ID NO: 144180 - RNA, 1410 nt, Artificial Sequence; identical to SEQ ID NO: 143658
  derived and/or modified sequence opt3 from neuraminidase__InfluenzaA__AFH74645

SEQ ID NO: 144181 - RNA, 1410 nt, Artificial Sequence; identical to SEQ ID NO: 143658
  derived and/or modified sequence opt3 from neuraminidase__InfluenzaA__AFH74656

SEQ ID NO: 144182 - RNA, 1410 nt, Artificial Sequence; identical to SEQ ID NO: 143658
  derived and/or modified sequence opt3 from neuraminidase__InfluenzaA__AFH74667

SEQ ID NO: 144183 - RNA, 1410 nt, Artificial Sequence; identical to SEQ ID NO: 143658
  derived and/or modified sequence opt3 from neuraminidase__InfluenzaA__AFH74678

SEQ ID NO: 144184 - RNA, 1410 nt, Artificial Sequence; identical to SEQ ID NO: 138615
  derived and/or modified sequence opt3 from neuraminidase__InfluenzaA__AFH74689

SEQ ID NO: 144185 - RNA, 1410 nt, Artificial Sequence; identical to SEQ ID NO: 138615
  derived and/or modified sequence opt3 from neuraminidase__InfluenzaA__AFH74700

SEQ ID NO: 144186 - RNA, 1410 nt, Artificial Sequence
  derived and/or modified sequence opt3 from neuraminidase__InfluenzaA__AFH74711
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccauguguuagaugcguguguagggacaacuggaagggcuccaaucggccgauaguagauauuaacaucaaagaccacagcaucgugucgucuuacgucugcuccgggcuggugggagacacgccccgcaagaaugauucaaguagcuccucucauugucuugacccuaacaaugaggaaggcggucacgggguuaaaggaugggcuuucgaugacggcaacgauguguggaugggccgaaccauuagcgagaagucaagauugggguaugagacauuuaaagucaucgaaggauggaguaauccaaaguccaaacugcagauuaacaggcaagugauaguagaccgggguaaucguagcggcuacucugggaucuucucaguugagggaaagaguugcauuaaccgcuguuuuuauguggaacuaaucagaggcaggaaggaggaaacugagguccucuggaccagcaauuccaucguggucuucugcgguacaucugggacuuacggcaccggaucguggcccgauggcgccgacauuaaccugaugccuguguga

SEQ ID NO: 144187 - RNA, 1410 nt, Artificial Sequence; identical to SEQ ID NO: 143651
  derived and/or modified sequence opt3 from neuraminidase__InfluenzaA__AFH74722

SEQ ID NO: 144188 - RNA, 1410 nt, Artificial Sequence; identical to SEQ ID NO: 143651
  derived and/or modified sequence opt3 from neuraminidase__InfluenzaA__AFH74733

SEQ ID NO: 144189 - RNA, 1410 nt, Artificial Sequence
  derived and/or modified sequence opt3 from neuraminidase__InfluenzaA__AFH74744
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgaauuacgucuguucuggacuggugggcgacacgccccgcaagaacgauuccucaaguagcucccauugccuugacccuaauaacgaggaaggugggcacggaguuaaaggcugggcuuucgaugacggcaaugauguguggauggggcgaaccauuucugaaaagagcagauugggauaugagacauuuaaagucaucgaggguuggucaaacccaaagaguaaacugcagauuaauaggcaagugauaguagaccggggcaaccguuccggguacagcggaaucuucucuguugagggcaagucauguauuaaucgcugcuuuuauguggaacuaaucagagguaggaaggaggaaacugagguccucuggaccaguaacagcaucguggucuucugugggacauccggcacuuacggaaccggcucuuggcccgauggggccgacauuaaucugaugccuguguga

SEQ ID NO: 144190 - RNA, 1410 nt, Artificial Sequence; identical to SEQ ID NO: 143651
  derived and/or modified sequence opt3 from neuraminidase__InfluenzaA__AFH74755

SEQ ID NO: 144191 - RNA, 1410 nt, Artificial Sequence; identical to SEQ ID NO: 143651
  derived and/or modified sequence opt3 from neuraminidase__InfluenzaA__AFH74766

SEQ ID NO: 144192 - RNA, 1410 nt, Artificial Sequence; identical to SEQ ID NO: 143651
  derived and/or modified sequence opt3 from neuraminidase__InfluenzaA__AFH74777

SEQ ID NO: 144193 - RNA, 1410 nt, Artificial Sequence; identical to SEQ ID NO: 138615
  derived and/or modified sequence opt3 from neuraminidase__InfluenzaA__AFH74788

SEQ ID NO: 144194 - RNA, 1410 nt, Artificial Sequence
  derived and/or modified sequence opt3 from neuraminidase__InfluenzaA__AFH74799
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcggcccugauaaguguuaccaauucgcgcuagggcagggaacgacucucaauaacguccauucaaauaacaccgugcgagaccguacaccauauagaacucugcuuaugaaugaacugggcguucccuuucacuuggguaccaaacaggugugcauugcuuggagcaguuccucuugucaugaugggaaggccuggcuccacgucugcaucacaggagacgauaagaacgcaaccgccagcuucaucuacaauggcaggcugguggacuccguaguuucauggaguaaagagauucugcggacgcaggaaagcgagugugugugcauaaacggcacuuguacagucgugaugaccgaugggucugcuuccggaaaggcagacacuaaaauccucuuuauugaggaagguaagaucgugcauacaucaaccuuaagcggcagugcccaacacgucgaggaaugcucuugcuauccucgcuacccagggguuagaugugugugcagggauaacuggaagggauccaaucggccgauaguagacauuaacaucaaagaucacagcaucgugucgucuuacgucuguuccggccuggugggugacacgccccgcaagaaugacucaaguagcuccucucauugccuugauccuaacaaugaggaagggggacacggcguuaaaggcugggcuuucgacgaugggaacgacguguggaugggacgaaccauuagcgagaagucaagauuggguuaugagacauuuaaagucaucgaaggcuggaguaauccaaaguccaaacugcagauuaacaggcaagugauaguagaucgggggaaucguagcggauacucuggcaucuucucaguugaggguaagaguuguauuaaccgcugcuuuuauguggaacuaaucagagggaggaaggaggaaacugagguccucuggaccagcaauuccaucguggucuucuguggcacaucuggaacuuacggcaccgggucguggcccgacggagccgauauuaaccugaugccuguguga

SEQ ID NO: 144195 - RNA, 1410 nt, Artificial Sequence; identical to SEQ ID NO: 143671
  derived and/or modified sequence opt3 from neuraminidase__InfluenzaA__AFH74810

SEQ ID NO: 144196 - RNA, 1410 nt, Artificial Sequence; identical to SEQ ID NO: 143671
  derived and/or modified sequence opt3 from neuraminidase__InfluenzaA__AFH74821

SEQ ID NO: 144197 - RNA, 1410 nt, Artificial Sequence; identical to SEQ ID NO: 143671
  derived and/or modified sequence opt3 from neuraminidase__InfluenzaA__AFH74832

SEQ ID NO: 144198 - RNA, 1410 nt, Artificial Sequence; identical to SEQ ID NO: 143671
  derived and/or modified sequence opt3 from neuraminidase__InfluenzaA__AFH74843

SEQ ID NO: 144199 - RNA, 1410 nt, Artificial Sequence; identical to SEQ ID NO: 143651
  derived and/or modified sequence opt3 from neuraminidase__InfluenzaA__AFH74854

SEQ ID NO: 144200 - RNA, 1410 nt, Artificial Sequence; identical to SEQ ID NO: 143651
  derived and/or modified sequence opt3 from neuraminidase__InfluenzaA__AFH74865

SEQ ID NO: 144201 - RNA, 1410 nt, Artificial Sequence; identical to SEQ ID NO: 143651
  derived and/or modified sequence opt3 from neuraminidase__InfluenzaA__AFH74876

SEQ ID NO: 144202 - RNA, 1410 nt, Artificial Sequence; identical to SEQ ID NO: 143651
  derived and/or modified sequence opt3 from neuraminidase__InfluenzaA__AFH74887

SEQ ID NO: 144203 - RNA, 1410 nt, Artificial Sequence; identical to SEQ ID NO: 143651
  derived and/or modified sequence opt3 from neuraminidase__InfluenzaA__AFH74898

SEQ ID NO: 144204 - RNA, 1410 nt, Artificial Sequence; identical to SEQ ID NO: 143651
  derived and/or modified sequence opt3 from neuraminidase__InfluenzaA__AFH74909

SEQ ID NO: 144205 - RNA, 1410 nt, Artificial Sequence
  derived and/or modified sequence opt3 from neuraminidase__InfluenzaA__AFH74920
augaaccccaaucagaagaucauuaccauaggcagcgugucccugacaaucucuacuauuugcuucuuuaugcaaacggccauccucauuaccacagucacucuucacuucaaacagugugaguuuaacucaccuccaaauaaccagguuaugcugugcgaaccgaccaucauagagagaaauaucacagaaauuguguacuugaccaacacuacaaucgagaaggaaauuugucccaaauuagcugaguauaggaauuggaguaagccucagugcgacaucaccggguucgcaccauuuagcaaagauaacuccauacggcugucugccggaggugacauuuggguaacgcgcgagcccuacgugucgugugauccugacaagugcuaucaauucgcgcuaggccaggggacuacccucaauaacguccauucaaauaacacagugcgagaucguacuccauacagaacccugcuuaugaaugaacugggaguucccuuucacuugggcacaaaacagguguguaucgcuuggagcaguuccucuugccaugacgguaaggccuggcuccacgucuguauuaccggggaugacaagaacgcaacggccagcuucaucuauaauggaaggcugguggauuccguaguuucauggaguaaagagauccugcggacucaggaaagcgagugcguguguauuaacggcacaugcaccgucgugaugacugacggcucugcuuccgggaaggcagauacaaaaauacucuuuaucgaggaaggaaagauugugcauaccucaacguuaagcgguagugcccaacacgucgaggaaugcucuuguuacccucgcuauccaggcguuagaugcguguguagggacaacuggaagggguccaaucggccgaucguagauauaaacauuaaagaccacagcaucgugucgucuuacgucugcuccggacuggugggcgacacccccaggaagaaugauucaaguagcuccucucauugucuugacccuaacaaugaggaaggugaucacgggguuaaaggaugggcuuucgacgauggcaacgacguguggaugggccgaacaaucagcgagaagucaagauugggguacgagacuuuuaaagucauugaaggauggaguaauccaaaguccaaacugcagaucaaccgccaggugauuguagaucgggguaaucguagcggcuauucugggauauucucaguugagggaaagaguugcaucaaccgcuguuuuuacguggaacuaauuagaggcaggaaggaggaaaccgagguccucuggacaagcaauuccaucguggucuucugcgguacuucugggaccuauggcacaggaucguggcccgacggcgccgauaucaaccugaugccuauuuga

SEQ ID NO: 144206 - RNA, 1410 nt, Artificial Sequence; identical to SEQ ID NO: 138615
  derived and/or modified sequence opt3 from neuraminidase__InfluenzaA__AFH74931

SEQ ID NO: 144207 - RNA, 1410 nt, Artificial Sequence; identical to SEQ ID NO: 138615
  derived and/or modified sequence opt3 from neuraminidase__InfluenzaA__AFH74942

SEQ ID NO: 144208 - RNA, 1410 nt, Artificial Sequence; identical to SEQ ID NO: 143651
  derived and/or modified sequence opt3 from neuraminidase__InfluenzaA__AFH74953

SEQ ID NO: 144209 - RNA, 1410 nt, Artificial Sequence
  derived and/or modified sequence opt3 from neuraminidase__InfluenzaA__AFH74964
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaauauuaagcgguagugcccaacacgucgaggaaugcucuugcuauccucgcuacccaggcguuagaugugugugcagggacaacuggaagggguccaaucggccgauuguagauaucaacaucaaagaccacagcauugugucgucuuacgucuguuccggacuggugggcgacacccccaggaagaaugauucaaguagcuccucucauugccuugacccuaacaaugaggaaggugggcacggaguuaaaggcugggcuuucgaugacggcaacgauguguggauggggcgaacgaucagcgagaagucaagauugggauaugagaccuuuaaagucauugaagguuggaguaauccaaaguccaaacugcagauaaaccgccaggugaucguagaccggggcaaucguagcggguacucuggaauuuucucaguugagggcaagaguuguaucaaccgcugcuuuuauguggaacuaaucagagguaggaaggaggaaacagagguccucuggacuagcaauuccauuguggucuucugugggaccucuggcacauacggaacuggcucguggcccgauggggccgacauaaaccugaugccuguguga

SEQ ID NO: 144210 - RNA, 1410 nt, Artificial Sequence; identical to SEQ ID NO: 143651
  derived and/or modified sequence opt3 from neuraminidase__InfluenzaA__AFH75391

SEQ ID NO: 144211 - RNA, 1410 nt, Artificial Sequence; identical to SEQ ID NO: 138754
  derived and/or modified sequence opt3 from neuraminidase__InfluenzaA__AFH97143

SEQ ID NO: 144212 - RNA, 1410 nt, Artificial Sequence
  derived and/or modified sequence opt3 from neuraminidase__InfluenzaA__AFI56407
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaagguaauguuuuugugauuagggagccauucaucagcuguuccccguuagaaugccggaccuuuuuccugacacagggggcucuacucaacgauaagcauucaaacggaaccaucaaagaccgcagucccuaucgaacucugaugagcuguccuauuggcgaggucccaucucccuacaauucccguuuugaaucaguggccuggagcgcaagugccugccacgauggcauaaacuggcuuacaaucgggauuucuggaccugacaauggugcuguagcaguucugaaguauaacggcaucauaaccgauacgauuaaguccuggagaaauaacaucuugaggacucaagagagcgagugugccugcgugaaugggucguguuucaccaucaugacagacggaccaucugauggccaggcuuccuacaaaauuuuucggaucgaaaaggguaaaauugucaagucaguggagaugaacgcccccaauuaucauuacgaagagugcaguuguuacccugacagcuccgagauaacuugcgugugccgcgauaacuggcacgggucuaauagaccaugggucagcuucaaccagaaucucgaauaucagaucggauacauuuguucaggcaucuuuggcgacaacccgaggcccaaugauaaaaccgggaguugcggaccuguuuccagcaacggugcgaacggcgugaagggguucucuuuuaaguauggaaauggcguauggaucggucggacaaaaucaauuaguagccgcaagggguucgagaugauaugggacccaaacggcuggaccggaacggauaauuccuuuucuaucaaacaagacauugugggcaucaacgaauggucgggguacagcggauccuucguccagcaucccgagcugacuggucuggacuguauucgaccuugcuucuggguggaacucaucagaggcaggccaaaggagaauacaauauggaccucagggaguucuaucagcuuuuguggaguuaacuccggcacuguggguuggucauggcccgauggggcagaguuaccguucacaauugacaaauga

SEQ ID NO: 144213 - RNA, 1410 nt, Artificial Sequence
  derived and/or modified sequence opt3 from neuraminidase__InfluenzaA__AFJ05141
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaagccuccugaugaaugaacuuggaguuccuuuucaccugggcacuaaacaggugugcauugcuuggaguuccucuagcugucaugacgguaaggccugguugcacgucugcaucaccggggaugacaagaacgcaacagccuccuucaucuacaauggaaggcucguggauucaguaguuaguuggagcaaagagauucugcggacccaggaaucugagugugugugcauaaacggcacguguacugucgugaugacagacggcuccgcuucagggaaggcagauaccaaaauccuguuuauugaggaaggaaagaucgugcauacuagcacacucagugguucugcccaacacgucgaggaaugcuccugcuauccacgcuacccgggcguuagaugugugugcagggacaacuggaaggggagcaaucggcccauaguagauauuaacaucaaagaccacucgaucgugucuuccuacgucuguucaggauuagugggcgacaccccucgcaagaaugauaguagcuccucuagccauugccuggacccaaacaaugaggaaggugggcacggaguuaaaggcugggcuuucgaugacggcaacgauguguggauggggcgaacgauuaaugagaccucaagacuuggauaugagacauuuaaggucaucgaagguuggaguaaccccaaauccaaguugcagauuaauaggcaagugauaguagaccggggcgaucguagcggguacucuggaaucuucucaguugagggcaaaaguuguauuaaccgcugcuuuuauguggaacugaucagagguaggaaggaggaaacugagguccuauggaccagcaauuccaucguggucuucugugggacaucuggcacuuacggaaccggcucguggccugacggggccgaucucaaccugaugccaauuuga

SEQ ID NO: 144214 - RNA, 1410 nt, Artificial Sequence
  derived and/or modified sequence opt3 from neuraminidase__InfluenzaA__AFJ05145
augaaccccaaucagaagaucauuaccauaggcagcgugucccugacaaugucuacuaucugcuucuuuaugcagauugccauccucauuacgaccgucacacuucacuucaaacaguacgaguuuaacucaccuccaaauaaccagguuaugcugugugaaccgacuaucauagagagaaauaucaccgaaauuguguauuugacaaacaccacuaucgagaaggaaauuugccccaaaccugcugaguacaggaauuggaguaagccacagugugacaucacaggguucgcacccuuuagcaaagauaacuccauacgguuaucugccggaggugacauuuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcaucgcuuggagcaguuccucuugucaugacgguaaggccugguugcacgucugcauuacaggggaugacaagaacgcaaccgccagcuucaucuacaauggaaggcucguggauuccguaguuucauggaguaaagagauccugcggacgcaggaaagcgagugugugugcauuaacggcacuuguacagucgugaugaccgacggcucugcuuccgggaaggcagauacuaaaauacuguuuaucgaggaaggaaagauugugcauacaucaacccucagcgguagugcccaacacgucgaggaaugcucuugcuauccacgcuacccgggcguuagaugugugugcagggacaacuggaagggguccaaucggcccaucguagauauaaacauuaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccaucaaugagacaagcagacuuggauaugagacuuuuaaggucauugaagguuggucaaaccccaaaaguaaguugcagaucaauaggcaagugauuguagaccggggcgaucguuccggguacagcggaauauucucuguugagggcaaaucauguaucaaccgcugcuuuuauguggaacugauuagagguaggaaggaggaaaccgagguccuauggacaaguaauagcaucguggucuucugugggacuuccggcaccuacggaacaggcucuuggccugacggggccgaucucaaccugaugccaaucuga

SEQ ID NO: 144215 - RNA, 1410 nt, Artificial Sequence
  derived and/or modified sequence opt3 from neuraminidase__InfluenzaA__AFJ05635
augaaccccaaucagaagaucauuaccauaggcagcgugugcaugacaaucgggauggccaaccugauucuccaaaucggaaauauuaucuccauauggaucucucacucaauucagcuuagaaaccagagucagaucgagacuuguaaucaaagcgucauuacguacgaaaacaauaccuggguuaaccagacauaugugaauaucuccaacacuaauuucgcugcaggucagucuguagugucgaugaaacuggccggcaacucauccuugugcccugucagugggugggcgauauacuccaaggacaauucuauuaggaucggaagcaaaggcgauguguuuguuauucgggagccauucaucuccuguucaccguuagaaugccgcaccuuuuuccugacacagggugcucuacucaacgacaagcauaguaaugggaccaucaaagaucgaagccccuaucguacucugaugucuuguccuauuggagaggugccaucccccuacaacucaagauuugaaagcgucgccuggagugcaucugccugccacgacggcauaaacuggcuuacaaucggcauuuccgggccugauaauggagcuguggcaguacugaaguauaacgguaucauaaccgacacgauuaagagcuggaggaauaacaucuugcggacucaagagucggagugugccugcguuaauggcucuuguuucaccaucaugacagaugggccauccgacggacaggcuucauacaaaauuuuucgcaucgaaaagggcaaaauugugaagagugucgagaugaacgcccccaauuaucauuacgaagagugcagcuguuacccugauuccucugagauaacuugcgugugcagagacaacuggcacgguagcaauaggccaugggugucauucaaccagaaucucgaauaucagaucggguacauuuguaguggaaucuuuggcgauaacccgcggcccaaugacaaaaccggcuccugcgggccugucagcucuaacggagcgaaugguguuaagggcuucucauuuaaguaugggaacggaguguggaucggccgcacaaaaaguauuagcucccgaaaggguuucgagaugauaugggauccaaacggguggaccggcacggacaauaacuuuucuaucaaacaagacauuguaggaaucaaugaauggucgggcuacagcggguccuucgugcagcaucccgagcugacuggacuggauuguauuagaccuugcuucugggucgaacucaucaggggucggccaaaggagaacacaauauggaccucaggcaguucuaucagcuuuuguggggugaauagcgacacuguuggauggucauggcccgauggcgcagaguuaccguucacaauugacaaauga

SEQ ID NO: 144216 - RNA, 1410 nt, Artificial Sequence
  derived and/or modified sequence opt3 from neuraminidase__InfluenzaA__AFJ11709
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuaaugagacaagcagauugggauaugagacuuuuaaggucaucgaagguuggucaaacccaaaaaguaagcugcagauuaauaggcaagugauaguagaccggggcaaccguuccggguacagcggaaucuucucuguugagggcaaaucauguauuaaucgcugcuuuuauguggaacuaaucagagguaggaaggaggaaaccgagguccucuggacaaguaacagcaucguggucuucugugggacuuccggcaccuacggaacaggcucuuggcccgauggggccgaccugaaucuuaugcugauuuga

SEQ ID NO: 144217 - RNA, 1410 nt, Artificial Sequence
  derived and/or modified sequence opt3 from neuraminidase__InfluenzaA__AFJ11720
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugauugauuccgugguaucauggaguaaagagauacugcggacgcaggaaagcgaguguguuugcaucaacggcacuuguacaguggucaugaccgacggcucugcuuccgggaaggcagauacuaaaauucucuuuaucgaggaaggaaagauagugcauacaucaaccuuaagcgguagugcccaacacguggaggaaugcucuugcuauccucgcuacccaggcgucagauguguuugcagggacaacuggaagggguccaaucggccgauuguggauaucaacaucaaagaccacagcauuguaucgucuuacguguguuccggacuggucggcgacacgccccgcaagaaugauucaaguagcuccucucauugccuugacccuaacaaugaggaaggugggcacggagugaaaggcugggcuuucgaugacggcaacgauguuuggauggggcgaaccaucaaugagacaagcagauugggauaugagacuuuuaaggugauugaagguuggucaaacccaaaaaguaagcugcagauaaauaggcaggucaucguggacaaaggcaaccgguccggguacagcggaauuuucucuguagagggcaagucauguaucaaucguugcuuuuauguugaacuaauccgcgguagaaaggaggaaaccgaggugcucuggacaaguaacagcauugucguguucugugggacuuccggcaccuacggaacaggcucuuggcccgauggggccgaccugaaucuuaugccuauauga

SEQ ID NO: 144218 - RNA, 1410 nt, Artificial Sequence; identical to SEQ ID NO: 143159
  derived and/or modified sequence opt3 from neuraminidase__InfluenzaA__AFJ11731

SEQ ID NO: 144219 - RNA, 1410 nt, Artificial Sequence
  derived and/or modified sequence opt3 from neuraminidase__InfluenzaA__AFJ19845
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccagacguuagaugugugugcagggauaacuggaagggcuccaaucggccgauaguagacauuaacaucaaagaccacagcaucgugucgucuuacgucuguuccgggcuggugggagauacgccccgcaagaaugacucaaguagcuccucucauugccuugauccuaacaaugaggaaggcggucacgggguuaaaggaugggcuuucgacgauggcaacgacguguggaugggccgaaccauuaaugagacaagcagauugggguaugagacuuuuaaggucaucgaaggauggucaaacccaaaaaguaagcugcagauuaauaggcaagugauaguagauaaagguaaccgguccggcuacagcgggaucuucucuguugagggaaagucauguauuaaucguugcuuuuauguggaacuaauccgcggcagaaaggaggaaaccgagguccucuggacaaguaacagcaucguggucuucugugguacuuccgggaccuacggcacaggaucuuggcccgacggcgccgaucugaaucuuaugccuauuuga

SEQ ID NO: 144220 - RNA, 1410 nt, Artificial Sequence; identical to SEQ ID NO: 138754
  derived and/or modified sequence opt3 from neuraminidase__InfluenzaA__AFJ44697

SEQ ID NO: 144221 - RNA, 1410 nt, Artificial Sequence; identical to SEQ ID NO: 142273
  derived and/or modified sequence opt3 from neuraminidase__InfluenzaA__AFJ69989

SEQ ID NO: 144222 - RNA, 1410 nt, Artificial Sequence
  derived and/or modified sequence opt3 from neuraminidase__InfluenzaA__AFJ69990
augaaccccaaucagaagaucauuaccauaggcagcgugugcaugacaaucgggauggccaaccugauucuccaaaucggaaauauuacuuccaucuggauaucucacucaauccagcuugguaaccagaaucagauugagacguguaaccaaagugucaucaccuacgaaaauaacacauggguuaaucagacuuaugugaacauuagcaauaccaacuucgcugcaggccaguccguagugucugucaaacuggccggaaauucgucauugugcccugugagcggaugggcgaucuacaguaaggacaacuccauaagaauuggcucuaaaggugauguuuuugugaucagggagccauucauuagcuguuccccguuagaaugccggacauuuuuccugacccagggggcucuacucaaugacaagcauucaaacggaacuaucaaagaucgcagucccuaucgaacacugaugagcuguccuaucggcgaggucccaucucccuacaacucccguuuugaaucaguggccuggagcgcaagugccugccacgacggcauuaauuggcuuaccauagggaucucuggaccugauaacggugcuguagcaguucugaaguauaauggcauuaucacggacacuauaaaguccuggagaaacaauauuuugaggacccaagagagcgagugugccugcgugaacgggucguguuucacagucaugacugauggaccaucugacggccaggcuuccuacaaaaucuuucggaucgaaaaggguaaaauugugaagucaguggagaugaaugcccccaacuaucauuacgaagagugcaguuguuacccugauagcuccgagauuaccugcgucugccgcgacaauuggcacgggucuaacagaccauggguuagcuucaaucagaaccucgaauauaggaucggauacauauguucaggcaucuuuggcgauaauccgcggcccaacgacaaaacagggaguugcggaccuguguccagcaauggugcgaacggcguaaagggguucucuuuuaaguauggaaacggcguguggauuggucgcaccaaaucaaucaguagccgaaauggguucgagaugaucugggauccaaacggcuggacgggaacugacaauaacuuuuccauuaagcaggacauaaucggcauuaaugaauggucuggguacucggggagcuucguccaacaucccgagcugacaggucuggauuguaucagaccuugcuucuggguggaacucauuaggggccggccaaaagagaacaccaucuggacuuccgggucaaguauaucuuuuuguggaguuaauagcgacacagugggcugguccuggcccgauggugcagaguuaccguucaccaucgacaaguga

SEQ ID NO: 144223 - RNA, 1410 nt, Artificial Sequence
  derived and/or modified sequence opt3 from neuraminidase__InfluenzaA__AFJ69991
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacucauccuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaaccaagaccuuucacacagcgccuggagugcaucugccugccaugauggcauaaacuggcugacaaucgggauuuccggaccugacaauggugcuguggcaguauugaaguauaacggcaucauaaccgauacgauuaagagcuggcguaauaacauccucagaacucaggaaucggagugugccugcguuaaugggucuuguuuuaccaucaugacagacggaccauccgauggccaggcuucauacaaaauuuucaggaucgagaaggguaaaauugugaagagugucgaaaugaacgcccccaauuaucacuacgaggaaugcagcuguuacccugacuccucugagauaacuugcgugugccgggauaacuggcaugggagcaaucgcccaugggugucauuuaaccagaaucuggaguaucaaaucggauacauuuguaguggcaucuucggcgacaacccgagacccaaugauaaaaccggguccugcggaccugucagcucuaacggugcgaauggcguuaagggguuuucauucaaguauggaaacggcguguggaucgguaggacaaaaaguauuagcucccggaagggguuugaaaugauaugggacccaaacggcuggaccggaacggacaauaacuucucuaucaaacaggauauuguaggcaucaaugaguggucgggguacagcggauccuuugugcagcaccccgaacugacuggucucgacuguauucgcccuugcuucugggucgaguuaauccgaggcagaccaaaggaaaacacaauauggaccucagggaguucuaucagcuucuguggagugaauagcgauacuguuggcuggucauggcccgacggugcagagcugccguuuacaauugauaaauga

SEQ ID NO: 144224 - RNA, 1410 nt, Artificial Sequence; identical to SEQ ID NO: 139580
  derived and/or modified sequence opt3 from neuraminidase__InfluenzaA__AFJ69992

SEQ ID NO: 144225 - RNA, 1410 nt, Artificial Sequence
  derived and/or modified sequence opt3 from neuraminidase__InfluenzaA__AFJ69993
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuaaugagacaagcagauugggauaugagacuuuuaaggucaucgaagguuggucaaacccaaaaaguaagcugcagauuaauaggcaagugauaguaggccgggggaaccguuccggauacagcggcaucuucucuguugaggguaaaucauguauuaaucgcugcuuuuauguggaacuaaucagagggaggaaggaggaaaccgagguccucuggacaaguaacagcaucguggucuucuguggcacuuccggaaccuacggcacagggucuuggcccgacggagccaaucugaaccuuaugccuauuuga

SEQ ID NO: 144226 - RNA, 1410 nt, Artificial Sequence; identical to SEQ ID NO: 141534
  derived and/or modified sequence opt3 from neuraminidase__InfluenzaA__AFJ69994

SEQ ID NO: 144227 - RNA, 1413 nt, Artificial Sequence
  derived and/or modified sequence opt3 from neuraminidase__InfluenzaA__AFJ74389
augaaccccaaucagaagaucauuaccauaggcagcaucuccauugccaucgggauuaucucucugauacuccaaaucggaaacauuaucucaauuugggcuagucacagcauccagacagguucccagaaucauacuggcgugugcaaccagagaauaauuacguacgaaaauucuaccugggucaaccaaacauauguuaauaucaacaauacuaacgugguagcagggaaagacaagaccucgaugacacuugccggaaauucaagccuguguccuauuaggggcugggcgaucuacaccaaagauaacaguauccggauugguuccaagggggacguguucgucauacgcgagccauuuaucucuugcagccacuuggagugucgaacuuucuuuuuaacacagggagcucugcuaaaugauaaacauuccaacggcaccgugaaggaccguucaccguauagagcccucaugaguugcccccugggcgaagcaccuagcccauacaauucuagguucgaguccguugccuggucagcuagcgcaugucacgaugggcuuggauggcugacgauugguaucaguggccccgacaacggggccguggcugucuugaaguauaacggaauaauuacugaaaccaucaaaucuuggaagaaacggauccuccgcacacaggaguccgagugcguguguaugaauggcagcugcuuuacuauuaugaccgaugguccuucgaacggggccgcgucuuacagaaucuucaagauugaaaaaggaaggguaacaaaguccauagagcuggacgcaccaaauuaucauuacgaagaguguucaugcuaccccgauaccggcacgguuaugugugugugccgggacaacuggcacggcaguaaucgcccuugggucagcuuuaaccagaaucuggauuaucaaaucggguacauuugcuccggaguguucggugacaacccacgaccgaaggauggcgaggggucuuguaaucccgugacugucgacggagccgacggcguuaaagguuuuagcuauagauacgggaacggcguguggaucggaaggacaaagucaaaucggcuccguaaaggcuucgaaaugaucugggauccuaacggguggaccgacacugauagugacuuuuccaugaagcaggauauuguagcuaugacagacuggagcggauauucugguucauucgugcagcacccagaguuaaccggccuggauugcaugcgccccuguuuuugggucgaacuugugagaggguugccuagggagaauacgaccauauggacaaguggaagcuccaucucuuucugcggcguuaacucggacacugccaauuggagcuggccagauggugcagaacugcccuucaccauugacaaauga

SEQ ID NO: 144228 - RNA, 1410 nt, Artificial Sequence
  derived and/or modified sequence opt3 from neuraminidase__InfluenzaA__AFJ74399
augaaccccaaucagaagaucauuaccauaggcagcgugucccugacaaucgccacuauuugcuuccucaugcaaaucgcuauucuugucaucacgcugaccuugcacuuuaaacaguacgaguguaacucuccuccaaauaaccagguuauguuaugcgaaccgacaauaaucgagagaaauauuacugaaaucguguaucugaccaacacaaccauugagaaggaaaucugucccaaacuagcagaguacaggaauuggucaaagccucagugcaaaauaacuggguucgccccauuuaguaaggacaacagcauucggcucuccgcgggaggugauaucuggguaacacgcgagcccuaugugucuugugacccuggcaagugcuaccaauucgcucuggggcagggaaccacgcuuaauaaccgacauucgaaugauacuguccacgaccguaccccauauagaacacuguugaugaacgaacucggcgugcccuuucaucuggguacuaaacagguuuguauugccuggucaagcaguuccugccacgaugggaaggcauggcugcaugugugugucaccggacacaaugagaacgccacagcuucuuucaucuacgacggcaggcucguggauagcaucggcuccuggaguaaaaauauuuuacggacccaggaaucagagugcguauguauaaacgggacgugcacuguugugaugacagacggaagcgcaucuggucgcgccgauaccaagauccuguuuauugaggaaggcaaaaucguccacauauccccucuuucagggagcgcucaacauguggaggaaugcaguuguuauccaagauacccgggagugaggugcgucugucgggacaacuggaagggcucuaaucgccccauuguugauaucaacgugaaggacuucuccaucguaagcucguacgugugcucugguuuggucggggauacuccucgaaagaaugacuccucaaguagcucccacugucugaacccaaauaacgaggaaggaggccauggcgugaaagggugggccuuugacgauggaaaugacguuuggauggguagaacaauuucugagaaacuaaggagcggcuaugagaccuucaaggugaucgggggauggucaaaacccaacaguaagcuccagauuaaucggcaggucauaguggaucguggcaaccgcuccgguuacagcgggaucuuuucuguagaaggcaaaucaugcauuaauagauguuucuauguugagcugaucaggggacggaagcaggaaacggaggugugguggaccaguaacagcaucgucguguuuugcggcacauccgggacuuacggaaccgguucuuggccugacggcgcggauauuaaucuuaugccaauauga

SEQ ID NO: 144229 - RNA, 1410 nt, Artificial Sequence
  derived and/or modified sequence opt3 from neuraminidase__InfluenzaA__AFJ74410
augaaccccaaucagaagaucauuaccauaggcagcgugucccugacaaucgccacuauuugcuuccucaugcaaaucgcuauucuugucaugacgguuacccugcacuuuaaacaguacgaguguaacucuccuccaaauaaccaggugauguugugcgaaccgacaaucauagagagaaauaucacugaaauuguauauuuaaccaacacaaccaucgagaaggaaauuugucccaaacuggcagaguacaggaauuggucaaagccucagugcaaaaucacuggguucgccccauuuaguaaggacaacagcauacggcuauccgcgggaggugauauuugggugacacgcgagcccuaugucucuugugacccuggcaagugcuaccaauucgcucucgggcagggaaccacgcugaauaaccgacauucgaaugauacugugcacgaccguaccccauauagaacacuucugaugaacgaauugggcguucccuuucaucucgguacuaaacagguguguaucgccuggucaagcaguuccugccacgaugggaaggcauggcugcaugucugugugaccggacacaaugagaacgccacagcuucuuucauuuacgacggcaggcugguagauagcaucggcuccuggaguaaaaauauccuccggacccaggaaucagagugcguuuguauuaacgggacgugcacuguggucaugacagacggaagcgcaucuggucgcgccgauaccaagauauuauuuaucgaggaaggcaaaauugugcacaucuccccucugucagggagcgcucaacauguggaggaaugcaguuguuauccaagauacccgggagucaggugcguuugucgggacaacuggaagggcucuaaucgccccauaguggauauuaacguaaaggacuacuccaucaucagcucguaugugugcucuggucuugucggggauacuccucgaaagaaugacuccucaaguagcucccacuguuugaacccaaauaacgaggaaggaggccauggcgugaaagggugggccuucgacgauggaaaugacguuuggauggguagaacaauuucugagaaacugaggagcggcuacgagaccuuuaaggugaucgggggauggucaaaacccaacaguaagcuacagauuaaucggcaggucauaguggaucguggcaaccgcuccgguuauagcgggaucuucucuguagaaggcaaaucaugcauuaauagauguuuuuacguugagcucaucaggggacggaagcaggaaacggaggugugguggaccaguaacagcaucgucguguucugcggcacauccgggacuuauggaaccgguucuuggccugacggcgcggauauuaaucugaugccaauauga

SEQ ID NO: 144230 - RNA, 1410 nt, Artificial Sequence; identical to SEQ ID NO: 136331
  derived and/or modified sequence opt3 from neuraminidase__InfluenzaA__AFJ74451

SEQ ID NO: 144231 - RNA, 1413 nt, Artificial Sequence
  derived and/or modified sequence opt3 from neuraminidase__InfluenzaA__AFJ74462
augaaccccaaucagaagaucauuaccauaggcagcaucuccguggccauugggaucauuucucugauccuccaaauaggaaacaucauuucaaucugggcuagucacagcauucagacagguucccagaauuacacuggcaucugcaaccagagaauaauuacguaugaaaauucuaccugggucaaccaaacauacguuaauaucaacaauacuaacgugguagcagggaaagacaagaccucgaugacacuugccggaaauucaagccuguguccuauuaggggcugggcgaucuauaccaaagauaacaguauccggauugguuccaagggggacguguucgucauacgcgagccauuuaucucuugcagccauuuggagugucgaacuuucuuuuuaacacagggagcucugcuaaaugauaaacacuccaacggcaccgugaaggaccguucaccguacagagcccucaugaguugcccccugggcgaagcaccuagcccauauaauucuagguucgaguccguugccuggucagcuagcgcaugucaugaugggcuuggauggcugacgauugguaucaguggccccgacaacggggccguggcugucuugaaguacaacggaauaauuacugaaaccaucaaaucuuggaagaaacagauccuccggacacaggaguccgagugcguguguguaaauggcagcugcuuuacuauuaugaccgaugguccuucgaaccgcgccgcgucuuauagaaucuucaagauugaaaaagggaggguuacaaaguccauagagcuggacgcaccaaauuaccacuacgaagaguguucaugcuaucccgauaccggaacggugaugugugucugccgggacaacuggcauggcaguaaucgcccuugggugagcuuuaaccaaaaucuggauuaccagaucggcuauauuugcuccgggguguucggagacaacccacgaccgaaggauggugagggcucuuguaaucccgucacuguugacggggccgacggagugaaaggcuuuagcuacagauaugguaacgggguauggaucggcaggacaaagucaaaucggcuccguaaaggauucgaaaugaucugggauccuaacggcuggaccgacacugauagugacuuuuccaugaagcaggauguggucgcuaugacagacuggagcggguacucuggaucauucgugcagcacccagaguuaaccggucuggauugcaugcgccccuguuuuuggguugaacuugugagaggcuugccuagggagaauacgaccauuuggacaagugggagcuccauaucuuucugcggagucaacucggaaacugccaauuggagcuggccagacggcgcagagcugcccuucaccaucgauaaauga

SEQ ID NO: 144232 - RNA, 1410 nt, Artificial Sequence
  derived and/or modified sequence opt3 from neuraminidase__InfluenzaA__AFJ74517
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauaugacaaacaccacuaucgagaaggaaauuugucccaaauuagcagaguacaggaauuggucaaagccucagugcaaaaucacaggguucgccccauuuaguaaggacaacagcauacggcuguccgcgggaggugauauuugggugacccgcgagcccuaugucucuugugacccugauaagugcuaccaauucgcucuaggccaggggacgacucucaauaaccgacauucgaaugacaccgugcacgaucguacaccauauagaacucugcuuaugaacgaacugggaguucccuuucauuugggcaccaaacagguguguaucgccuggucaagcaguuccugccacgacgguaaggcauggcuccaugucugugugacagggcacgaugagaaugccaccgcuucuuucauuuacgacggaaggcugguagauagcaucggcuccuggaguaaaaagauccugcggacgcaggaaucagagugcguuuguauuaacggcacuugcacaguggucaugaccgacgggagcgcaucuggacgcgccgauacuaaaauacucuuuaucgaggaagguaagauugugcacaucucccaauuaucaggcagcgcucagcauguggaggaaugcaguuguuauccuagauacccaggggucaggugcguuugucgggacaauuggaagggaucuaaccgcccgauaguggauauuaacguaaaagacuacuccaucgugagcucguaugucugcucuggccuggugggugacacaccccgaaagaaugauuccucaaguagcucccacugucuuaacccuaauaacgaggaagggggacauggcguuaaaggcugggccuucgacgaugggaaugacguguggaugggaagaaccaucucugagaaguugaggagcgguuacgagacguuuaaagucauugaaggcuggucaaagccaaacaguaaacugcagaucaaucgucaggugauuguagaucgggggaaccgcuccggauauagcggcauauucucuguugaggguaagucaugcaucaauagauguuuuuacguggaacuaauuagggggcggaagcaagagaacgaagucugguggaccaguaauagcaucguggucuucugcggcacauccggaacuuauggcaccgggucuuggcccgacggagcggauaucaaccucaugccuauuuga

SEQ ID NO: 144233 - RNA, 1410 nt, Artificial Sequence
  derived and/or modified sequence opt3 from neuraminidase__InfluenzaA__AFJ74564
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuacagagaaggaaaucugucccaaacuggcagaguacaggaauuggucaaagccucagugcaacauuaccggguucgccccauuuaguaaagacaauagcauccggcuauccgcgggaggugauauaugggugacgcgcgagcccuaugucucuugugacccugauaagugcuaccaauucgcucucggccaggggacuacccugaacaauggacauucgaacgacacagugcacgaucgaacuccauaucguacccuucugaugaaugaauugggcguucccuuucaucucgguacaagacagguguguauugccuggucaagcaguuccugccacgacgggaaggcauggcugcaugucugugugaccggagaugacgagaacgccacggcuucuuucaucuacaauggcaggcugguagauagcauuggcuccuggaguaaaaagauccuccggacucaggaaucagagugcguuuguaucaacgggacaugcaccguggucaugacugacggaagcgcaucugguaaagccgauacaaagauuuuauuuauagaggaaggcaaaaucgugcacauuuccacccugucagggagcgcucaacacguggaggaaugcaguuguuauccucgcuacccaggagucagaugcguuuguagggacaacuggaagggcucuaaucggccgaucguggauauaaacguaaaggacuacuccauugugagcucguaugucugcucuggucuugugggggacacgccccgcaaaaaugauuccuucucaaguagccauuguuuggacccuaacaaugaggaaggaggccacggcguuaaggggugggccuuugaugacggaaacgauguguggaugggucgaaccaucuccgagacacugagaucuggcuacgagacuuucaaagucaucgaaggguggagcaagccaaauucaaaacuacagauuaacaggcaagugaucguagagcggggaaaucguaguggcuauuccgguauuuuuagcguugaagggaagucuugcauaaaccgcuguuucuacguggagcucaucagaggcaggaaagaagagaccgaggucugguggacaucaaauaguauuguggucuuuugcggaacuagcggcaccuaugggacaggauccuggcccgacggugcggauaucaaccugaugccuaucuga

SEQ ID NO: 144234 - RNA, 1413 nt, Artificial Sequence
  derived and/or modified sequence opt3 from neuraminidase__InfluenzaA__AFJ74639
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgagaauaacaccugggugaaucacacauaugucaacaucaauaacacuaauguuguggcagggaaagacaagaccucuguaacacuugccggaaacucgucacuguguagcauuaguggcugggcgaucuacaccaaagauaauuccaucaggauugguucuaagggggacguguucgucauacgggaaccuuuuaucagcugcucccauuuggagugucgcacuuucuuuuuaacacaaggagcucugcuaaacgauaaacacucaaauggcaccgugaaggaccgaaguccauaucgugcccucaugagcugcccgcugggcgaagcacccucuccuuacaacuccaaguucgagucaguugccuggagcgcuagugcaugucaugaugggaugggauggcuuacgauugguaucucuggcccagacaacggggccguggcuguccugaaauauaauggaauaauuacugaaaccaucaaguccuggaaaaagagaaucuugaggacacaggagagcgagugcguguguaugaacggcucgugcuuuacuauuaugaccgauggucccucuaauggggccgcguccuacaaaaucuucaagauugaaaagggaaaaguaacaaagucaauagagcucaacgcaccuaguuuucacuaugaagaguguagcugcuacccagacaccggcacgguuaugugugugugccgggauaauuggcacggcuccaaccgccccugggucucuuucaaucagaaccuggacuaccagaucggguauauuugcagcggaguguuuggugauaauccuagaccaaaagacggcgaggggucauguaacccggugacugucgauggagccgacggcguuaaggguuucaguuacaaauaugggaauggcguguggaucggaaggacaaaguccaaccggcugcgcaaaggcuuugaaaugaucugggaccccaauggguggaccaacacugauagcgacuucucuguaaagcaagauguggucgcuauuacagacuggucaggauacagugguagcuuugugcagcauccugagcucaccggcuuagauugcauacgaccauguuucuggguugaacuggugagagggcuucccagggagaauacgaccaucuggacauccggaucuucgauuagcuucugcggcgucaacuccgacacugccaacuggucauggccugauggugcagaauugccauuuaccaucgacaaguga

SEQ ID NO: 144235 - RNA, 1410 nt, Artificial Sequence
  derived and/or modified sequence opt3 from neuraminidase__InfluenzaA__AFJ74640
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcuggguacaggaauuggaguaagccucaguguaacauaacaggauucgcaccauuuagcaaagacaauuccauucggcugucugccgguggcgauaucuggguaacccgcgagcccuaugugucgugcgacccugauaaguguuaccaauucgcgcuagggcagggaacgacucucaacaauguccauucaaacgacaccgugcacgaucgaacaccauaucguacucugcuuaugaaugagcugggcguucccuuucauuuggguaccaaacaggugugcauugcuuggagcaguuccucuugucacgacgggaaggccuggcuccaugucugcgugacaggagaugacgaaaacgcaaccgccagcuucaucuacaauggcagacugguagauuccaucguuucauggaguaagaaaauucugaggacgcaggagagcgaaugugugugcauaaacggcacuuguacagucgugaugaccgacgggucugcuuccggaaaggcagauacuaaaauccucuuuauugaggaggguaagaucgugcacacaucaaccuuaagcggcagugcccaacacgucgaagagugcucuugcuauccucgguacccagggguucgcugugugugcagagacaacuggaagggauccaauaggccgauaguagauauuaacaucaaagacuacagcaucgugucgucuuaugucuguuccggccuggugggugacacgccccggaagaaugauucaaguagcuccucucauugccuugacccuaacaaugaagaagggggacacggcguuaaaggcugggcuuucgaugacgggaacgauguguggaugggacgcaccauuagcgagaaguugcgaucagguuacgagacauuuaaagucaucgagggcuggaguaauccaaacuccaagcugcagauuaauagacaggugauaguagacaaagggaacaggagcggauauucuggcaucuucucaguugaagguaagaguuguauuaaucggugcuuuuacguggagcuaauccgugggcgcaagcaggaaacugagguccucuggaccagcaacuccaucguggucuucuguggcacaucuggaacuuauggcaccgggucguggcccgauggagccgacauuaaucugaugccuauauga

SEQ ID NO: 144236 - RNA, 1413 nt, Artificial Sequence; identical to SEQ ID NO: 144234
  derived and/or modified sequence opt3 from neuraminidase__InfluenzaA__AFJ74659

SEQ ID NO: 144237 - RNA, 1413 nt, Artificial Sequence
  derived and/or modified sequence opt3 from neuraminidase__InfluenzaA__AFJ74679
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgagaauaacaccugggugaaucacacauaugucaacaucaauaacacuaauguuguggcagggaaagacaagaccucuguaacacuugccggaaacucgucacuguguagcauuaguggcugggcgaucuacaccaaagauaauuccaucaggauugguucuaagggggacguguucgucauacgggaaccuuuuaucagcugcucccauuuggagugucgcacuuucuuuuuaacacaaggagcucugcuaaacgauaaacacucaaauggcaccgugaaggaccgaaguccauaucgugcccucaugagcugcccgcugggcgaagcacccucuccuuacaacuccaaguucgagucaguugccuggagcgcuagugcaugucaugaugggaugggauggcuuacgauugguaucucuggcccagacaacggggccguggcuguccugaaauauaauggaauaauuacugaaaccaucaaguccuggaaaaagagaaucuugaggacacaggagagcgagugcguguguaugaacggcucgugcuuuacuauuaugaccgauggucccucuaauggggccgcguccuacaaaaucuucaagauugaaaagggaaaaguaacaaagucaauagagcucaacgcaccuaguuuucacuaugaagaguguagcugcuacccagacaccggcacgguuaugugugugugccgggauaauuggcacggcuccaaccgccccugggucucuuucaaucagaaccuggacuaccagaucggguauauuugcagcggaguguuuggugauaauccuagaccaaaagacggcgaggggucauguaacccggugacugucgauggagccgacggcguuaaggguuucaguuacaaauaugacaaugggguguggaucggcaggacaaaguccaaccggcugcgcaaaggauuugaaaugaucugggaucccaauggcuggaccaacacugacagcgauuucucuguaaagcaagacguggucgcuauuacagauuggucaggguacagugguagcuuugugcagcauccugagcucaccggauuagacugcauacgaccauguuucuggguugaacuggugagaggccuucccagggagaauacgaccaucuggacauccgggucuucgauuagcuucugcggagucaacuccgauacugccaacuggucauggccugacggcgcagaauugccauuuaccaucgauaaguga

SEQ ID NO: 144238 - RNA, 1410 nt, Artificial Sequence
  derived and/or modified sequence opt3 from neuraminidase__InfluenzaA__AFJ74680
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuauacugugugaaccgacuaucauugagagaaauaucaccgaaauuguguauuugacaaacaccacuaucgagaaggaaauaugccccaaauuagcugaguacaggaauuggaguaagccucaguguaacauuacaggguucgcaccauuuagcaaagacaauuccauccggcugucugccggaggugauauuuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcaucgcuuggagcaguuccucuugucacgacgguaaggccuggcuccaugucugcgugacaggggaugacgagaacgcaaccgccagcuucaucuacaauggaagacugguagauuccauuguuucauggaguaagaaaauacugaggacgcaggaaagcgagugugugugcaucaacggcacuuguacagucgugaugaccgacggcucugcuuccgggaaggcagauacuaaaauucucuuuaucaaggagggaaagauagugcacacaucaaccuuaagcgguagugcccaacacgucgaagagugcucuugcuauccucgguacccaggcguucgcugugugugcagagacaacuggaaaggguccaauaggccgauuguagauaucaacaucaaggacuacagcauugugucgucuuaugucuguuccggacuggugggcgacacgccccggaaaaaugauucaaguagcuccucucauugccuugacccuaacaaugaagagggugggcacggaguuaagggcugggcuuucgaugacggcaacgauguguggauggggcgcaccaucagcgaaaaauugcgaucaggauacgagacauuuaaggucauugaggguuggaguaauccaaacuccaaacugcagauaaauagacaggugaucguagacaggggcaaccggagcggguauucuggaauuuucucaguugaaggcaagaguuguaucaaucguugcuuuuacguggagcuaauccgcgguagaaagcaggaaacugagguccucuggaccagcaacuccauuguggucuucugugggacaucuggcacuuauggaaccggcucguggcccgauggggccgacauaaaucugaugccuaucuga

SEQ ID NO: 144239 - RNA, 1410 nt, Artificial Sequence
  derived and/or modified sequence opt3 from neuraminidase__InfluenzaA__AFJ74701
augaaccccaaucagaagaucauuaccauaggcagcgugucccugacaaucgccacuauuugcuuccucaugcaaaucgcuauucuugucacgaccguuacacugcacuuuaaccaguacgaguguaauucuccuccaaacaaucaggugauguugugcgaaccgacuaucauagagagaaacaucaccgaaauuguauauuuaacaaauaccacuaucgagaaagaaauuugucccaagcuggcagaguacaggaucuggucaaaaccucagugcaacauaacaggguucgccccauuuaguaaggacaauagcauucggcuauccgcgggaggugauaucugggugacccgcgagcccuaugucucuugugacccugauaaaugcuaccaauucgcucucggccaggggacgacucugaacaauggacauucgaacgacaccgugcacgaucgaacaccauaucguacucuucugaugaaugaauugggcguucccuuucaucucgguaccagacagguguguauggccuggucaagcaguuccugccacgacgggaaggcauggcugcaugucugugugacaggagaugacgagaacgccaccgcuucuuucauuuacaauggcaggcugguagauagcaucggcuccuggucaaagaaaauccuccggacgcaggaaagugagugcguuuguauuaacgggacuugcacaguggucaugaccgacggaagcgcaucugguaaggccgauacuaaaauauuauuuaucgaggaaggcaagauugugcacaucuccacacugucagggagcgcucaacacguggaggaaugcaguuguuauccucgcuacccaggagucagaugcguuuguagggacaacuggaaaggcucuaaucggccgauaguggauauuaacguaaaggacuacuccaucgugagcucguaugucugcucuggucuugugggggacacgccccgcaagaaugauuccuucucaaguagccauuguuuggacccuaacaaugaggaaggaggccacggcguuaaagggugggccuuugaugacggaaacgauguguggaugggucgaaccaucuccgagaagcugagaucuggcuacgagaccuucaaagucauugaaggguggagcaagccaaauucaaaacuacaggugaacaggcagguaaucguugagcggggaaaucguaguggcuauuccgguauuuuuagcguggaagggaagucuugcauaaaccgcuguuucuacgucgagcucaucagaggcaggaaagaagagacagaggugugguggacuucaaauaguauugucguguuuugcggaaccagcggcacauaugggacuggauccuggcccgacggugcggauaucaaccugaugccuaucuga

SEQ ID NO: 144240 - RNA, 1410 nt, Artificial Sequence
  derived and/or modified sequence opt3 from neuraminidase__InfluenzaA__AFJ74731
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacgagaacgcaaccgccagcuucaucuacaauggaagacugguagauuccaucguuucauggaguaagaaaauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaccgauucaaguagcuccucucauugccuugacccuaauaacgaggaaggugggcacggaguuaaaggcugggcuuucgaugacggcaaugauguguggauggggcgcacaauuagcgagaaguugcgaucaggauacgagacuuuuaaagucaucgaagguuggaguaacccaaauuccaagcugcagauuaacagacaggugauaguagacaggggcaaucggagcggguauucuggaaucuucucaguugagggcaaaaguuguauuaaccguugcuuuuacguggaacuaauccgcgguagaaaucaggagaccgaaguccucuggacaagcaacuccaucguggucuucugugggacuucuggcaccuauggaacaggcucguggcccgauggggccgagauuaaucugaugccuauauga

SEQ ID NO: 144241 - RNA, 1413 nt, Artificial Sequence; identical to SEQ ID NO: 144234
  derived and/or modified sequence opt3 from neuraminidase__InfluenzaA__AFJ74766

SEQ ID NO: 144242 - RNA, 1410 nt, Artificial Sequence
  derived and/or modified sequence opt3 from neuraminidase__InfluenzaA__AFJ74767
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacgagaacgcaaccgccagcuucaucuacaauggaagacugguagauuccaucguuucauggaguaagaaaauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccaaacuccaagcugcagauuaauagacaggugauaguagacaggggcaaccggagcggguauucuggaaucuucucaguugagggcaaaaguuguauuaaucguugcuuuuacguggaacuaauccgcgguagaaaccaggagacugaaguccucuggaccagcaauuccaucguggucuucugugggacaucuggcacuuauggaaccggcucguggcccgauggggccgacauuaaccugaugccuauauga

SEQ ID NO: 144243 - RNA, 1410 nt, Artificial Sequence; identical to SEQ ID NO: 144242
  derived and/or modified sequence opt3 from neuraminidase__InfluenzaA__AFJ74783

SEQ ID NO: 144244 - RNA, 1410 nt, Artificial Sequence; identical to SEQ ID NO: 136161
  derived and/or modified sequence opt3 from neuraminidase__InfluenzaA__AFJ74807

SEQ ID NO: 144245 - RNA, 1410 nt, Artificial Sequence; identical to SEQ ID NO: 136161
  derived and/or modified sequence opt3 from neuraminidase__InfluenzaA__AFJ74822

SEQ ID NO: 144246 - RNA, 1410 nt, Artificial Sequence; identical to SEQ ID NO: 136730
  derived and/or modified sequence opt3 from neuraminidase__InfluenzaA__AFJ74834

SEQ ID NO: 144247 - RNA, 1410 nt, Artificial Sequence; identical to SEQ ID NO: 136161
  derived and/or modified sequence opt3 from neuraminidase__InfluenzaA__AFJ74845

SEQ ID NO: 144248 - RNA, 1413 nt, Artificial Sequence
  derived and/or modified sequence opt3 from neuraminidase__InfluenzaA__AFJ75039
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaacaauacauaugucaacaucaauaacacuucgguuguggcagagaaagacaagaccucaguaacacuugccgggaauagcagucuguguuccauuucuggaugggcgaucuacaccaaagauaacagcaucaggauuggcuccaagggugacguguucgucauacgggagccuuuuaucucaugcagucacuuggaaugucgcacuuucuuuuuaacacaaggggcucugcuaaaugauaaacauagcaacggaaccgugaaggaccgaucuccauaucgugcccucauguccugcccgcugggcgaggcacccucaccuuacaauagcaaguucgaaaguguugccuggucugcuuccgcaugucacgauggcaugggguggcuuacgauuggaaucagcgguccagacaacggcgccguggcuguccugaaauauaacgggauaauuacugagaccaucaagucguggaaaaagagaaucuugaggacacaggagucugaaugcguguguaugaauggauccugcuuuacuauuaugaccgauggccccucaaacgguggggccaguuacaaaaucuucaagauugagaagggaaaaguaacaaagagcauagaacucaaugcgccuaacuuucauuaugaggaguguuccugcuacccagacaccggcacgguuaugugugugugccgggauaauuggcacggcucuaaccgccccugggucagcuucaaucagaaccuggacuaccagaucggguauauuugcucaggaguguuuggugauaauccuagaccaaaagacggcgaagggaguuguaacccggugacuaucgauggagcagacggcgucaaggguuucuccuacaaauaugggaauggcguuuggaucggaaggacaaagagcaaccggcugcgcaaaggcuuugagaugauuugggaccccaauggguggaccaacacugauucugacuucucagugaagcaagauguaguggccauaacagacuggaguggauacagcgguuccuuuguccagcacccugaacucaccggcuuagauugcauccgaccauguuucuggguggagcugguuagagggcuucccagggaaaauacgaccauuuggacaucuggaucgagcaucuccuucugcggcgugaacucagacacugcuaacuggaguuggccugauggugccgaguugccauuuaccauugacaaguga

SEQ ID NO: 144249 - RNA, 1410 nt, Artificial Sequence
  derived and/or modified sequence opt3 from neuraminidase__InfluenzaA__AFJ75050
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccguacggcugucugccggaggugauauuugggugacccgcgagcccuaugucucgugcgacccugauaaguguuaccaauucgcgcuaggccaggggacgacucucaacaaugugcauucaaacgacaccguucacgaucgaacaccauaucguacucugcuuaugaaugaacugggagugcccuuucauuugggcaccaagcaggucugcaucgcuuggagcaguuccucuugucacgacgguaaagccuggcuccaugugugcguaacaggggaugacaagaacgcaaccgccagcuucauuuacaauggaagacugguugauuccaucgugucauggaguaaagagauccugaggacgcaggaaagcgagugugucugcauuaacggcacuuguacaguggugaugaccgacggcucugcuuccgggaaggcagauacuaaaauacucuuuaucgucgagggaaagauuguucacacaucagccuuaagcgguagugcucaacacguggaagagugcucuugcuauccucgguacccaggcguacgcugugugugcagagacaacuggaagggguccaauaggccgaucgucgauauaaacauuaaagacuacagcaucgugucgucuuauguuuguuccggacuggugggcgacacgccccggaagaaugauucaaguagcuccucucauugccuugacccuaacaaugaagagggugggcacggagucaaaggcugggccuucgaugacggcaacgauguguggauggggcgcaccaucagcgaaaaguugcgaucaggauacgagaccuuuaaaguaauugaggguuggaguaauccaaacuccaagcugcagaucaauagacagguuauuguggacaggggcaaccggagcggguauucuggaauauucucagucgaaggcaaaaguuguaucaaucguugcuuuuacguggagcuaauucgcgguagaaaggaagagacagaaguccucuggacuagcaacuccaucgugguuuucugugggaccucuggcacauauggaacuggcucguggcccgauggggcggacaucaaucugaugccuauuuga

SEQ ID NO: 144250 - RNA, 1410 nt, Artificial Sequence
  derived and/or modified sequence opt3 from neuraminidase__InfluenzaA__AFJ75094
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagaagaauauuaccgaaaucguguauuugacaaacaccacuauugagaaagaaaucugccccaaguuagcugaguacagaaauuggaguaaaccucagugugacauaacaggguucgcaccauuuagcaaggauaacuccauuaggcugucugccggaggugacaucuggguaacccgggagcccuaugugucgugcgauccugacaaguguuaccaauucgcgcuaggccaggggacgacucucaauaacguccauucaaaugauaccgugcgcgaccgaacaccauaucguacucugcuuaugaacgaacugggaguucccuuucacuugggcaccaaacaggugugcauugcuuggagcaguuccucuugucaugaugguaaggccuggcuccacgucugcaucacaggggacgauaaaaaugcaaccgccagcuucaucuacaacggaagacugguggacuccauuguaucauggaguaaggagauacugaggacgcaggaaagcgaguguguuugcaucaauggcacuuguacaguggucaugaccgauggcucugcuuccgggaaagcagacacuaagauucucuuuaucgaggaaggaaagauagugcauacaucaaccuuaagcgguagugcccaacacguggaggaaugcucuugcuauccucgguacccaggcguccgcuguguuugcagagauaacuggaaaggguccaacaggccgauuguggacaucaauaucaaggaccacagcauuguaucgucuuacguguguuccggacuggucggcgauacgccccggaaaaacgacucaaguagcuccucuaauugccuugauccuaacaaugaggaaggugggcauggagugaagggcugggcuuucgacgauggcaacgacguuuggauggggcgcaccaucagcgagaaaucacgauugggauaugagacauuuaaggugauugaagguuggaguaauccaaacuccaaacugcagauaaauagacaggucaucguggauaggggcaaccggagcggguacucuggaauuuucucaguagagggcaagaguuguaucaaucguugcuuuuauguugaacuaauccgcgguagaaaggaggaaauugaggugcucuggacuagcaacuccauagucguguucugugggaccucuggcacauacggaacuggcucguggcccgacggggccgauaucaauauuaugccuaucuga

SEQ ID NO: 144251 - RNA, 1413 nt, Artificial Sequence
  derived and/or modified sequence opt3 from neuraminidase__InfluenzaA__AFJ75104
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccccuguaacacuugccggaaauucgucacuguguagcauuaguggcugggcgauccauaccaaagauaacuccaucaggauugguucuaagggggacguguucgucauacgggagccauuuaucagcugcucccacuuggaguguaaaacuuucuuuuuaacacaaggagcucugcuaaaugauaagcauucaaacggcaccgugaaggaccgcaguccguaccgagcccucaugagcugcccccugggcgaagcaccuucuccauauaauuccaaauucgagucaguugccuggagcgcuagugcaugucacgaugggauuggauggcuuacgaucgguauaucuggccccgacaacggggccguggcuguccugaaguacaacggaauuaucacuggcaccaucaaauccuggaagaaacagauuuugcguacacaggaaagcgagugcguguguaugaaugguucgugcuuuacuaucaugaccgaugggccuucuaacggagccgcguccuauaagauuuucaagauagagaaaggcaagguaacaaaaucaauggaacucaaugcaccaaacuuucacuacgaggaauguaguugcuaucccgacaccggcacgguuaugugugugugcagagauaauuggcaugggagcaacaggccuugggucuccuucaaucagaaccuggacuaccaaaucggauacauuugcucugguguguuuggcgauaauccacggccggaggacggggagggaagcuguaaccccgugacugucgauggcgccaaugguguuaagggguucucauauaaauacggcaacggaguguggaucggccgcacaaagaguaauagaaucaggaaaggguuugaaaugauuugggacccuaacggauggaccaauacugacuccgauuucagcguaaagcaggacauaguggcuaucacagauuggucugguuauucaggcaguuuuguccagcacccagagcugaccgggcucgacugcauucggcccuguuucuggguggaauuaguucgcggacugccucgagagaacacgaccaucuggacaagcggcuccucuauuucguucugcggugugaacagcgauaucgccaauugguccuggccagacggggcagaacuucccuuuacuauagauaaguga

SEQ ID NO: 144252 - RNA, 1410 nt, Artificial Sequence; identical to SEQ ID NO: 137900
  derived and/or modified sequence opt3 from neuraminidase__InfluenzaA__AFJ75114

SEQ ID NO: 144253 - RNA, 1410 nt, Artificial Sequence; identical to SEQ ID NO: 137900
  derived and/or modified sequence opt3 from neuraminidase__InfluenzaA__AFJ75452

SEQ ID NO: 144254 - RNA, 1410 nt, Artificial Sequence; identical to SEQ ID NO: 137900
  derived and/or modified sequence opt3 from neuraminidase__InfluenzaA__AFJ75463

SEQ ID NO: 144255 - RNA, 1413 nt, Artificial Sequence; identical to SEQ ID NO: 144251
  derived and/or modified sequence opt3 from neuraminidase__InfluenzaA__AFJ75552

SEQ ID NO: 144256 - RNA, 1413 nt, Artificial Sequence
  derived and/or modified sequence opt3 from neuraminidase__InfluenzaA__AFJ75574
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccccuguaacacuugccggaaauucgucacuguguagcauuaguggcugggcgauccauaccaaagauaacuccaucaggauugguucuaagggggacguguucgucauacgggagccauuuaucagcugcucccacuuggaguguaaaacuuucuuuuuaacacaaggagcucugcuaaaugauaagcauucaaacggcaccgugaaggaccgcaguccguaccgagcccucaugagcugcccccugggcgaagcaccuucuccauauaauuccaaauucgagucaguugccuggagcgcuagugcaugucacgaugggauuggauggcuuacgaucgguauaucuggccccgacaacggggccguggcuguccugaaguacaacggaauuaucacuggcaccaucaaauccuggaagggucagauuuugcguacacaggaaagcgagugcguguguaugaaugggucgugcuuuacuaucaugaccgauggaccuucuaacggcgccgcguccuauaaaauuuucaagauagagaagggcaaaguaacaaagucaauggaacucaaugcaccaaacuuucacuacgaggaauguaguugcuaucccgacaccgggacgguuaugugugugugcagagauaauuggcauggaagcaacaggccuugggucuccuucaaucagaaccuggacuaccaaaucgguuacauuugcucuggcguguuuggggauaauccacggccggaggacggagagggcagcuguaaccccgugacugucgauggugccaaugggguuaaaggcuucucauauaaguacggaaacggcguguggaucgggcgcacaaaaaguaauagaaucaggaagggauuugaaaugauuugggacccuaacgguuggaccaauacugacuccgauuucagcguaaaacaggacauaguggcuaucacagauuggucuggcuauucagggaguuuuguccagcacccagagcugaccggacucgacugcauucggcccuguuucuggguggaauuaguucgcggccugccucgagagaacacgaccaucuggacaagcgguuccucuauuucguucugcggggugaacagcgauaucgccaauugguccuggccagacggcgcagaacuucccuuuacuauagauaaguga

SEQ ID NO: 144257 - RNA, 1410 nt, Artificial Sequence; identical to SEQ ID NO: 137900
  derived and/or modified sequence opt3 from neuraminidase__InfluenzaA__AFJ75585

SEQ ID NO: 144258 - RNA, 1410 nt, Artificial Sequence
  derived and/or modified sequence opt3 from neuraminidase__InfluenzaA__AFJ75596
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaauuagcugaguacaggaauuggaguaagccucagugugggaucaccggauucgcaccauuuagcaaagacaacuccauacggcugucugccgguggcgauauuuggguaacgcgcgagcccuaugugucgugcgacccugauaaguguuaccaauucgcgcuagggcagggaacuacccucaauaacguccauucaaauaacacagugcgagaccguacuccauauagaacccugcuuaugaaugaacugggcguucccuuucacuuggguacaaaacaggugugcaucgcuuggagcaguuccucuugucaugaugggaaggccuggcuccacgucugcauuaccggagacgauaagaacgcaacggccagcuucaucuacaauggcaggcugguggacuccaucguaucauggaguaaagagauucugcggacucaggaaagcgaguguguuugcauaaacggcacauguaccguggucaugacugaugggucugcuuccggaaaggcagacacaaaaauccucuuuauugaggaagguaagaucgugcauaccucaacguuaagcggcagugcccaacacguggaggaaugcucuugcuauccucgcuacccaggggucagauguguuugcagggauaacuggaagggauccaaucggccgauaguggacauuaacaucaaagaucacagcaucguaucgucuuacguguguuccggccuggucggugacacaccccgcaagaaugacucaaguagcuccucucauugccuugauccuaacaaugaggaagggggacacggcgugaaaggcugggcuuucgacgaugggaacgacguuuggaugggacgaaccauuagcgagaagucaagauuggguuaugagacuuuuaaagugaucgaaggcuggaguaauccaaaguccaaacugcagauuaacaggcaggucauaguggaucgggggaaucguagcggauacucuggcaucuucucaguagaggguaagaguuguauuaaccgcugcuuuuauguugaacuaaucagagggaggaaggaggaaaccgaggugcucuggacaagcaauuccaucgucguguucuguggcacuucuggaaccuacggcacagggucguggcccgacggagccgauauuaaccugaugccuauauga

SEQ ID NO: 144259 - RNA, 1410 nt, Artificial Sequence
  derived and/or modified sequence opt3 from neuraminidase__InfluenzaA__AFJ75607
augaaccccacccagaagaucauuacaauaggcagcgugucccugacuaucucuacgauuugcuucuuuaugcaaaccgccauccucauuacaacugucacccuucacuucaaacaguacgaguuuaauucaccuccaaacaaucagguuaugcugugugaaccgacaaucauagagagaaacaucaccgaaauuguguauuugacuaauacaaccaucgagaaggaaauuugccccaaauuagcugaguacaggaacuggaguaagccucagugugacaucacgggguucgcaccauuuagcaaagauaauuccauacggcugucugccggaggugacauuuggguaacucgcgagcccuaugugucgugcgauccugaaaaguguuaccaauucgcgcuaggccaggggaccacacucaacaauguccauucaaacaauacugugcgagaccguaccccauauagaacacugcuuaugaacgagcugggaguucccuuucacuugggcaccaaacaggugugcaucgcuuggagcaguuccucuugucaugaugguaaggccuggcuccacgucugcauuacgggggacgauaagaaugcaacugccagcuucaucuacaacggaaggcugguggacuccaucguaucauggaguaaagaaauucugcggacacaggagagcgaguguguuugcauaaauggcaccuguacuguggucaugacagauggcucugcuuccgggaaggcagacaccaaaauccucuuuauugaagagggaaagaucgugcauacgucaaaguuaagcgguagugcccaacacguggaagagugcucuugcuauccucgcuacccaggcgucagauguguuugcagggauaacuggaaaggguccaaccggccgauaguggacauuaauaucaaggaucacagcaucguaucgucuuacguguguuccggacuggucggcgacacaccccgcaaaaacgacucaagugguagcucccauugccuugauccuaauaacgaagaagggggacacggcgugaagggcugggcuuucgacgaugggaaugacguuuggaugggacgaaccauuucugagaaaagcagauuggguuaugagacuuuuaaggugaucgagggcuggucaaacccaaaaaguaagcugcagauuaauaggcaggucauaguggaucgggggaaccguuccggauacagcggcaucuucucuguagaagguaagucauguauuaaucgcugcuuuuauguugagcuaaucagagggaggaaagaagagaccgaggugcucuggacaaguaacagcaucgucguguucuguggcacuuccggaaccuacggcacagggucuuggcccgacggagccgauauuaaucugaugccuauauga

SEQ ID NO: 144260 - RNA, 1410 nt, Artificial Sequence
  derived and/or modified sequence opt3 from neuraminidase__InfluenzaA__AFJ75633
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagauauucugcggacgcaggagagcgaaugugugugcauaaauggcacuuguacagucgugaugaccgacggcucugcuuccgggaaggcagauacuaaaauccucuuuauugaggagggaaagaucgugcauacaucaaccuuaagcgguagugcccaacacgucgaagagugcucuugcuauccucgcuacccaggcguuagaugugugugcagggacaacuggaagggguccaaccggccgauaguagacauuaauaucaaaaaccacagcaucgugucgucuuacgucuguuccggacuggugggcgauacgccccgcaagaaugacucaaguagcuccucucauugccuugauccuaacaaugaagagggugggcacggaguuaaaggcugggcuuucgacgauggcaacgacguguggauggggcgaaccauuagcgaaaagucaagauugggauaugagacauuuaaagucaucgaggguuggaguaauccaaaguccaaacugcagauuaacaggcaagugauaguagaucggggcaaucguagcggguacucuggaaucuucucaguugaaggcaagaguuguauuaaccgcugcuuuuauguggagcuaaucagagguaggaaggaagagacugaaguccucuggaccagcaauuccaucguggucuucugugggacaucuggcacuuacggaaccggcucguggcccgacggggccgauauuaaccugaugccuauauga

SEQ ID NO: 144261 - RNA, 1413 nt, Artificial Sequence; identical to SEQ ID NO: 139477
  derived and/or modified sequence opt3 from neuraminidase__InfluenzaA__AFJ75654

SEQ ID NO: 144262 - RNA, 1410 nt, Artificial Sequence; identical to SEQ ID NO: 137900
  derived and/or modified sequence opt3 from neuraminidase__InfluenzaA__AFJ75665

SEQ ID NO: 144263 - RNA, 1413 nt, Artificial Sequence
  derived and/or modified sequence opt3 from neuraminidase__InfluenzaA__AFJ75676
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccccuguaacacuugccggaaauucgucacuguguagcauuaguggcugggcgauccauaccaaagauaacuccaucaggauugguucuaagggggacguguucgucauacgggagccauuuaucagcugcucccacuuggaguguaaaacuuucuuuuuaacacaaggagcucugcuaaaugauaagcauucaaacggcaccgugaaggaccgcaguccguaccgagcccucaugagcugcccccugggcgaagcaccuucuccauauaauuccaaauucgagucaguugccuggagcgcuagugcaugucacgaugggauuggauggcuuacgaucgguauaucuggccccgacaacggggccguggcuguccugaaguacaacggaauuaucacuggcaccaucaaauccuggaagaaacagauuuugcguacacaggaaagcgagugcguguguaugaaugguucgugcuuuacuaucaugaccgaugggccuucuaacggagccgcguccuauaagauuuucaagauagagaaaggcaagguaacaaaaucaauggaacucaaugcaccaaacuuucacuacgaggaauguaguugcuaucccgacaccggcacgguuaugugugugugcagagauaauuggcaugggagcaacaggccuugggucuccuucaaucagaaccuggacuaccaaaucggauacauuugcucugguguguuuggcgauaauccacggccgaaggacggggagggaagcuguaaccccgugacugucgauggcgccaaugguguuaaaggguucucauauaaguacggcaacggaguguggaucggccgcacaaaaaguaauagaaucaggaagggguuugagaugauuugggacccuaacggauggaccaauacugacuccgauuucagcguaaagcaggacauaguggcuaucacagauuggucugguuauucaggcaguuuuguccagcacccagaacugaccgggcucgacugcauucggcccuguuucuggguggaguuaguucgcggacugccucgagaaaacacgaccaucuggacaagcggcuccucuauuucguucugcggugugaacagcgauaucgccaauugguccuggccagacggggcagagcuucccuuuacuauagauaaauga

SEQ ID NO: 144264 - RNA, 1413 nt, Artificial Sequence; identical to SEQ ID NO: 139477
  derived and/or modified sequence opt3 from neuraminidase__InfluenzaA__AFJ75687

SEQ ID NO: 144265 - RNA, 1410 nt, Artificial Sequence; identical to SEQ ID NO: 138754
  derived and/or modified sequence opt3 from neuraminidase__InfluenzaA__AFJ76122

SEQ ID NO: 144266 - RNA, 1410 nt, Artificial Sequence; identical to SEQ ID NO: 143332
  derived and/or modified sequence opt3 from neuraminidase__InfluenzaA__AFJ76134

SEQ ID NO: 144267 - RNA, 1410 nt, Artificial Sequence; identical to SEQ ID NO: 138754
  derived and/or modified sequence opt3 from neuraminidase__InfluenzaA__AFJ76146

SEQ ID NO: 144268 - RNA, 1410 nt, Artificial Sequence; identical to SEQ ID NO: 138754
  derived and/or modified sequence opt3 from neuraminidase__InfluenzaA__AFJ76159

SEQ ID NO: 144269 - RNA, 1410 nt, Artificial Sequence; identical to SEQ ID NO: 138754
  derived and/or modified sequence opt3 from neuraminidase__InfluenzaA__AFJ76173

SEQ ID NO: 144270 - RNA, 1410 nt, Artificial Sequence; identical to SEQ ID NO: 138754
  derived and/or modified sequence opt3 from neuraminidase__InfluenzaA__AFJ76191

SEQ ID NO: 144271 - RNA, 1413 nt, Artificial Sequence
  derived and/or modified sequence opt3 from neuraminidase__InfluenzaA__AFJ76192
augaaccccaaucagaagaucauuaccauaggcagcaucuccauugccaucgggauuaucucucugauggugcaaauaggaaacaucauuucaaucugggcuagucacagcauucagacagguauccagaauaacacuggcauaugcaaucagagaauuaucacguacgagaacuccaccugggucaaucauacauauguuaacauuaauaacacuaaugugguagcaggggaagacaaaaccucugugacacucgccggaaacucgucacuuuguagcaucaguggcugggcgaucuacaccaaggauaauuccauuaggauagguucuaaaggggacgucuucgugauccgggagccuuuuauuagcugcucccaccuggaaugucgcacuuucuuuuugacacaaggagcuuuacugaacgauaagcauucaaauggcaccguuaaagaccgaaguccauaucgugcccuaaugagcugcccgcucggcgaggcacccucuccuuacaacuccaaguucgaaucaguggccuggagcgcuagugcaugucacgaugggaugggauggcugacgaucgguauaucuggcccagacaacggggccgucgcugugcuuaaguauaauggaauuaucacuggcaccaucaaauccuggaagaaacagauucugagaacacaggagagcgagugcguauguaugaacgguucgugcuuuacuaucaugaccgaugggcccucuaauaaggccgcguccuacaaaauuuucaagauagaaaagggaaaaguuacaaagucaaucgaguugaacgcaccuaauuuuuauuacgaagaguguaguugcuacccagacaccggcauugugaugugugucugcagggauaacuggcauggcagcaaucggcccuggguguccuucaaccagaaucucgacuaucaaaucggguacaucugcucuggaguguuuggugauaacccucgcccagaggacggcgaagggagcuguaauccggucacgguugauggagccaacggcgugaaagguuucucauauaaguacgggaauggcguauggauuggaagaacuaaaaguaacaggcugcggaagggcuuugagaugauaugggaccccaauggguggacaaacaccgacuccgauuucagcgugaaacaggacgucguggcuaucacugauuggucuggauauucagguaguuuuguucagcacccugaacugacaggccucgacugcauucgcccauguuucuggguggaguuaguccgagggcugcccagagaaaacaccacgaucuggaccagcggauccucuauuucguucugcggcgugaauagcgauacagccaacugguccuggccugacggugcagagcuuccauuuacuaucgauaaguga

SEQ ID NO: 144272 - RNA, 1410 nt, Artificial Sequence; identical to SEQ ID NO: 138754
  derived and/or modified sequence opt3 from neuraminidase__InfluenzaA__AFJ76206

SEQ ID NO: 144273 - RNA, 1410 nt, Artificial Sequence
  derived and/or modified sequence opt3 from neuraminidase__InfluenzaA__AFJ76216
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauaaagagaaauaucaccgagauuguauacuuaacaaacaccacuaucgaaaaagagauuugucccaagcuggcagaauauaggaauuggucaaaaccucagugcaacaucacaggguucgccccauuuaguaaggacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaucgaacaccauaccguacucuucugaugaaugaguugggcguucccuuucaccucgguaccagacagguguguaucgccuggucaagcaguuccugccaugacgggaaagcauggcugcacgucugugugacaggagaugacaagaacgccaccgcuucuuucauuuauaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaagagggcaagauugugcacaucuccacacugucagggagcgcucaacauguggaggaaugcaguuguuacccucgcuauccaggagucagaugcguuuguagggacaacuggaaaggcucuaaucggccgauaguggauauuaacguaaaggacuacuccaucgugagcucguacgucugcucuggucuugugggggacacccccaggaaaaaugauuccuucucaaguagccacuguuuggacccuaacaaugaggaaggaggccauggcguuaaggggugggccuuugaugacggaaacgauguguggaugggucgaacgaucuccgagaaacugagaucuggcuaugaaaccuucaaggucauugagggguggagcaaaccaaauucaaagcuacagaucaaccgccaggugauuguagagcggggaaaucguaguggcuacuccgguauauuuagcguugaagggaagucuugcaucaaccgcuguuucuauguggagcucauuagaggcaggaaagaagagacagaagucugguggacuucaaauaguaucguggucuuuugcggaaccagcggcacauacgggacuggauccuggcccgacggugcggauaucaaccugaugccuauuuga

SEQ ID NO: 144274 - RNA, 1410 nt, Artificial Sequence
  derived and/or modified sequence opt3 from neuraminidase__InfluenzaA__AFJ77411
augaaccccaaucagaagaucauuaccauaggcagcgugucccugacaaucgccacuauuugcuuccucaugcaaaucgucauucuuguuacgaccgugacacugcacuuuaaacaguacgaguguaacucuccuccaaauaaccagguaauguugugcgaaccgacuaucauagagagaaauaucaccgaaauuguguauuuaacaaacaccacuaucgagaaggaaauuugucccaaacuggcugaguacaggaauuggucaaagccucagugcaaaaucacaggguucgcaccauuuaguaaggacaacagcauacggcuauccgccggaggugauauuugggucacccgcgagcccuaugugucuugugacccuggcaagugcuaccaauucgcgcucgggcagggaacgacucugaauaaccgacauucgaaugauaccguucacgaccguacaccauauagaacucuucugaugaacgaauugggcgugcccuuucaucucgguaccaaacaggucuguaucgcuuggucaagcaguuccugccacgaugggaaggccuggcugcauguguguguaacaggacacgacgagaaugcaaccgccucuuucauuuacgauggcaggcugguugacagcaucggcuccuggaguaaaaacauccuccggacgcaggaaucagagugcguguguauuaaugggacuugcacagucgugaugaccgauggaagcgcuucugagcgcgcagacacuaagauauuauuuaucgaagaggguaaaauugugcacaucuccccucugucaggcagcgcccaacaugucgaagagugcaguuguuauccaagauacccggggguuaggugcgugugucgggauaacuggaagggaucuaaccgccccauaguagacauuaaugugaaggauuacuccaucgucagcucguaugugugcucuggccuuguuggugacacaccucgaaagaacgacuccucaaguagcuccuacuguuugaauccaaacaaugaagaagggggacacggcgugaaaggcugggcuuucgaugacgggaacgaugucuggaugggaagaaccaucucugagaaacugaggagcgguuaugagacguuuaaggugauuggcggguggucaaaacccaauaguaagcuacagaucaaccggcagguaauuguugaccguggaaaucgcuccggcuacagcgguauauucucuguggaggggaaaucaugcgucaacagauguuuuuauguggaacucaucaggggccggaagcaggagaccgaagucugguggacaaguaauagcauugugguuuucugcggaacuuccggcaccuacgggacaggaucuuggccugauggugccgacaucaaccugaugccaaucuga

SEQ ID NO: 144275 - RNA, 1410 nt, Artificial Sequence
  derived and/or modified sequence opt3 from neuraminidase__InfluenzaA__AFJ77422
augaaccccaaucagaagaucauuaccauaggcagcgugucccugacaaucgccacuauuugcuuccucaugcaaaucgcuauucuugucaucacgguuacccugcacuuuaaacaguacgaguguaacucuccuccaaauaaccaggugauguugugcgaaccgacaauaaucgagagaaauauuacugaaaucguauauuuaaccaacacaaccauugagaaggaaaucugucccaaacuggcagaguacaggaauuggucaaagccucagugcaaaauaacuggguucgccccauuuaguaaggacaacagcauucggcuauccgcgggaggugauaucugggugacacgcgagcccuaugucucuugugacccugauaagugcuaccaauucgcucucggccaggggaccacgcugaauaaccgacauucgaaugacacugugcacgaucguaccccauauagaacacuucugaugaacgaauugggaguucccuuucaucucggcacuaaacagguguguauugccuggucaagcaguuccugccacgacgguaaggcauggcugcaugucugugugaccgggcacgaugagaaugccacagcuucuuucaucuacgacggaaggcugguagauagcaucggcuccuggaguaaaaagauucuccggacccaggaaucagagugcguuuguauaaacggcacgugcacuguggucaugacagacgggagcgcaucuggacgcgccgauaccaaaaucuuauuuauugaggaagguaagaucgugcacauauccccucugucaggcagcgcucaacauguggaggaaugcaguuguuauccaagauacucuggggucaggugcguuugucgggacaauuggaagggauccaaccgcccgauuguggauaucaacguaaaagacuacagcaucgugucgucuuucgucugcuccggccuugugggugacacuccccgaaagaaugauucaaguagcuccucucacuguuugaacccuaauaacgaggaagggggacauggcguuaaaggcugggccuuugacgaugggaaugacguguggaugggaagaacaauuagcgagaagcugaggucagguuaugagaccuucaaagucaucggcggguggaguaagccaaacuccaaacuacagauuaaucgucaggugauaguagaucggggaaaccgcagcggcuacucugguaucuuuucaguugaagggaagaguugcauuaauagauguuucuauguggagcucaucaggggccggaagcaggaaacggaggucugguggaccagcaacuccaucguggucuuuugcggaacaucuggcacuuacgggaccggaucguggcccgacggugcggauauuaaucugaugccuauauga

SEQ ID NO: 144276 - RNA, 1410 nt, Artificial Sequence
  derived and/or modified sequence opt3 from neuraminidase__InfluenzaA__AFJ77433
augaaccccaaucagaagaucauuaccauaggcagcgugucccugacaaucgccacuauuugcuuccucaugcaaaucgucauucuuguuacgaccgugacacugcacuuuaaacaguacgaguguaacucuccuccaaauaaccagguaauguugugcgaaccgacuaucauagagagaaauaucaccgaaauuguguauuuaacaaacaccacuaucgagaaggaaauuugucccaaacuggcugaguacaggaauuggucaaagccucagugcaaaaucacaggguucgcaccauuuaguaaggacaacagcauacggcuauccgccggaggugauauuugggucacccgcgagcccuaugugucuugugacccuggcaagugcuaccaauucgcgcucgggcagggaacgacucugaauaaccgacauucgaaugauaccguucacgaccguacaccauauagaacucuucugaugaacgaauugggcgugcccuuucaucucgguaccaaacaggucuguaucgcuuggucaagcaguuccugccacgaugggaaggccuggcugcauguguguguaacaggacacgacgagaaugcaaccgccucuuucauuuacgauggcaggcugguugacagcaucggcuccuggaguaaaaacauccuccggacgcaggaaagugagugcguguguauuaaugggacuugcacagucgugaugaccgauggaagcgcuucugagcgcgcagacacuaagauauuauuuaucgaagaggguaaaauugugcacaucuccccucugucaggcagcgcccaacaugucgaagagugcaguuguuauccaagauacccggggguuaggugcgugugucgggauaacuggaagggaucuaaccgccccauaguagacauuaaugugaaggauuacuccaucgucagcucguaugugugcucuggccuuguuggugacacaccucgaaaaaccgacuccucaaguagcuccgauuguuugaacccaaauaacgaagaagggggacacggcgugaagggcugggcuuucgacgaugggaaugacgucuggaugggaagaacgaucucugagaaacugaggagcgguuacgagaccuuuaaggugauuggcggguggucaaaacccaacaguaagcuacagaucaaucggcagguaauuguugaucguggaaaccgcuccggcuauagcgguauauucucuguggaggggaaaucaugcgucaauagauguuuuuacguggaacucaucaggggccggaagcaggagacagaagucugguggacuucaaacagcauugugguuuucugcggaaccuccggcacauaugggacuggaucuuggccugacggugccgauaucaaucugaugccaaucuga

SEQ ID NO: 144277 - RNA, 1410 nt, Artificial Sequence
  derived and/or modified sequence opt3 from neuraminidase__InfluenzaA__AFJ77443
augaaccccaaucagaagaucauuaccauaggcagcgugucccugacaaucgccacuauuugcuuccucaugcaaaucgcuauucuugucaucacgcugaccuugcacuuuaaacaguacgaguguaacucuccuccaaauaaccagguuauguuaugcgaaccgacaauaaucgagagaaauauuacugaaaucguguaucugaccaacacaaccauugagaaggaaaucugucccaaacuagcagaguacaggaauuggucaaagccucagugcaaaauaacuggguucgccccauuuaguaaggacaacagcauucggcucuccgcgggaggugauaucuggguaacacgcgagcccuaugugucuugugacccuggcaagugcuaccaauucgcucuggggcagggaaccacgcuuaauaaccgacauucgaaugauacuguccacgaccguaccccauauagaacacuguugaugaacgaacucggcgugcccuuucaucuggguacuaaacagguuuguauugccuggucaagcaguuccugccacgaugggaaggcauggcugcaugugugugucaccggacacaaugagaacgccacagcuucuuucaucuacgacggcaggcucguggauagcaucggcuccuggaguaaaaauauuuuacggacccaggaaucagagugcguauguauaaacgggacgugcacuguugugaugacagacggaagcgcaucuggucgcgccgauaccaagauccuguuuauugaggaaggcaaaaucguccacauauccccucuuucagggagcgcucaacauguggaggaaugcaguuguuauccaagauacccgggagugaggugcgucugucgggacaacuggaagggcucuaaucgccccauuguugauaucaacgugaaggacuucuccaucguaagcucguacgugugcucugguuuggucggggauacuccucgaaagaaugacuccucaaguagcucccacugucugaacccaaauaacgaggaaggaggcaauggcgugaaagggugggccuuugacgauggaaacgacguuuggauggguagaacaauuucugagaaacuaaggagcggcuaugagaccuucaaggugaucgggggauggucaaaacccaauaguaagcuccagauuaaccggcaggucauaguggaucguggcaaucgcuccgguuacagcgggaucuuuucuguagaaggcaaaucaugcauuaacagauguuucuauguugagcugaucaggggacggaagcaggaaacggaggugugguggaccaguaauagcaucgucguguuuugcggcacauccgggacuuacggaaccgguucuuggccugacggcgcggauauuaaccuuaugccaauauga

SEQ ID NO: 144278 - RNA, 1410 nt, Artificial Sequence
  derived and/or modified sequence opt3 from neuraminidase__InfluenzaA__AFJ77465
augaaccccaaucagaagaucauuaccauaggcagcgugucccugacaaucgccacuauuugcuuccucaugcaaaucgcuauucuugucacgaccguuacacugcacuuuaaacaguacgaguguaacccuccaccgaauaaccaggugauguugugcgaacccacuaucauagagagaaauaucaccgaaauuguauauuuaacaaacaccacuaucgagaaggaaauuuguccuaaacuggcagaguacaggaauuggucuaagccacagugcaaaaucacaggguucgcccccuuuucaaaggacaacaguauacggcuaagcgcgggaggugauauuugggugacccgcgagccuuaugucuccugugacccagauaagugcuaccaauucgcucucggccaggggacgacucugaauaaccgacauucuaaugacaccgugcacgaucguacacccuauagaacucuucugaugaacgaauugggaguuccuuuucaucucggcaccaaacagguguguaucgccuggucgucaagcaguugccacgacgguaaggcauggcugcaugucugugugacagggcacgaugagaaugccaccgcuuccuucauuuacgacggaaggcugguagauucuaucggcagcugguccaaaaagauccuccggacgcaggaaucagagugcguuuguauuaacggcacuugcacaguggucaugaccgacgggagugcaagcggacgcgccgauacuaaaauauuauuuaucgaggaagguaagauugugcacaucucuccacuguccggcucagcucaacauguggaggaaugcagcuguuauccgagauaccccggggucaggugcguuugucgggacaauuggaagggaaguaaccgcccuauaguggauauuaacgugaaaaauuacucuaucguguccagcuaugucugcucgggccuugugggugacacaccacgaaagaacgacucuuccucaaguagccacuguuugaaucccaacaaugaggaagggggacauggcguuaaaggcugggccuucgaugacgggaacgauguguggaugggaagaaccaucuccgagaagcugaggucugguuacgagacguuuaaagucauugaaggcuggagcaagccuaauucaaaacuacagaucaaccggcagguaauuguagaccgugggaaucgcaguggauauuccggcauauucagcguugaggguaagucuugcaucaacagauguuuuuacguggaacucauuagggggcggaagcaggagaccgaagucugguggacaucaaauaguaucguggucuucugcggcacuagcggaaccuauggcacaggguccuggccagauggagcggacaucaaccugaugcccauuuga

SEQ ID NO: 144279 - RNA, 1410 nt, Artificial Sequence
  derived and/or modified sequence opt3 from neuraminidase__InfluenzaA__AFJ77476
augaaccccaaucagaagaucauuaccauaggcagcgugucccugacaaucgccacuauuugcuuccucaugcaaaucgcuauucuugucacgaccguuacacugcacuuuaaacaguacgaguguaacucuuugccuaauaaccaggugauguuaugcgaaccaacuaucauagagagaaauaucaccgaaauuguauaucugacaaacaccacuaucgagaaggaaauuuguccgaaacuagcagaguacaggaauuggucaaagccccagugcaaaaucacaggguucgccccuuuuaguaaggacaacagcauacggcucuccgcgggaggugauauuugggugacccgcgagccauaugucucuugugaccccgauaagugcuaccaauucgcucugggccaggggacgacucuuaauaaccgacauucgaaugacaccgugcacgaucguacaccuuauagaacucuguugaugaacgaacucggaguuccauuucaucugggcaccaaacagguguguaucgccuggucaagcaguuccugccacgacgguaaggcauggcugcaugucugugugacagggcacgaugagaaugccaccgcuucuuucauuuacggaggcaggcucguagacagcaucggcuccuggaguaaaaagaucuuacggacgcaggaaucagagugcguuuguauuaacgggacuugcacaguggucaugaccgauggaagcgcaucuggucgcgccgacacuaaaauacuguuuaucgaggaaggcaagauuauccacauaucccaacuuucagggagcgcucagcauguggaggaaugcaguuguuaucccagauacccuggagugaggugcgucugucgggauaauuggaagggcucuaaccgcccaauuguugacaucaacgugaaagauuacuccaucguaagcucguaugugugcucugguuuggucggggacacaccgcgaaagaaugacuccucaaguagcucccacugucuggaucccaacaaugaggaaggaggccauggcgugaaagggugggccuucgacgauggaaacgacguuuggauggguagaaccauuucugagaaguuuaggagcggcuacgagacguucaaagugaucgaaggguggucaaagccuaauaguaaacuacagauuaaccggcagauaaucgucgaucgugacaaucgcuccggauauagcggcaucuuuucuguggaggguaagucaugcauuaacagauguuucuacguagaacucaucagggggcggaagcaagagaccgaaguuugguggacaaguaauagcauuguggucuuuugcggcacuuccggaaccuauggcacagggucuuggccagauggagcggacauaaaccugaugcccaucuga

SEQ ID NO: 144280 - RNA, 1410 nt, Artificial Sequence; identical to SEQ ID NO: 136331
  derived and/or modified sequence opt3 from neuraminidase__InfluenzaA__AFJ77487

SEQ ID NO: 144281 - RNA, 1410 nt, Artificial Sequence
  derived and/or modified sequence opt3 from neuraminidase__InfluenzaA__AFJ77498
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucggcuccuggaguaaaaagauccuccggacgcaggaaucagagugcguuuguauuaacggcacuugcacaguggucaugaccgacgggagcgcaucuggacgcgccgauacuaaaauauuauuuaucgaggaagguaagauugugcacacauccaagcugucaggcagcgcucaacauguggaggaaugcaguuguuauccuagauacccaggggucaggugcguuugucgggacaauuggaaaggaucuaaccgcccgaucguggauauaaacguaaaggacuacuccauuaucagcucguaugugugcucuggccuugucggugacacccccagaaagaaugauuccucaaguagcucccacuguuuggacccuaacaaugaggaagggggacauggcgugaaaggcugggccuucgaugacgggaacgauguuuggaugggacgaacgaucucugagaaaagcaggucagguuacgagaccuuuaaggugauugaaggcuggaguaaaccaaauuccaagcugcagaucaaccggcaggucauuguggagcgugggaauaugagcggauauucuggcauauucucaguagaagguaagaguugcaucaaccgcuguuuuuacguugagcuaauuagagggaggaaacaggaaacagaggugugguggacuagcaauuccaucgucguguucugcggcaccucuggaacauauggcacugggucguggcccgacggagcggauaucaaccucaugccuauuuga

SEQ ID NO: 144282 - RNA, 1410 nt, Artificial Sequence; identical to SEQ ID NO: 136331
  derived and/or modified sequence opt3 from neuraminidase__InfluenzaA__AFJ77509

SEQ ID NO: 144283 - RNA, 1410 nt, Artificial Sequence
  derived and/or modified sequence opt3 from neuraminidase__InfluenzaA__AFJ77520
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccucacugagcgggagugcucaacacguggaggaaugcucuuguuauccucgguacccaggaguccgcugcguuuguagagacaacuggaagggcuccaauaggccgaucguggauauaaacguaaaagacuacagcauugugucgucuuaugucugcuccggucuugugggggacacgccccggaagaaugauucaaguagcuccucucauuguuuggacccuaacaaugaggaaggaggccacggcguuaaagggugggccuucgaugacggaaacgauguguggaugggucgcaccaucagcgagaagcugcgaucaggcuacgagaccuuuaaagucaucgaaggguggaguaagccaaauuccaaacuacagauuaacagacaggugaucguagacaggggaaaucggagcggcuauucugguauuuucucaguugaggggaagaguugcauaaaccguuguuuuuacguggaacucauccgcggcagaaagcaggagauugaaguccuguggacaagcaauuccaucguggucuucugcggaacuucuggcaccuaugggacaggaucguggcccgauggugcggacaucaaccuuaugccuauuuga

SEQ ID NO: 144284 - RNA, 1410 nt, Artificial Sequence
  derived and/or modified sequence opt3 from neuraminidase__InfluenzaA__AFJ77531
augaaccccaaucagaagaucauuaccauaggcagcgugucccugacaaucacuacgauuugcuuccucaugcaaaucgccauucuugucaucaccguuacacugcacuuuaaacagugugagugcaacucuccuccaaauaaccaggugauguugugugaaccgacuauaaucgagagaaauauuaccgaaaucguauacuuaacaaacaccacuauugagaaggaaaucugccccaaacuggcugaguauaggaauuggucaaagccucaguguaaagugacaggguucgcaccauuuaguaaggacaacagcauacggcuauccgccggaggugauauuugggucacccgcgagcccuacgugucuugcgacccuggcaaguguuaucaauucgcgcucgggcagggaacgacucugaauaaccgacauucgaaugauaccguucacgaccguacaccauacagaacucuucugaugaacgaauugggcgugcccuuucaucucgguaccaaacaggucugcaucgcuuggucaagcaguuccugucacgaugggaaggccuggcugcaugugugcguaacaggacacaaugagaacgcaaccgccucuuucauuuaugacggcaggcugguugauagcaucggcuccuggaguaaaaauauccuccggacgcaggaaucagagugugugugcauuaacgggacuugcacagucgugaugaccgacggaagcgcuucuggucgcgcagauacuaagauauuauuuaucgaggaaggcaaaauugugcacaucuccccucugucagggagcgcccaacaugucgaggaauguaguugcuacccaagauauccgggaguuaggugugugugccgggacaacuggaagggcucuaaucgccccauaguagauauuaacgugaaggacuacuccaucgucagcucguacguguguucuggucuuguuggggauacaccucgaaagaaugacuccucaaguagcuccuauugcuuggacccaaacaaugaggaaggaggccacggcgugaaagggugggcuuucgaugacggaaacgaugucuggauggguagaaccaucucugagaaacugaggagcggcuacgagacguuuaaggugauugggggauggucaaaacccaauaguaagcuacagaucaaccggcagguaauuguugaccguggcaaucgcuccgguuauagcgggauauucucuguggaaggcaaaucauguaucaacagaugcuuuuacgucgagcucauuaggggacggaagcaggaaaccgaggugugguggacaaguaauagcaucgucguguucuguggcacuuccgggaccuauggaacagguucuuggccugauggcgccgacaucaaccugaugccaauuuga

SEQ ID NO: 144285 - RNA, 1410 nt, Artificial Sequence
  derived and/or modified sequence opt3 from neuraminidase__InfluenzaA__AFJ77542
augaaccccaaucagaagaucauuaccauaggcagcgugucccugacaaucucuacuauuugcuuccucaugcaaaucgccauucuugucacgaccguuacacugcacuuuaaacaguacgaguguaacucaccuccaaauaaccaggugauguugugcgaaccgacuaucauagagagaaauaucaccgaaauuguauauuuaacaaacaccacuaucgagaaggaaauuugucccaaacuggcugaguacaggaauuggaguaagccucagugcaacaucacaggguucgcaccauuuagcaaagacaauuccauacggcuaucugccggaggugauauuugggugacccgcgagcccuaugucucgugugacccugauaagugcuaccaauucgcgcucggccaggggacgacucugaacaauggacauucaaacgacaccgugcacgaucgaacaccauaucguacucuucugaugaaugaauugggcguucccuuucaucucgguaccaaacagguguguaucgcuuggagcaguuccucuugccacgacgggaaggccuggcugcaugucugugugacaggagaugacgagaacgcaaccgccagcuucauuuacaauggcagacugguagauuccaucggcucauggaguaagaaaauccucaggacgcaggaaagcgagugcguuuguauuaacgggacuugcacaguggucaugaccgacggaucugcuuccgguaaggcagauacuaaaauauuauuuaucgaggaaggcaagauugugcacacaucaacccugagcgggagugcccaacacguggaggaaugcucuuguuauccucgguacccaggaguccgcugcguuuguagagacaacuggaagggcuccaauaggccgaucguggauauaaacauuaaagacuacagcaucguaucgucuuaugugugcuccggucuugucggggacacgccccggaagaaugauucaaguagcuccucucauuguuuggacccuaacaaugaggaaggaggccacggcgugaaagggugggcuuucgaugacggaaacgauguuuggaugggucgcaccaucagcgagaagcugcgaucaggcuacgagacauuuaaagugauugaaggguggaguaagccaaauuccaaacuacagaucaacagacaggucauuguggacaggggaaaucggagcggcuauucugguauauucucaguagaggggaagaguugcaucaaccguuguuuuuacguugaacucauucgcggcagaaagcaggagacugaagugcuguggaccagcaauuccaucgucguguucugcggaacaucuggcacuuaugggaccggaucguggcccgauggugccgacaucaaccuuaugccuauuuga

SEQ ID NO: 144286 - RNA, 1410 nt, Artificial Sequence; identical to SEQ ID NO: 136269
  derived and/or modified sequence opt3 from neuraminidase__InfluenzaA__AFJ77553

SEQ ID NO: 144287 - RNA, 1410 nt, Artificial Sequence
  derived and/or modified sequence opt3 from neuraminidase__InfluenzaA__AFJ77564
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucggcuccuggaguaaaaagauccuccggacgcaggaaucagagugcguuuguauuaacggcacuugcacaguggucaugaccgacgggagcgcaucuggacgcgccgauacuaaaauauuauuuaucgaggaagguaagauugugcacaucucccaacugucaggcagcgcucagcauguggaggaaugcaguuguuauccuagauacccaggggucaggugcguuugucgggacaauuggaagggaucuaaccgcccgauaguggauauuaacguaaaagacuacuccaucgugagcucguaugucugcucuggccuugugggugacacaccccgaaagaaugauuccucaaguagcucccacuguuugaacccuaauaacgaggaagggggacauggcguuaaaggcugggccuucgacgaugggaaugacguguggaugggaagaaccaucucugagaagcugaggagcgguuacgagacguuuaaagucauugaaggcuggucaaagccaaacaguaaacuacagaucaaucgucaggugauuguagaucgggggaaccgcuccggauauagcggcauauucucuguugaggguaagucaugcaucaauagauguuuuuacguggaacucauuagggggcggaagcaagagaacgaagucugguggaccaguaauagcaucguggucuucugcggcacauccggaacuuauggcaccgggucuuggcccgacggagcggauaucaaccugaugccuauuuga

SEQ ID NO: 144288 - RNA, 1329 nt, Artificial Sequence
  derived and/or modified sequence opt3 from neuraminidase__InfluenzaA__AFJ77575
augaaccccaaucagaagaucauuaccauaggcagcgugucccugacaaucgccacuauuugcuuccucaugcaaaucgcuauucuugucaucgagagaaacauaacggaaaucguuuaccugaccaauacaacuauugagaaagaaaucuguccuaaguuggcagaguauaggaacuggucuaaaccacagugcaauauuaccggguuugccccguucucaaaggacaacaguauccgguuaagcgcgggaggugauauaugggugacacgcgaacccuacguauccugugacccugauaaaugcuaucaguuugcucugggccaggggaccacucuaaauaacggacacucuaaugacacagugcaugaucgaaccccauaccguacgcuccugaugaacgagcuuggcguccccuuccaccuggguacuaagcaaguguguauugccuggucgucaagcaguugccaugacgggaaggcaugguugcacguuugugugaccggagaugacgagaaugccacagcuuccuuuaucuauaacggcagacucgucgauucuauuggcagcugguccaaaaagauccugaggacucaggaaucagagugcguguguaucaaugggaccugcacaguaguuaugaccgacggaagugcaagcgguaaagccgauacgaagauucuguucauagaagagggcaaaaucgugcauacuucuucccucucagggagcgcucagcacgucgaggaauguaguugcuacccucgguauccaggagugcgcugcguguguagagacaacuggaagggcucuaauaggcccauugucgauaucaacguuaaggacuacuccauagugagcucguacguaugcucugguuuagugggggacacaccucggaaaaacgauuccucaaguagcucccacugucuggacccaaauaacgaggaaggaggccauggcgucaaggggugggccuuugaugacggaaaugauguguggaugggucgcaccauuucugagaaacuucgaagcggcuaugaaacuuucaagguuaucgagggguggucaaaaccgaacaguaaguugcagaucaauagacaagugauugucgacaggggaaaccgguccggcuacagcgguaucuuuucuguggaggggaaaucaugcauuaaucguuguuucuauguagaacugauacgcggcagaaagcaggagacagaaguucuauggaccaguaacagcaucguggucuuuugcggaacguccggcaccuacgggacaggaucuuggcccgauggugcggacauuaaucucaugccuaucuga

SEQ ID NO: 144289 - RNA, 1410 nt, Artificial Sequence
  derived and/or modified sequence opt3 from neuraminidase__InfluenzaA__AFJ77597
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacacggccucuguccgggucagcucaacacguggaggaaugcagcuguuauccacgcuacccgggagucagaugcguuuguagggacaacuggaagggcaguaaucggcccaucguggauauaaacguaaaagacuacucuauuguguccagcuaugucugcucgggucuugugggggacaccccucgcaagaaugauucuuccucaaguagccauuguuuggacccaaacaaugaggaaggaggccacggcguuaaagggugggccuucgaugacggaaacgauguguggaugggucgaacgaucuccgagaagcugagaucuggcuacgagaccuuuaaagucaucgaaggguggagcaagcccaauucaaaacuacagauuaacaggcaagugaucguagaccggggaaaucguaguggcuauuccgguauuuucagcguugaggggaagucuugcauaaaccgcuguuuuuacguggaacucaucagaggcaggaagcaggagacagaaguccuguggacuucaaauaguauuguggucuucugcggaaccagcggcacauaugggacuggauccuggccugauggugcggacaucaaccuuaugccaaucuga

SEQ ID NO: 144290 - RNA, 1410 nt, Artificial Sequence
  derived and/or modified sequence opt3 from neuraminidase__InfluenzaA__AFJ77608
augaaccccaaucagaagaucauuaccauaggcagcgugucccugacaaucgccacuauuugcuuccucaugcaaacggcuauccuugucaccacaguuacucugcacuuuaaacaguacgaguguaacucuccuccaaauaaccaggugauguugugcgaaccgaccauuaucgagagaaauaugacagaaauaguauauuuaaccaacacuacaaucgagaaggaaauuugucccaaacuggcagaguacaggaauuggucaaagccucagugcaacaucaccggguucgccccauuuaguaaagacaauagcauucggcuauccgcgggaggugaucucugggugacgcgcgagcccuaugucucuugugacccugauaagugcuaccaauucgcucugggccaggggacuacccuuaacaauggacauucgaacgacacagugcacgaucgaacuccauaucguacccuguugaugaaugaacucggcguucccuuucaucuggguacaaaacagguguguaucgccuggucaagcaguuccugccacgacgggaaggcauggcugcaugucugugugaccggagaugacgagaacgccacggcuucuuucauauacaauggcagacucguagauagcauuggcuccuggucaaagaaaaucuuaaggacucaggaaagugagugcguuuguauuaacgggacaugcaccguggucaugacugacggaagcgcaucugguaaggccgauacaaaaauccuguuuaucgaggaaggcaagauugugcacaccuccucacuuagcgggagugcucaacacguggaggaaugcucuuguuauccucgguacccaggaguccgcugcguuuguagagacaacuggaagggcuccaauaggccgauaguggauaucaacguaaaagacuacagcauugugucgucuuaugucugcuccgguuuggugggggacacgccccggaagaaugauucaaguagcuccucucauugucuggacccuaacaaugaggaaggaggccacggcguuaaagggugggccuucgaugacggaaacgauguguggaugggucgcaccaucagcgagaagcuacgaucaggcuacgagacauuuaaagucauagaaggguggaguaagccaaauuccaaacuccagauuaacagacaggugaucguagacaggggaaaucggagcggcuauucugguaucuucucaguugaggggaagaguugcauuaaccguuguuuuuacguggaacugauccgcggcagaaagcaggagacugaaguccuuuggaccagcaauuccauuguggucuucugcggaacaucuggcacuuaugggaccggaucguggcccgauggugcggacauaaaccugaugccuaucuga

SEQ ID NO: 144291 - RNA, 1410 nt, Artificial Sequence; identical to SEQ ID NO: 144289
  derived and/or modified sequence opt3 from neuraminidase__InfluenzaA__AFJ77619

SEQ ID NO: 144292 - RNA, 1410 nt, Artificial Sequence; identical to SEQ ID NO: 144289
  derived and/or modified sequence opt3 from neuraminidase__InfluenzaA__AFJ77630

SEQ ID NO: 144293 - RNA, 1410 nt, Artificial Sequence; identical to SEQ ID NO: 144285
  derived and/or modified sequence opt3 from neuraminidase__InfluenzaA__AFJ77641

SEQ ID NO: 144294 - RNA, 1410 nt, Artificial Sequence; identical to SEQ ID NO: 144285
  derived and/or modified sequence opt3 from neuraminidase__InfluenzaA__AFJ77652

SEQ ID NO: 144295 - RNA, 1410 nt, Artificial Sequence; identical to SEQ ID NO: 136056
  derived and/or modified sequence opt3 from neuraminidase__InfluenzaA__AFJ77663

SEQ ID NO: 144296 - RNA, 1410 nt, Artificial Sequence; identical to SEQ ID NO: 136056
  derived and/or modified sequence opt3 from neuraminidase__InfluenzaA__AFJ77674

SEQ ID NO: 144297 - RNA, 1410 nt, Artificial Sequence; identical to SEQ ID NO: 136056
  derived and/or modified sequence opt3 from neuraminidase__InfluenzaA__AFJ77685

SEQ ID NO: 144298 - RNA, 1410 nt, Artificial Sequence
  derived and/or modified sequence opt3 from neuraminidase__InfluenzaA__AFJ77696
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugagaaggccgauacuaaaauauuauuuaucgaagaggguaagauugugcacacaucccugcuuucaggcagcgcucaacacguggaagagugcaguuguuauccucgguacccagggguccgcugcguuuguagagacaacuggaagggaucuaauaggccgaucguggauauaaacguaaaagacuacuccauugugagcucguaugucugcucuggcuuggugggugacacuccccggaagaaugauuccucaaguagcucccauugucuggacccuaacaaugaagaagggggacacggcguuaaaggcugggccuucgaugacgggaacgauguguggaugggacgcacgaucucugagaagcuacgaagcgguuacgagaccuuuaaagucaucgagggcuggucaaagccaaauaguaaacuccagauuaacagacaggugaucguagacagggggaaucgguccggauauagcggcauuuucucuguugaagguaagucaugcauaaaccguuguuuuuacguggagcugauccgcgggagaaagcaggaaacagagguccuuuggaccaguaauagcauuguggucuucugcggcaccuccggaacauauggcacugggucuuggcccgauggagcggacaucaaccugaugccuaucuga

SEQ ID NO: 144299 - RNA, 1410 nt, Artificial Sequence; identical to SEQ ID NO: 136056
  derived and/or modified sequence opt3 from neuraminidase__InfluenzaA__AFJ77707

SEQ ID NO: 144300 - RNA, 1410 nt, Artificial Sequence; identical to SEQ ID NO: 136077
  derived and/or modified sequence opt3 from neuraminidase__InfluenzaA__AFJ77718

SEQ ID NO: 144301 - RNA, 1410 nt, Artificial Sequence; identical to SEQ ID NO: 136077
  derived and/or modified sequence opt3 from neuraminidase__InfluenzaA__AFJ77729

SEQ ID NO: 144302 - RNA, 1410 nt, Artificial Sequence
  derived and/or modified sequence opt3 from neuraminidase__InfluenzaA__AFJ77740
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacgagaacgcaaccgccagcuucaucuacaauggaagacugguagauuccaucguuucauggaguaagaaaauucugaggacgcaggaaagcgagugugugugcauaaacggcacuuguaucgucgugaugacagacggcucugcuuccgggaaggcagauaccaaaauucucuuuaucgaggaaggaaagauagugcacacuucaacauuaagcgguagugcccaacacgucgaggaaugcucuugcuauccucgguacccaggcguucgcugugugugcagagacaacuggaagggguccaauaggccgauuguagauaucaacaucaaagacuacagcauugugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccaucagcgagaaguugcgaucaggauacgagaccuuuaaagucauugaagguuggaguaauccaaacuccaagcugcagauaaauagacaggugaucguagacaggggcaaccggagcggguauucuggaauuuucucaguugagggcaaaaguuguaucaaucguugcuuuuacguggaacuaauccgcgguagaaagcaggagacagaaguccucuggacuagcaacuccauuguggucuucugugggaccucuggcacauauggaacuggcucguggcccgauggggccgacauaaaucugaugccuaucuga

SEQ ID NO: 144303 - RNA, 1410 nt, Artificial Sequence
  derived and/or modified sequence opt3 from neuraminidase__InfluenzaA__AFJ77751
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcgagaucguacaccauacagaacucuucugaugaaugaauugggcguucccuuucaucucgguacccgacagguguguaucgccuggucaagcaguuccugccacgacgggaaggcauggcugcaugucugugugacaggagaugacaaaaacgccaccgcuucuuucauuuauaauggccggcugguagauagcaucggcuccuggucaaagaaaauccuccgcacgcaggagagugaaugcguuuguauuaacgggacuugcacaguggucaugaccgacggaagcgcaucugguaaggccgauacuaaaauauuauuuaucgaggagggcaagauugugcacaucuccacacugucagggagcgcucaacacguggaagagugcaguuguuacccuagauauccaggagucaggugcguuugucgggacaacuggaagggcucuaaucgcccgauaguggauauuaacguaaaagacuacuccaucuucagcucguacgugugcucuggucuugucggggacacccccaggaagaaugauuccuuuucaaguagccauuguuuggacccuaacaaugaagagggaggccacggcgugaaagggugggccuucgaugacggaaacgauguuuggauggguagaacgaucuccgaaaagcugaggucuggcuaugagaccuuuaaagugauugagggguggagcaagccaaauucaaaacuacagaucaaccggcaggucauuguggaacguggaaaucgcaguggcuacuccgguauauucagcguagaggggaagucuugcaucaacagauguuuuuauguugaacucauuaggggccggaaggaggaaacagaggugugguggacuucaaauaguaucgucguguucugcggaaccagcggcacauacgggacuggauccuggcccgacggugcggauaucaaccugaugccuauuuga

SEQ ID NO: 144304 - RNA, 1410 nt, Artificial Sequence; identical to SEQ ID NO: 136161
  derived and/or modified sequence opt3 from neuraminidase__InfluenzaA__AFJ77762

SEQ ID NO: 144305 - RNA, 1410 nt, Artificial Sequence; identical to SEQ ID NO: 136161
  derived and/or modified sequence opt3 from neuraminidase__InfluenzaA__AFJ77773

SEQ ID NO: 144306 - RNA, 1410 nt, Artificial Sequence; identical to SEQ ID NO: 136161
  derived and/or modified sequence opt3 from neuraminidase__InfluenzaA__AFJ77784

SEQ ID NO: 144307 - RNA, 1410 nt, Artificial Sequence; identical to SEQ ID NO: 136730
  derived and/or modified sequence opt3 from neuraminidase__InfluenzaA__AFJ77795

SEQ ID NO: 144308 - RNA, 1410 nt, Artificial Sequence; identical to SEQ ID NO: 136730
  derived and/or modified sequence opt3 from neuraminidase__InfluenzaA__AFJ77806

SEQ ID NO: 144309 - RNA, 1410 nt, Artificial Sequence; identical to SEQ ID NO: 136730
  derived and/or modified sequence opt3 from neuraminidase__InfluenzaA__AFJ77817

SEQ ID NO: 144310 - RNA, 1410 nt, Artificial Sequence; identical to SEQ ID NO: 136730
  derived and/or modified sequence opt3 from neuraminidase__InfluenzaA__AFJ77828

SEQ ID NO: 144311 - RNA, 1410 nt, Artificial Sequence
  derived and/or modified sequence opt3 from neuraminidase__InfluenzaA__AFJ77839
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuuuauugaggagggaaagaucauacacacaucaaccuuaagcgguagugcccaacacguggaagagugcucuugcuauccucgguacccaggcguccgcuguguuugcagagauaacuggaaaggguccaacaggccgauuguggacaucaauaucaaggacuacagcauuguaucgucuuauguguguuccggacuggucggcgauacgccccggaaaaacgacucaaguagcuccucucauugccuugauccuaauaacgaagagggugggcacggagugaagggcugggcuuucgacgauggcaaugacguuuggauggggcgcaccaucagcgaaaaauugcgaucaggauacgagacauuuaaggugauugaggguuggaguaacccaaauuccaaacugcagauaaacagacaggucaucguggauaggggcaaucggagcggguauucuggaauuuucucaguagaaggcaagaguuguaucaaccguugcuuuuacguugagcuaauccgcgguagaaaggaagagacugaagugcucuggaccagcaauuccauugucguguucugugggacaucuggcacuuauggaaccggcucguggcccgacggggccgauauaaaccugaugccuaucuga

SEQ ID NO: 144312 - RNA, 1410 nt, Artificial Sequence
  derived and/or modified sequence opt3 from neuraminidase__InfluenzaA__AFJ77850
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcuaaguacaggaauuggaguaaaccucagugugacauaacaggguucgcaccauuuagcaaggauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgagcugggaguucccuuucauuugggcaccaaacaggugugcauugcuuggagcaguuccucuugucacgaugguaaggccuggcuccaugucugcgugacaggggacgauaaaaaugcaaccgccagcuucaucuacaacggaagacugguagacuccaucguuucauggaguaagaaaauucugaggacgcaggaaagcgagugugugugcauaaauggcacuuguacagucgugaugaccgauggcucugcuuccgggaaggcagacacuaagauccucuuuauugaagagggaaaaaucgugcacacaucaaccuuaagcgguagugcccaacacgucgaggaaugcucuugcuauccucgguacccaggcguucgcugugugugcagagauaacuggaagggguccaacaggccgauaguagacauuaauaucaaagacuacagcaucgugucgucuuaugucuguuccggacuggugggcgauacgccccggaagaacgacucaaguagcuccucucauugccuugauccuaauaacgaggaaggugggcacggaguuaaaggcugggcuuucgacgauggcaaugacguguggauggggcgcaccauuagcgagaaguugcgaucaggauacgaaacauuuaaagucaucgaggguuggaguaacccaaauuccaagcugcagauuaacagacaggugauaguagauaggggcaaucggagcggguauucuggaaucuucucaguugagggcaagaguuguauuaaccguugcuuuuacguggaacuaauccgcgguagaaaagaggaaacugagguccucuggaccagcaauuccaucguggucuucugugggacaucuggcacuuauggaaccggcucguggcccgacggggccgauauuaaccugaugccuauauga

SEQ ID NO: 144313 - RNA, 1410 nt, Artificial Sequence; identical to SEQ ID NO: 136730
  derived and/or modified sequence opt3 from neuraminidase__InfluenzaA__AFJ77861

SEQ ID NO: 144314 - RNA, 1410 nt, Artificial Sequence; identical to SEQ ID NO: 136730
  derived and/or modified sequence opt3 from neuraminidase__InfluenzaA__AFJ77872

SEQ ID NO: 144315 - RNA, 1410 nt, Artificial Sequence; identical to SEQ ID NO: 137196
  derived and/or modified sequence opt3 from neuraminidase__InfluenzaA__AFJ77883

SEQ ID NO: 144316 - RNA, 1410 nt, Artificial Sequence; identical to SEQ ID NO: 136730
  derived and/or modified sequence opt3 from neuraminidase__InfluenzaA__AFJ77894

SEQ ID NO: 144317 - RNA, 1410 nt, Artificial Sequence; identical to SEQ ID NO: 136730
  derived and/or modified sequence opt3 from neuraminidase__InfluenzaA__AFJ77905

SEQ ID NO: 144318 - RNA, 1410 nt, Artificial Sequence
  derived and/or modified sequence opt3 from neuraminidase__InfluenzaA__AFJ77916
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuuuauugaggagggaaagaucgugcacacaucaaccuuaagcgguagugcccaacacgucgaagagugcucuugcuauccucgguacccaggcguucgcugugugugcagagauaacuggaaaggguccaacaggccgauaguagacauuaauaucaaggacuacagcaucgugucgucuuaugucuguuccggacuggugggcgauacgccccggaaaaacgacucaaguagcuccucucauugccuugauccuaauaacgaagagggugggcacggaguuaagggcugggcuuucgacgauggcaaugacguguggauggggcgcaccauuagcgaaaaauugcgaucaggauacgagacauuuaaggucaucgaggguuggaguaacccaaauuccaaacugcagauuaacagacaggugauaguagauaggggcaaucggagcggguauucuggaaucuucucaguugaaggcaagaguuguauuaaccguugcuuuuacguggagcuaauccgcgguagaaaggaagagacugaaguccucuggaccagcaauuccaucauuguguucugugggacaucuggcacuuauggaaccggcucguggcccgacggggccgauauaaaccugaugccuaucuga

SEQ ID NO: 144319 - RNA, 1410 nt, Artificial Sequence; identical to SEQ ID NO: 136752
  derived and/or modified sequence opt3 from neuraminidase__InfluenzaA__AFJ77927

SEQ ID NO: 144320 - RNA, 1410 nt, Artificial Sequence; identical to SEQ ID NO: 136752
  derived and/or modified sequence opt3 from neuraminidase__InfluenzaA__AFJ77938

SEQ ID NO: 144321 - RNA, 1410 nt, Artificial Sequence; identical to SEQ ID NO: 136730
  derived and/or modified sequence opt3 from neuraminidase__InfluenzaA__AFJ77949

SEQ ID NO: 144322 - RNA, 1410 nt, Artificial Sequence; identical to SEQ ID NO: 136730
  derived and/or modified sequence opt3 from neuraminidase__InfluenzaA__AFJ77960

SEQ ID NO: 144323 - RNA, 1410 nt, Artificial Sequence
  derived and/or modified sequence opt3 from neuraminidase__InfluenzaA__AFJ77971
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccaaacuccaagcugcagauuaauagacaggugauaguagacaggggcaaccggagcggguauucuggaaucuucucaguugagggcaaaaguuguauuaaucguugcuuuuacguggaacuaauccgcgguagaaaggaugagacugaaguccucuggaccagcaacuccaucguggucuucugugggacaucuggcacuuauggaaccggcucguggcccgacggggccgauauuaaucugaugccuauauga

SEQ ID NO: 144324 - RNA, 1410 nt, Artificial Sequence
  derived and/or modified sequence opt3 from neuraminidase__InfluenzaA__AFJ77982
augaaccccaaucagaagaucauuaccauaggcuucgugagccugacaaucuccacuauuugcuuuuucaugcaaaucgccauucucaucacgaccgucccucuucacuuuaaacaguacgaguucaacucuccaccgaauaaccagguuaugcugugugaacccacaauaaucgagagaaauauuacugaaaucguguauuugaccaacacaaccauugagaaggaaaucugcccuaaauuagcugaguacaggaauuggucaaagccacaguguaacauaacuggguuugcacccuucaguaaagacaauagcauucggcuguccgccggaggugauaucuggguaacacgcgagccuuaugugucuugcgacccagauaaguguuaccaauuugcgcuaggccaggggaccacgcucaacaauguccauucgaacgacacugugcacgaucgaacccccuaucguacacugcuuaugaaugaacugggaguuccuuuccauuugggcacuaaacaggugugcauugcuuggucaagcaguuccugucacgacgguaaggccuggcuccaugucugcgugaccggggaugacaagaacgcaacagccucuuuuaucuacaauggaagacugguagauagcaucguuuccuggucaaaagagauucugaggacccaggaaagugagugugugugcauaaacggcacguguacugucgugaugacagacggcagcgcuucugggaaggcagauaccaaaauccucuucauugaggaaggaaagaucgugcacacuuccacauuaucagguagcgcccaacacgucgaggaaugcaguugcuauccacgguacccgggcguucgcugugugugcagagacaacuggaaggggucuaauaggcccauaguagauauuaacaucaaagacuacuccaucgugagcucguaugucuguucuggaauugugggcgacaccccucggaagaaugauuccucaaguagcucccauugccuggacccaaacaaugaggaaggugggcacggaguuaaaggcugggcuuuugaugacggcaacgauguguggauggggcgcacgaucucugagaaacuucgaagcggauacgagaccuucaaggucauugaagguuggucaaaucccaacaguaaguugcagauaaauagacaggugaucguagacaggggcaaccgguccggguauagcggaauuuuuaguguugagggcaaaucauguaucaaucguugcuucuacguggaacugauccgcgguagaaaggaggaaacagagguccuauggacuucuaacagcauuguggucuucugugggaccuccggcacauauggaacuggcucuuggccugauggggccgacauaaaucucaugccaaucuga

SEQ ID NO: 144325 - RNA, 1410 nt, Artificial Sequence; identical to SEQ ID NO: 136728
  derived and/or modified sequence opt3 from neuraminidase__InfluenzaA__AFJ77993

SEQ ID NO: 144326 - RNA, 1410 nt, Artificial Sequence
  derived and/or modified sequence opt3 from neuraminidase__InfluenzaA__AFJ78004
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagaagaauauuaccgaaaucguguauuugacaaacaccacuauugagaaagaaaucugccccaaguuagcugaguacagaaauuggaguaaaccucaguguaacauaacaggguucgcaccauuuagcaaggacaauuccauuaggcugucugccggaggugauaucuggguaacccgggagcccuaugugucgugcgacccugauaaguguuaccaauucgcgcuaggccaggggacgacucucaacaauguccauucaaacgacaccgugcacgaucgcacaccauaucgaacucugcuuaugaaugaacugggaguucccuuucauuugggcaccaaacaggugugcauugcuuggagcaguuccucuugucacgacgguaaggccuggcuccaugucugcgugacaggggaugacaaaaacgcaaccgccagcuucaucuacaauggacgucugguagauuccaucguuucauggaguaaggagauucugagaacgcaggaaagcgagugugugugcauaaacggcacuuguacagucgugaugaccgacggcucugcuuccgggaaagcagauacuaagauccucuuuauugaggaaggaaagaucgugcacacaucaaccuuaagcgguagugcccaacacgucgaggaaugcucuugcuauccuagguacccaggcguucggugugugugccgcgacaacuggaaaggguccaauagaccgauaguagauauuaacaucaaggacuacagcaucgugucgucuuaugucuguuccggacuggugggcgacacgcccaggaaaaaugauucaaguagcuccucucauugccuugacccuaacaaugaggaaggugggcacggaguuaagggcugggcuuucgaugacggcaacgauguguggauggggcggaccauuagcgagaaauugcgcucaggauacgagacauuuaaggucaucgaagguuggaguaauccaaacuccaaacugcagauuaaucgacaggugauaguagacagaggcaacaggagcggguauucuggaaucuucucaguugagggcaagaguuguauuaaucggugcuuuuacguggaacuaauccguggucgcaaggaggaaacugagguccucuggaccagcaacuccaucguggucuucugugggacaucuggcacuuauggaaccggcucguggcccgauggggccgacauuaaucugaugccuauauga

SEQ ID NO: 144327 - RNA, 1410 nt, Artificial Sequence; identical to SEQ ID NO: 136728
  derived and/or modified sequence opt3 from neuraminidase__InfluenzaA__AFJ78015

SEQ ID NO: 144328 - RNA, 1410 nt, Artificial Sequence; identical to SEQ ID NO: 143585
  derived and/or modified sequence opt3 from neuraminidase__InfluenzaA__AFJ78026

SEQ ID NO: 144329 - RNA, 1410 nt, Artificial Sequence; identical to SEQ ID NO: 143585
  derived and/or modified sequence opt3 from neuraminidase__InfluenzaA__AFJ78037

SEQ ID NO: 144330 - RNA, 1410 nt, Artificial Sequence
  derived and/or modified sequence opt3 from neuraminidase__InfluenzaA__AFJ78048
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcaacgcuucugggaaggcagauacuaaaauccucuuuauugaggaaggaaagaucgugcacacauccaccuuaucagguagcgcccaacacgucgaggaaugcaguugcuauccucgguacccaggcguucgcugugugugcagagacaauuggaaggggucuaacaggccgauaguagauauuaauaucaaagacuacuccaucgugagcucguaugucuguucuggacuggugggcgacacgccccggaagaacgauuccucaaguagcucccauugccuugacccuaauaacgaggaaggugggcacggaguuaaaggcugggcuuucgaugacggcaaugauguguggauggggcgcaccauuucugagaaguugcgaagcggauacgagacauuuaaagucaucgaagguuggucaaacccaaauaguaagcugcagauuaacagacaggugauaguagacaggggcaaucgguccggguauagcggaaucuucucuguugagggcaaaucauguauuaaccguugcuuuuacguggaacuaauccgcgguagaaaggaggaaacugagguccucuggaccaguaauagcaucguggucuucugugggacauccggcacuuauggaaccggcucuuggcccgauggggccgacauuaaccugaugccuauauga

SEQ ID NO: 144331 - RNA, 1410 nt, Artificial Sequence
  derived and/or modified sequence opt3 from neuraminidase__InfluenzaA__AFJ78059
augaaccccaaucagaagaucauuaccauaggcagcgugucccugacaaucucuacuauuugcuucuuuaugcaaaucgccauucucaucacgaccgucacacuucacuucaaacaguacgaguuuaacccuccaccgaauaaccagguuaugcugugugaacccacuauaaucgagagaaauauuaccgaaaucguguauuugacaaacaccacuauugagaaggaaaucugcccuaaauuagcugaguacaggaauuggucaaagccacaguguaacauaacaggguucgcacccuuuaguaaagacaauagcauucggcuguccgccggaggugauaucuggguaacccgcgagccuuaugugucuugcgacccagauaaguguuaccaauucgcgcuaggccaggggacgacucucaacaauguccauucgaacgacaccgugcacgaucgaacacccuaucguacucugcuuaugaaugaacugggaguuccuuuucauuugggcaccaaacaggugugcauugcuuggucaagcaguuccugucacgacgguaaggccuggcuccaugucugcgugacaggggaugacaagaacgcaaccgccucuuucaucuacaauggaagacugguagauagcaucguuuccuggucaaaagagauucugaggacgcaggaaagugagugugugugcauaaacggcacuuguacagucgugaugaccgacggcagcgcuucugggaaggcagauacuaaaauccucuuuauugaggaaggaaagaucgugcacacauccaccuuaucagguagcgcccaacacgucgaggaaugcaguugcuauccacgguacccgggcguucgcugugugugcagagacaacuggaaggggucuaauaggcccauaguagauauuaacaucaaagacuacuccaucgugagcucguaugucuguucuggacuggugggcgacacgccucggaagaaugauuccucaaguagcucccauugccuugacccaaacaaugaggaaggugggcacggaguuaaaggcugggcuuucgaugacggcaacgauguguggauggggcgcaccauuucugagaaguugcgaagcggauacgagacauuuaaagucaucgaagguuggucaaaucccaacaguaagcugcagauuaauagacaggugauaguagacaggggcaaccgguccggguauagcggaaucuucucuguugagggcaaaucauguauuaaucguugcuuuuacguggaacuaauccgcgguagaaaggaugagacugaaguccucuggaccaguaacagcaucguggucuucugugggacauccggcacuuauggaaccggcucuuggccugacggggccgauauuaaucugaugccaauauga

SEQ ID NO: 144332 - RNA, 1410 nt, Artificial Sequence
  derived and/or modified sequence opt3 from neuraminidase__InfluenzaA__AFJ78070
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaaguggaguaaaccucaguguaauauaacaggguucgcaccauuuagcaaggacaacuccauucggcugucugccggaggugauaucuggguaacccgcgagcccuaugugucgugcgacccugauaaguguuaccaauucgcgcuaggccaggggacgacucucaauaacguccauucaaaugacaccgugcgagaucguacaccauauagaacucugcuuaugaacgaacugggaguucccuuucacuugggcaccaaacaggugugcauugcuuggagcaguuccucuugucaugacgguaaggccuggcuccacgucugcgugacaggggaugacaaaaaugcaaccgccagcuucaucuacaacggaaggcugguagauuccaucguuucauggaguaaggagauucugcggacgcaggaaagcgagugugugugcauaaauggcacuuguacagucgugaugaccgacggcucugcuuccgggaaagcagauacuaagauccucuuuauugaggaaggaaagaucgugcauacaucaaccuuaagcgguagugcccaacacgucgaggaaugcucuugcuauccucgcuacccaggcguuagaugugugugcagggacaacuggaaaggguccaaccggccgauaguagauauuaauaucaaggacuacagcaucgugucgucuuaugucuguuccggacuggugggcgacacgccccgcaaaaacgauucaaguagcuccggucacugccuugacccuaauaacgaggaagggggacauggcguuaagggcugggcuuucgaugacgggaaugauguguggaugggacgaaccauuucugagaaaagcagaucagguuacgagacauuuaaggucaucgaaggcuggaguaacccaaauuccaaauugcagauuaacaggcaagugauaguagaccgggggaaucguagcggauauucuggcaucuucucaguugaggguaagaguuguauuaaccgcugcuuuuacguggaacugaucagagggaggaaggaggaaacugagguccuauggaccagcaauuccaucguggucuucuguggcacaucuggaacuuauggcaccgggucguggcccgauggagccgacauuaaccucaugccuauauga

SEQ ID NO: 144333 - RNA, 1410 nt, Artificial Sequence
  derived and/or modified sequence opt3 from neuraminidase__InfluenzaA__AFJ78081
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccgggaaggcagacacuaaaauucucuuuaucgaggaaggaaagauagugcauacaucaaccuuaagcgguagugcccaacacguggaggaaugcucuugcuauccucgcuacccaggcgucagauguguuugcagggauaacuggaagggguccaaccggccgauuguggacaucaauaucaaagaccacagcauuguaucgucuuacguguguuccggacuggucggcgauacgccccgcaagaacgacaauucaaguagcucccauugccuugauccuaacaaugaggaaggugggcacggagugaaaggcugggcuuucgacgauggcaacgacguuuggauggggcgaaccaucucugaaaagagcagauugggauaugagacauuuaaagugauugaggguuggucaaauccaaacaguaagcugcagaugaauaggcaggucauaguggaucggggcaaccguuccggguacagcggaaucuucucuguagagggcaaaucauguauuaaucgcugcuuuuauguugaacuaaucagagguaggaaggaggaaacugaggugcucuggaccaguaacagcaucgucguguucugugggacauccggcacuuacggaaccggcucuuggcccgacggggccgauauuaaucugaugccuauauga

SEQ ID NO: 144334 - RNA, 1410 nt, Artificial Sequence; identical to SEQ ID NO: 144250
  derived and/or modified sequence opt3 from neuraminidase__InfluenzaA__AFJ78092

SEQ ID NO: 144335 - RNA, 1410 nt, Artificial Sequence
  derived and/or modified sequence opt3 from neuraminidase__InfluenzaA__AFJ78103
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccgggaaggcagacacuaaaauucucuuuaucgaggaaggaaagauagugcauacaucaaccuuacuggguagcgcccaacacguggaggaaugcaguugcuauccucgcuacccaggcgucagauguguuugcagggauaacuggaaggggucuaaccggccgauuguggacaucaauaucaaagaccacuccauuguaagcucguacguguguucuggacuugucggcgauacgccccgcaagaacgacuccucaaguagcggucauugcuuggauccuaauaacgaggaagggggacacggcgugaaaggcugggcuuucgacgaugggaaugacguuuggaugggacgaaccaucuccgagaagucuagacuggguuaugagacauuuaaagugauugaaggcuggagcaacccaucaaguaagcuacagauaaauaggcaggucaucguggaucgggggaaccguuccggauacagcggcauuuucucuguagaggguaaaucauguaucaaucgcugcuuuuauguugaacucaucagagggaggaaggaggaaacugaggugcuguggaccaguaacagcauugucguguucuguggcacauccggaacuuacggcaccgggucuuggcccgacggagccgauauaaaucuuaugccuaucuga

SEQ ID NO: 144336 - RNA, 1410 nt, Artificial Sequence
  derived and/or modified sequence opt3 from neuraminidase__InfluenzaA__AFJ78114
augaaccccaaucagaagaucauuaccauaggcagcgugucccugacaaucucuacuauuugcuucuuuaugcaaaucgccauucucaucacgaccgucacacuucacuucaaacaguacgagcugaacucaccuccaaauaaccagguuauguugugugaaccgacuauaaucgagagaaauauuaccgaaaucguguauuuaacaaacaccacuauugagaaggaaaucugccccaaacuggcugaguacaggaauuggaguaagccucagugugacauaacaggguuugcaccauucagcaaagauaacuccauucggcuaucugccggaggugacaucuggguaacccgcgagcccuaugugucgugcgauccugacaaguguuaccaauuugcgcucggccaggggacgacucugaauaacguccauucaaaugauaccgugcgagaccguacaccauauagaacucuucugaugaacgaauugggaguucccuuccaccucggcaccaaacaggugugcauugcuuggagcaguuccucuugucaugaugguaaggccuggcugcacgucugcaucacaggggacgauaagaaugcaaccgccagcuuuaucuacaacggaaggcugguggacuccauuguaucauggaguaaagagauacuccggacgcaggaaagcgaguguguuugcaucaauggcacuuguacaguggucaugaccgauggcucugcuuccgggaaggcagacacuaaaauuuuauucaucgaggaaggaaagauagugcauacaucaacccugagcgguagugcccaacacguggaggaaugcucuugcuauccucgcuacccaggcgucagauguguuugcagggauaacuggaagggguccaaccggccgauuguggacaucaauaucaaagaccacagcauuguaucgucuuacguguguuccggacuugucggcgauacgccccgcaagaacgacucaaguagcuccucucauugcuuggauccuaauaacgaggaaggugggcacggagugaaaggcugggcuuuugacgauggcaaugacguuuggauggggcgaaccaucagcgagaagucaagacugggauaugagacauucaaagugauugaagguuggaguaacccaaauuccaagcuacagauaaacaggcaggucaucguggaucggagcaaucguucuggcuacucagggauuuuuaguguagagggaaaaagcuguaucaaccgcugcuucuauguugaacucaucagaggcaggaaggaggaaacugaggugcuguggaccuccaauucuauugucguguuuugugguacaucggggacuuacggcaccggaagcuggcccgacggcgccgauauaaaccuuaugccuaucuga

SEQ ID NO: 144337 - RNA, 1410 nt, Artificial Sequence
  derived and/or modified sequence opt3 from neuraminidase__InfluenzaA__AFJ78125
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaugugccccaaauuagcugaguacaggaauuggaguaagccucagugugacaucacaggguucgcaccauuuagcaaagauaacuccauacggcugucugccggaggugacauuuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcaucgcuuggagcaguuccucuugucaugaugguaaggccuggcuccacgucugcauuacaggggacgauaagaaugcaaccgccagcuucaucuacaacggaaggcugguggacuccaucguaucauggaguaaagagauucugcggacgcaggaaagcgaguguguuugcauaaauggcacuuguacaguggucaugaccgauggcucugcuuccgggaaggcagacacuaaaauccucuuuauugaggaaggaaagaucgugcauacaucaaccuuaagcgguagugcccaacacguggaggaaugcucuugcuauccucgcuacccaggcgucagauguguuugcagggauaacuggaagggguccaaccggccgauaguggacauuaauaucaaagaccacagcaucguaucgucuuacguguguuccggacuggucggcgauacgccccgcaagaacgacucaaguagcuccucucauugccuugauccuaauaacgaggaaggugggcacggagugaaaggcugggcuuucgacgauggcaaugacguuuggauggggcgaaccauuagcgagaagucaagauugggauaugagacauuuaaagugaucgaagguuggaguaacccaaauuccaagcugcagaugaacaggcaggucauuguggaucggggcaaucguagcggguacucuggaauauucucaguagagggcaaaaguuguaucaaccgcugcuuuuauguugaacuaauuagagguaggaaggaggaaacugaggugcucuggaccagcaauuccaucgucguguucugugggacaucuggcacuuacggaaccggcucguggcccgacggggccgauaucaaccugaugccuauuuga

SEQ ID NO: 144338 - RNA, 1410 nt, Artificial Sequence
  derived and/or modified sequence opt3 from neuraminidase__InfluenzaA__AFJ78136
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaauaacacagugcgagaucguacuccauauagaacccugcuuaugaaugaacugggaguucccuuucacuugggcacaaaacaggugugcaucgcuuggagcaguuccucuugucaugacgguaaggccuggcuccacgucugcauuaccggggaugacaagaacgcaacggccagcuucaucuacaauggaaggcugguggauuccaucguaucauggaguaaagagauucugcggacucaggaaagcgaguguguuugcauaaacggcacauguaccguggucaugacugacggcucugcuuccgggaaggcagauacaaaaauccucuuuauugaggaaggaaagaucgugcauaccucaacguuaagcgguagugcccaacacguggaggaaugcucuugcuauccucgcuacccaggcgucagauguguuugcagggacaacuggaagggguccaaucggccgauaguggauauuaacaucaaagaccacagcaucguaucgucuuacguguguuccggacuggucggcgacacaccccgcaagaaugauucaaguagcuccucucauugccuugacccuaacaaugaggaaggugggcacggagugaaaggcugggcuuucgaugacggcaacgauguuuggauggggcgaaccauuagcgagaagucaagauugggauaugagacuuuuaaagugaucgaagguuggaguaauccaaaguccaaacugcagauuaacaggcaggucauaguggaccggggcaaucguagcggguacucuggaaucuucucaguagagggcaagaguuguauuaaccgcugcuuuuauguugaacuaaucagagguaggaaggaggaaaccgaggugcucuggacaagcaauuccaucgucguguucugugggacuucuggcaccuacggaacaggcucguggcccgauggggccgacauuaaccugaugccuauauga

SEQ ID NO: 144339 - RNA, 1410 nt, Artificial Sequence; identical to SEQ ID NO: 144338
  derived and/or modified sequence opt3 from neuraminidase__InfluenzaA__AFJ78147

SEQ ID NO: 144340 - RNA, 1410 nt, Artificial Sequence; identical to SEQ ID NO: 144338
  derived and/or modified sequence opt3 from neuraminidase__InfluenzaA__AFJ78158

SEQ ID NO: 144341 - RNA, 1410 nt, Artificial Sequence; identical to SEQ ID NO: 137900
  derived and/or modified sequence opt3 from neuraminidase__InfluenzaA__AFJ78169

SEQ ID NO: 144342 - RNA, 1410 nt, Artificial Sequence; identical to SEQ ID NO: 138418
  derived and/or modified sequence opt3 from neuraminidase__InfluenzaA__AFJ78180

SEQ ID NO: 144343 - RNA, 1410 nt, Artificial Sequence; identical to SEQ ID NO: 137900
  derived and/or modified sequence opt3 from neuraminidase__InfluenzaA__AFJ78191

SEQ ID NO: 144344 - RNA, 1410 nt, Artificial Sequence
  derived and/or modified sequence opt3 from neuraminidase__InfluenzaA__AFJ78202
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaucaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccauuguaucauggaguaaagagauacugcggacgcaggaaagcgaguguguuugcaucaacggcacuuguacaguggucaugaccgacggcucugcuuccgggaaggcagauacuaaaauucucuuuaucgaggaaggaaagauagugcauacaucaaccuuaagcgguggcgcccaacacguggaggaaugcaguugcuauccucgcuacccaggggucagauguguuugcagggacaacuggaagggaucuaaucggccgauuguggauaucaacaucaaagaccacuccauuguaagcucguacguguguucuggccuggucggugacacgccccgcaagaaugauuccucaaguagcucccauugccuugacccuaacaaugaggaagggggacacggcgugaaaggcugggcuuucgaugacgggaacgauguuuggaugggacgaaccaucucugaaaagagcagauuggguuaugagacauuuaaagugauugagggcuggucaaauccaaagaguaaacugcagauaaacaggcaggucaucguggaccgggggaaucguuccggauacagcggcauuuucucuguagaggguaagucauguaucaaccgcugcuuuuauguugaacuaaucagagggaggaaggaggaaacugaggugcucuggaccaguaauagcauugucguguucuguggcacauccggaacuuacggcaccgggucuuggcccgauggagccgacauaucgcugaugccuaucuga

SEQ ID NO: 144345 - RNA, 1410 nt, Artificial Sequence
  derived and/or modified sequence opt3 from neuraminidase__InfluenzaA__AFJ78213
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccgggaaggcagacacuaaaauucucuuuaucgaggaaggaaagauagugcauacaucaaccuuaagcgguagugcccaacacguggaggaaugcucuugcuauccucgcuacccaggcgucagauguguuugcagggauaacuggaagggguccaaccggccgauuguggacaucaauaucaaagaccacagcauuguaucgucuuacguguguuccggacuggucggcgauacgccccgcaagaacgacucaaguagcuccucucauugccuugauccuaauaacgaggaaggugggcacggagugaaaggcugggcuuucgacgauggcaaugacguuuggauggggcgaaccaucagcgagaagucaagauugggauaugagacauuuaaagugauugaagguuggaguaacccaaaguccaaacugcagauaaauaggcaggucaucguggaucggggcaaccguagcggguacucuggaauuuucucaguagagggcaagaguuguaucaaucgcugcuuuuauguugaacuaaucagagguaggaaggaggaaacugaggugcucuggaccagcaacuccauugucguguucugugggacaucuggcacuuacggaaccggcucguggcccgacggggccgauauaaaucugaugcuuaucuga

SEQ ID NO: 144346 - RNA, 1410 nt, Artificial Sequence; identical to SEQ ID NO: 137900
  derived and/or modified sequence opt3 from neuraminidase__InfluenzaA__AFJ78224

SEQ ID NO: 144347 - RNA, 1410 nt, Artificial Sequence; identical to SEQ ID NO: 137900
  derived and/or modified sequence opt3 from neuraminidase__InfluenzaA__AFJ78235

SEQ ID NO: 144348 - RNA, 1410 nt, Artificial Sequence
  derived and/or modified sequence opt3 from neuraminidase__InfluenzaA__AFJ78246
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccaggcuaugcugugugaaccgacuauaaucgagagaaauauuaccgaaaucguuuauuugacaaacaccacuauugagaaggaaaucugccccaaauuagcagaguacaggaauuggaguaagccucagugugacauaacaggguucgccccauuuagcaaagauaacuccauucggcugucugcgggaggugacaucugggugacccgcgagcccuauguaucgugcgauccugacaaguguuaccaauucgcucuaggccaggggacgacucucaauaacgugcauucaaaugauaccguccgagaccguacaccauauagaacucugcuuaugaacgaacugggagugcccuuucacuugggcaccaagcagguuugcauugccuggagcaguuccucuugucaugaugguaaagcauggcuccacgugugcaucacaggggacgauaagaaugccaccgcuagcuucaucuacaacggaaggcuggucgacuccauugugucauggaguaaagagauacugcggacgcaggaaagcgaguguguaugcaucaauggcacuuguacaguugugaugaccgauggcucugcauccgggaaggccgacacuaaaauucucuuuaucgaggaaggaaagauaguccauacaucaaccuuaagcgguagugcucaacacguggaggaaugcucuugcuauccucgcuacccaggcgugagaugugucugcagggauaacuggaagggguccaaccggccgauuguugacaucaauaucaaagaccacagcauugugucgucuuacguauguuccggacuggugggcgauacgccccgcaagaacgacucaaguagcuccucucauugccuugauccuaauaacgaggaaggugggcacggagucaaaggcugggccuucgacgauggcaaugacguguggauggggcgaaccaucagcgagaagucaagauugggauaugagacauuuaaaguuauugaagguuggaguaacccaaaguccaaacugcagauaaauaggcaagugaucgucgaucggggcaaccguagcggguacucuggaauuuucucaguggagggcaagaguuguaucaaucgcugcuuuuauguagaacuaaucagagguaggaaggaggaaacugagguucucuggaccagcaacuccauuguggucuucugugggacaucuggcacuuacggaaccggcucguggcccgacggggcggauauaaaucugaugccuaucuga

SEQ ID NO: 144349 - RNA, 1410 nt, Artificial Sequence
  derived and/or modified sequence opt3 from neuraminidase__InfluenzaA__AFJ78268
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaauaacacagugcgagaucguacuccauauagaacccugcuuaugaaugaacugggaguucccuuucacuugggcacaaaacaggugugcaucgcuuggagcaguuccucuugucaugacgguaaggccuggcuccacgucugcauuaccggggaugacaagaacgcaacggccagcuucaucuacaauggaaggcugguggauuccaucguaucauggaguaaagagauucugcggacucaggaaagcgaguguguuugcauaaacggcacauguaccguggucaugacugacggcucugcuuccgggaaggcagauacaaaaauccucuuuauugaggaaggaaagaucgugcauaccucaaaguuaagcgguagugcccaacacguggaggaaugcucuugcuauccucgcuacccaggcgucagauguguuugcagggacaacuggaaaggguccaaucggccgauaguggauauuaacaugaaggaccacagcaucguaucgucuuacguguguuccggacuggucggcgacacgccccgcaaaaaugauucaaguagcuccucucauugccuugacccuaacaaugaggaaggugggcacggagugaagggcugggcuuucgaugacggcaacgauguuuggauggggcgaaccaucagcgagaaaucaagauugggauaugagacauuuaaggugauugaagguuggaguaauccaaaauccaagcugcagaucaacaggcaggucauuguggaccggggcaaucguagcggguacucuggaauauucucaguagagggcaagaguuguaucaaccgcugcuuuuauguugaacuaauuagagguaggaaagaggaaacugaggugcucuggaccagcaauuccaucgucguguucugugggacaucuggcacuuacggaaccggcucguggcccgauggggccgacaucaaccugaugccuauuuga

SEQ ID NO: 144350 - RNA, 1410 nt, Artificial Sequence
  derived and/or modified sequence opt3 from neuraminidase__InfluenzaA__AFJ78279
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaucaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccauuguaucauggaguaaagagauacugcggacgcaggaaagcgaguguguuugcaucaacggcacuuguacaguggucaugaccgacggcucugcuuccgggaaggcagauacuaaaauucucuuuaucgaggaaggaaagauagugcauacaucaaccuuaagcgguggcgcccaacacguggaggaaugcaguugcuauccucgcuacccaggggucagauguguuugcagggacaacuggaagggaucuaaucggccgauuguggauaucaacaucaaagaccacuccauuguaagcucguacguguguucuggccuggucggugacacgccccgcaagaaugauuccucaaguagcucccauugccuugacccuaacaaugaggaagggggacacggcgugaaaggcugggcuuucgaugacgggaacgauguuuggaugggacgaaccaucucugaaaagagcagauuggguuaugagacauuuaaagugauugagggcuggucaaauccaaagaguaaacugcagauaaacaggcaggucaucguggaccgggggaaucguuccggauacagcggcauuuucucuguagaggguaagucauguaucaaccgcugcuuuuauguugaacuaaucagagggaggaaggaggaaacugaggugcucuggaccaguaauagcauugucguguucuguggcacauccggaacuuacggcaccgggucuuggcccgauggagccgacauaaaccugaugccuaucuga

SEQ ID NO: 144351 - RNA, 1410 nt, Artificial Sequence
  derived and/or modified sequence opt3 from neuraminidase__InfluenzaA__AFJ78290
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucagccuuaagcgguagugcucaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacccccaggaagaaugauucaaguagcuccucucauugccuugacccuaacaaugaggaaggugggcacggaguuaaaggcugggccuucgaugacggcaacgauguguggauggggcgaacgauuagcgagaagucaagauugggauaugagaccuuuaaagucaucgaagguuggaguaauccaaaguccaaacugcagauuaaccgccaggugauaguagaccggggcaaucguagcggguacucuggaaucuucucaguugagggcaagaguuguauuaaccgcugcuuuuauguggaacuaaucagagguaggaaggaggaaacagagguccucuggacuagcaauuccaucguggucuucugugggaccucuggcacauacggaacuggcucguggcccgauggggcggacauuaaccugaugccuauauga

SEQ ID NO: 144352 - RNA, 1413 nt, Artificial Sequence
  derived and/or modified sequence opt3 from neuraminidase__InfluenzaA__AFJ78312
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcugggagaaaagaaucuugaggacacaggagucggaaugcguguguguaaauggcucuugcuuuacuauuaugaccgauggucccuccaacggggccgcgucauacaagaucuucaaaauugagaagggaaagguuacaaaaaguauagaacucaaugcaccuaacagccacuaugaggaguguuccugcuacccagacaccggcacggugaugugugucugccgggauaauuggcacggcucuaaccgccccugggugagcuuuaaucagaaccuggacuaccagaucggguauauuugcucaggaguguucggugauaauccuagaccaaaggacggcgaagggaguuguaacccggucacugccgauggagcugacggcguuaaagguuuuuccuacaaguaugggaauggcguguggaucggaaggacaaaaagcaaccggcugcgcaagggcuucgagaugaucugggaccccaauggguggaccgauacugacucugauuuuucaguaaaacaagacguggucgccauuacagauuggaguggauacagcgguuccuucgugcagcauccugaacucaccggcuuagacugcauacgaccauguuuuuggguugagcuggugagagggaggccccgggaaaacacgaccaucuggacaucuggaucgagcauuuccuucugcggcgucaauucagauacugcaaacuggaguuggccugacggugcugagcuuccauucaccaucgauaaguga

SEQ ID NO: 144353 - RNA, 1410 nt, Artificial Sequence; identical to SEQ ID NO: 144285
  derived and/or modified sequence opt3 from neuraminidase__InfluenzaA__AFJ78323

SEQ ID NO: 144354 - RNA, 1413 nt, Artificial Sequence
  derived and/or modified sequence opt3 from neuraminidase__InfluenzaA__AFJ78334
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugugaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagcagaucuugagaacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugcagggauaauuggcacggcuccaaccggcccugggugucuuucaaucagaaccuggacuaccaaaucggguauauuugcagcggaguguuuggugauaauccucgcccaaaagacggcgaggggucauguaacccggucacuguugauggagccgacggcgugaaggguuucaguuacaaauaugggaauggcguauggaucggaagaacaaaguccaacaggcugcggaaaggcuuugaaaugaucugggaccccaauggguggaccgauacugacagcgauuucucugugaagcaggacgucguggcuauuacagauuggucaggauacagugguagcuuuguucagcauccugagcucaccggcuuagacugcauacgcccauguuucuggguggaacugguccgagggcuucccagagagaacacgaccaucuggacauccggaucuucgauuagcuucugcggcgucaauuccgauacugccaacuggucauggccugacggugcagaauugccauuuaccaucgauaaguga

SEQ ID NO: 144355 - RNA, 1413 nt, Artificial Sequence; identical to SEQ ID NO: 144354
  derived and/or modified sequence opt3 from neuraminidase__InfluenzaA__AFJ78345

SEQ ID NO: 144356 - RNA, 1413 nt, Artificial Sequence
  derived and/or modified sequence opt3 from neuraminidase__InfluenzaA__AFJ78356
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugugaauaucaacaauacuaacguugugguagggaaagacaagaccucggugacacuugcaggaaauucaagccuguguaguauuuccggcugggccaucuacaccaaagauaacucuaucaggauugguagcaagggggacgucuucgugauacgggagccuuuuaucuccugcucacauuuggagugucgcacuuucuuuuuaacacaaggagcgcugcuaaaugauaaacacaguaacggcaccguuaaggaccgaagcccauaucgugcucucaugucuugcccgcugggcgaagcccccuccccuuacaauucaaaguucgagagcguggcauggagugccucugcuugucaugaugggaugggauggcuuacgauugguaucuccggcccagacaacggggcagucgccgugcugaaauauaacggaauaauuacugaaaccaucaagagcuggaaaaagcagaucuugagaacacaggagucggagugcguauguguuaauggcucuugcuuuacuauuaugaccgauggucccuccaacggggcugccucauacaaaaucuucaagauugaaaagggaaaagugacaaagaguauagagcucaaugcgccuaacuuucacuaugaagaguguagcugcuacccagacaccggcacggucauguguaucugcagggauaauuggcacggcuccaaccggcccugggugucuuucaaucagaaccuggacuaccaaauuggguauaucugcagcggaguguuuggugauaauccucgcccaaaagacggcgaggggucauguaacccggucacuguugauggagcagacggcgugaaggguuucaguuacaaauaugggaauggcguauggaucggaagaacaaaguccaacaggcugcggaaaggcuuugaaaugauuugggaccccaauggguggaccgauacugacagcgauuucucugugaagcaggacgucguggccauaacagauuggucaggauacagugguagcuuuguucagcauccugagcucaccggcuuagacugcauccgcccauguuucuggguggaacugguccgagggcuucccagagagaacacgaccauuuggacauccggaucuucgaucagcuucugcggcgucaauuccgauacugcuaacuggucauggccugacggugccgaauugccauuuaccauugauaaguga

SEQ ID NO: 144357 - RNA, 1413 nt, Artificial Sequence
  derived and/or modified sequence opt3 from neuraminidase__InfluenzaA__AFJ78367
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacagccacuaugaagaguguuccugcuacccagacaccggcacggugaugugugucugccgggauaauuggcacggcucuaaccgccccugggugagcuuuaaucagaaccuggacuaccagaucggguauauuugcucaggaguguucggugauaauccuagaccaaaagacggcgaggggaguuguaacccggucacugccgauggagcugacggcguuaaggguuuuuccuacaaauaugggaauggcguguggaucggaaggacaaagagcaaccggcugcgcaaaggcuucgaaaugaucugggaccccaauggguggaccgauacugacucugauuuuucaguaaagcaagacguggucgccauuacagauuggaguggauacagcgguuccuucgugcagcauccugagcucaccggcuuagacugcauacgaccauguuuuuggguugaacuggugagagggaggccccgggagaacacgaccaucuggacaucuggaucgagcauuuccuucugcggcgucaauggugauacugcaaacuggucauggccugacggggcugaacuuccauucaccaucgauaaguga

SEQ ID NO: 144358 - RNA, 1413 nt, Artificial Sequence
  derived and/or modified sequence opt3 from neuraminidase__InfluenzaA__AFJ78378
augaaccccaaucagaaggugaucaccauuggcagcauauccaucgccauugggaucauuucucugaugcuccaaaucggaaacauaaucucaauuugggcuagucacagcauccagacagguucccagaaucauacuggcauuugcaaccagagaaucauaacguacgaaaauucuaccugggucaaccacacauauguuaauauuaacaauacuaacgugguagcagggaaagacaagaccucggugacacuugccggaaauucaagccuguguaguaucuccggcugggcgauuuacaccaaagauaacucuaucaggaucgguagcaagggggacgucuucgugauucgggagccuuuuauauccugcucacauauggagugucgcacuuucuuuuugacacaaggagcuuuacugaaugauaaacacaguaacggcaccguuaaggaccgaagcccauaucgugcccuaaugucuugcccgcucggcgaagcacccuccccuuacaauucaaaguucgagagcguggccuggagugcuucugcaugucaugaugggaugggauggcugacgaucgguauuuccggcccagacaacggggccgucgcugugcuuaaauauaacggaaucauaacugaaaccauuaagagcuggaaaaagagaauccugaggacacaggagucggagugcguauguguuaauggcucuugcuuuacuaucaugaccgauggucccuccaacggggccgcgucauacaaaauuuucaagaucgaaaagggaaaagugacaaagaguauugaguugaaugcaccuaacagccacuaugaagaguguuccugcuacccagacaccggcacggucaugugugugugccgggauaauuggcacggcucuaaccgccccugggugagcuuuaaucagaaccucgacuaccagauaggguauaucugcucaggagucuucggugauaauccuagaccaagggacggcgaggggaguuguaacccgguuacuguggauggagccgacggcguaaaagguuuuuccuacaaguaugggaauggcguguggauuggacggacaaaaagcaaccgccugcgaaagggcuucgaaaugaucugggaccccaauggguggaccgauacugacucugauuuugcugucaaacaagacgugguugccaucacagauuggucaggauacagugguagcuucgugcagcauccugagcugaccggccucgacugcauuagaccauguuuuugggucgaauuagugagggggcugccccgggagaacacgaccauauggacauccggaucuucgaucagcuucugcggcguaaauuccgauacugcaaacuggucauggccugacggugcugaacuuccauucaccauugauaaguga

SEQ ID NO: 144359 - RNA, 1413 nt, Artificial Sequence; identical to SEQ ID NO: 136402
  derived and/or modified sequence opt3 from neuraminidase__InfluenzaA__AFJ78389

SEQ ID NO: 144360 - RNA, 1413 nt, Artificial Sequence; identical to SEQ ID NO: 136402
  derived and/or modified sequence opt3 from neuraminidase__InfluenzaA__AFJ78400

SEQ ID NO: 144361 - RNA, 1413 nt, Artificial Sequence; identical to SEQ ID NO: 136402
  derived and/or modified sequence opt3 from neuraminidase__InfluenzaA__AFJ78411

SEQ ID NO: 144362 - RNA, 1413 nt, Artificial Sequence
  derived and/or modified sequence opt3 from neuraminidase__InfluenzaA__AFJ78422
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggacgggauggcuuacuauugguaucuccggcccagacaacggggccguggcuguccugaaauauaacggaauaauuaccgaaacaaucaagagcuggaaaaagagaaucuugaggacucaggagucggagugcguguguaugaauggcucuugcuuuaccauuaugacagauggucccuccaacggggccgcgucauacaaaaucuucaagauugaaaagggaaaaguaaccaagaguauagagcucaaugcaccuagcuuucacuaugaagaguguuccugcuacccagacacgggcacuguuaugugugugugccgggauaacuggcacggcucuaaucgccccugggucagcuucaaccagaaucuggacuaccagaucggguauauuugcucaggaguguuuggugauaacccuagaccacaagacggcgaggggaguuguaauccggugacagucgauggagccgacggcguuaaagguuucuccuacaaguaugggaacggcguguggaucggaaggaccaaaagcaaucggcugcgcaagggcuuugaaaugaucugggaccccaacggguggacuaauacagauucugacuucucaguaaaacaggauguggucgcuauuaccgacuggaguggauacagcgguuccuuugugcagcauccugagcucacgggcuuagauugcauacgaccauguuucuggguugaacuggugagagggcuucccagggagaacaccacaaucuggacuucuggaucgagcauuuccuucugcggcgucaauucagacaccgccaacuggaguuggccugauggugcagaauugccauuuacaaucgacaaguga

SEQ ID NO: 144363 - RNA, 1413 nt, Artificial Sequence; identical to SEQ ID NO: 138509
  derived and/or modified sequence opt3 from neuraminidase__InfluenzaA__AFJ78433

SEQ ID NO: 144364 - RNA, 1413 nt, Artificial Sequence; identical to SEQ ID NO: 138509
  derived and/or modified sequence opt3 from neuraminidase__InfluenzaA__AFJ78444

SEQ ID NO: 144365 - RNA, 1413 nt, Artificial Sequence
  derived and/or modified sequence opt3 from neuraminidase__InfluenzaA__AFJ78466
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggauuggauggcuuacgaucgguauauccggcccagacaacggggccguggcuguccugaaauauaacggaauuaucacuggcaccaucaagagcuggaaaaagcagauuuugagaacacaggaaucggagugcguguguaucaaugguucuugcuuuacuauuaugaccgaugggcccuccaacggagccgcgucauacaaaauauucaagaucgagaagggcaaaguaacaaagaguauugaacucaaugcaccuaacuuucacuaugaggaauguagcugcuacccagacaccggcacgguuaugugugugugcagggauaauuggcacggguccaaccggcccugggucucuuucaaucagaaccuggacuaccaaaucggauauaucugcagcgguguguuuggcgauaauccucgcccaaaagacggggagggaagauguaacccggugacugucgauggcgccgacgguguuaagggguucucauacaaauauggcaauggaguguggauuggcaggacaaagaguaaccggcugcgcaaaggguuugagaugauaugggaccccaauggauggaccaacacugauuccgacuucagcguaaagcaggauguggucgcuaucacagacuggucugguuacucaggcaguuuugugcagcauccugaacucaccggguuagauugcauucgaccauguuucuggguugagcuggugagaggacuucccagggaaaauacgaccaucuggacaagcggcuccucuauuucguucugcggugucaacagcgacacugccaacugguccuggccugauggggcagaguugccauuuaccaucgacaaguga

SEQ ID NO: 144366 - RNA, 1413 nt, Artificial Sequence
  derived and/or modified sequence opt3 from neuraminidase__InfluenzaA__AFJ78477
augaaccccaaucagaagaucauuaccauaggcagcaucuccauugccaucgggauuaucggacugaugcuccaaauagguaacaucauuucuaucugggcuucacacaguauucagacaggcagccagaaucauacugggaucugcucccagagaauaauuacguacgagaacucuaccugggugaauaacacauaugucaauaucaacaauacuaacguuguggcagaaaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacacuuggaaugucgcacuuucuuuuuaacacaaggagcucugcuaaaugauaaacauaguaacggcaccgugaaggaccgaagcccauaucgugcccucaugucuugcccgcugggcgaggcacccuccccuuacaauucaagauucgaaagcguugccuggagugcuucugcaugucacgaugggaugggauggcuuacgauugguaucuccggcccagacaacggggccguggcuguccugaaguauaacggaauaauuacugagaccaucaaaagcuggaagaaaaggaucuugcggacacaggagucggaaugcguguguaugaauggcucuugcuuuacuauuaugaccgauggucccuccaacggggccgcgucauacaagaucuucaaaauugagaagggaaagguaacaaaaaguauagaacucaaugcaccuaacuuucauuaugaggaguguagcugcuacccagacaccggcacgguuaugugugugugccgcgauaauuggcacggcuccaacagacccugggucucuuucaaucagaaccuggacuaccagaucggguauauuugcagcggaguguuuggugauaauccuaggccaaaggacggcgaagggucauguaacccggugacugucgauggagccgacggcguuaaagguuucaguuacaaguaugggaauggcguguggaucggacggacaaaauccaaccgccugcgaaagggcuuugagaugaucugggaccccaauggguggaccaacacugauagcgacuucucuguaaaacaagauguggucgcuauuacagacuggucaggauacagugguagcuuugugcagcacccugaacucaccggcuuagauugcauaagaccauguuucuggguugagcuggugagggggcuuccccgggaaaauacgaccaucuggacauccggaucuucgauuagcuucugcggcgucaacuccgguacugccaacuggucauggccugacggggcagaguugccauuuaccaucgauaaguga

SEQ ID NO: 144367 - RNA, 1413 nt, Artificial Sequence
  derived and/or modified sequence opt3 from neuraminidase__InfluenzaA__AFJ78488
augaaccccaaucagaagaucauuaccauaggcagcaucuccauugccaucgggauuaucucucugauacuccaaaucggaaacauuaucucaauuugggcuagucacagcauccagacagguucccagaaucauacuggcauaugcaaccagagaauuaucacguacgaaaauucuaccugggugaacaauacauaugucaacauuaauaacacuaauguuguggcagagaaagacaagaccucgguaacacuugccgggaacucaagccuguguaguaucuccggaugggcgaucuacaccaaagauaauucuauuaggauaggcagcaagggugacguguucgucauccgggagccuuuuauuuccugcucacacuuggaaugucgcacuuucuuuuuaacacaaggggcucugcuaaacgauaaacauaguaauggaaccgugaaggaccgaagcccauaucgugcccucaugucuugcccgcugggcgaggcacccuccccuuacaacucaagauucgaaagcguugccuggagugcuucugcaugucacgauggcaugggguggcuuacgaucggaauauccgguccagacaacggcgccguggcuguccugaaguauaaugggauuaucacugagaccaucaaaagcuggaagaaaaggauuuugcggacacaggagucggaaugcguguguaugaacggaucuugcuuuacuaucaugaccgauggccccuccaauggugccgcgucauacaagauuuucaaaauagagaaggggaagguaacaaaaaccaucgaacucaacgcaccuaauuuucauuaugaggaguguaguugcuacccagacacgggaacuguuaugugugugugccgcgauaacuggcacggcagcaauagacccugggucuccuucaaccagaaucuggacuaccagauuggcuauaucugcucugggguguuuggagauaacccuaggccaaaggacggugaaggcagcuguaauccggugacagucgauggggccgacggaguuaaaggcuucucauacaaguaugguaacgggguguggaucggccggaccaaaaguaaucgccugcgaaagggauuugagaugauuugggaccccaacggcuggacuaauacagauuccgacuucagcaugaaacaagauguaguggcuauaaccgacuggucuggguacucaggaaguuuuguccagcacccugaacucacggguuuagauugcaucagaccauguuucuggguggagcugguuaggggccuuccccgggaaaacaccacaauuuggacuagcggguccucuaucucguucugcggagugaacagcggcaccgccaauugguccuggccugacggugcagaguugccauuuacaauugauaaguga

SEQ ID NO: 144368 - RNA, 1413 nt, Artificial Sequence
  derived and/or modified sequence opt3 from neuraminidase__InfluenzaA__AFJ78510
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacuggcaccaucaagagcuggaaaaagcagaucuugagaacacaggaaucggagugcguguguaugaaugguucuugcuuuacuauuaugaccgaugggcccuccaacggagccgcgucauacaaaaucuucaagauugagaagggcaaaguaacaaagaguauagaacucaaugcaccuaacuuucacuaugaggaauguagcugcuacccagacaccggcaucguuaugugugugugcagggauaauuggcacggguccaaccggcccugggucucuuucaaucagaaccuggacuaccaaauuggauauaucugcagcgguguguuuggcgauaauccucgcccaaaagacggggagggaucauguaacccggugacggucgauggcgccgacgguguuaagggguucaguuacaaauaugacaauggcguguggaucggaagaacuaaguccaacaggcugcggaaaggcuuugagaugauuugggaucccaauggguggacaaacaccgacagcgauuucucuguaaagcaggacguggucgcuauaacugauuggucaggauacagugguagcuuugugcagcauccugaacucacaggcuuagacugcauccgcccauguuucuggguugagcuggugcgagggcuucccagagaaaauaccacgauuuggaccuccggaucuucgaucagcuucugcggcgucaacuccgauacagccaacuggucauggccugacggugcagaguugccauuuacuauugauaaguga

SEQ ID NO: 144369 - RNA, 1413 nt, Artificial Sequence
  derived and/or modified sequence opt3 from neuraminidase__InfluenzaA__AFJ78521
augaaccccaaucagaagaucauuaccauaggcagcaucuccauugccaucgggauuaucucucugauacuccaaaucggaaacauuaucucaauuugggcuagucacagcauccagacagguucccagaaucauacuggcauaugcaaccagagaauuaucacguacgaaaauucuaccugggugaacaauacauaugucaacauuaauaacacuaauguuguggcagagaaagacaagaccucgguaacacuugccgggaacucaagccuguguaguaucuccggaugggcgaucuacaccaaagauaauucuauuaggauaggcagcaagggugacguguucgucauccgggagccuuuuauuuccugcucacacuuggaaugucgcacuuucuuuuuaacacaaggggcucugcuaaacgauaaacauaguaauggaaccgugaaggaccgaagcccauaucgugcccucaugucuugcccgcugggcgaggcacccuccccuuacaacucaagauucgaaagcguugccuggagugcuucugcaugucacgauggcaugggguggcuuacgaucggaauauccgguccagacaacggcgccguggcuguccugaaguauaaugggauuaucacugagaccaucaaaagcuggaagaaaaggauuuugcggacacaggagucggaaugcguguguaugaacggaucuugcuuuacuaucaugaccgauggccccuccaauggugccgcgucauacaagauuuucaaaauagagaaggggaagguaacaaaaaccaucgaacucaacgcaccuaauuuucauuaugaggaguguaguugcuacccagacacgggaacuguuaugugugugugccgcgauaacuggcacggcagcaauagacccugggucuccuucaaccagaaucuggacuaccagauuggcuauaucugcucugggguguuuggagauaacccuaggccaaaggacggugaaggcagcuguaauccggugacagucgauggggccgacggaguuaaaggcuucucauacaaguaugguaacgggguguggaucggccggaccaaaaguaaucgccugcgaaagggauuugagaugauuugggaccccaacggcuggacuaauacagauuccgacuucagcguaaaacaagauguggucgcuauaaccgacuggucuggguacucaggaaguuuugugcagcacccugaacucacggguuuagauugcaucagaccauguuucuggguugagcuggugaggggccuuccccgggaaaacaccacaauuuggacuagcggguccucuaucucguucugcggagucaacagcggcaccgccaauugguccuggccugacggugcagaguugccauuuacaauugauaaguga

SEQ ID NO: 144370 - RNA, 1413 nt, Artificial Sequence; identical to SEQ ID NO: 144263
  derived and/or modified sequence opt3 from neuraminidase__InfluenzaA__AFJ78532

SEQ ID NO: 144371 - RNA, 1413 nt, Artificial Sequence; identical to SEQ ID NO: 144263
  derived and/or modified sequence opt3 from neuraminidase__InfluenzaA__AFJ78543

SEQ ID NO: 144372 - RNA, 1413 nt, Artificial Sequence; identical to SEQ ID NO: 144263
  derived and/or modified sequence opt3 from neuraminidase__InfluenzaA__AFJ78554

SEQ ID NO: 144373 - RNA, 1413 nt, Artificial Sequence; identical to SEQ ID NO: 144251
  derived and/or modified sequence opt3 from neuraminidase__InfluenzaA__AFJ78565

SEQ ID NO: 144374 - RNA, 1413 nt, Artificial Sequence
  derived and/or modified sequence opt3 from neuraminidase__InfluenzaA__AFJ78576
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgagaauaguaccugggugaaccacacauaugucaauaucaacaauacuaacguuguggcagggaaagacaagaccccuguaacacuugccggaaauucgucacuguguagcauuaguggcugggcgauccauaccaaagauaacuccaucaggauugguucuaagggggacguguucgucauacgggaaccauuuaucagcugcucccacuuggaguguaaaacuuucuuuuuaacacaaggagcucugcuaaaugauaagcauucaaacggcaccgugaaggaccgcaguccguaccgagcccucaugagcugcccccugggcgaagcaccuucuccauauaauuccaaauucgagucaguugccuggagcgcuagugcaugucacgaugggauuggauggcuuacgaucgguauaucuggccccgacaacggggccguggcuguccugaaguacaacggaauuaucacuggcaccaucaaauccuggaagaaacagauuuugcguacacaggaaagcgagugcguguguaugaaugguucgugcuuuacuaucaugaccgaugggccuucuaacggagccgcguccuauaagauuuucaagauagagaaaggcaagguaacaaaaucaauggaacucaaugcaccaaacuuucacuacgaggaauguaguugcuaucccgacaccggcacgguuaugugugugugcagagauaauuggcaugggagcaacaggccuugggucuccuucaaucagaaccuggacuaccaaaucggauacauuugcacugguguguuuggcgauaauccacggccggaggacggggagggaucuuguaaccccgugacagucgauggcgccaaugguguuaagggguucagcuauaaauacggcaacggaguguggaucggccgcaccaagucaaauagaaucaggaaaggguuugaaaugauuugggacccuaacggauggacuaauacagacagugauuucuccguaaagcaggacauaguggcuaucaccgauuggagcgguuauucuggcucauuuguccagcacccagagcugacggggcucgacugcauucggcccuguuucuggguggaauuaguucgcggacugccucgagagaacaccacaaucuggacuucuggcagcuccauuucuuucugcggugugaacucggauaucgccaauuggagcuggccagacggggcagaacuucccuuuaccauagauaaguga

SEQ ID NO: 144375 - RNA, 1413 nt, Artificial Sequence
  derived and/or modified sequence opt3 from neuraminidase__InfluenzaA__AFJ78598
augaaccccaaucagaagaucauuaccauaggcagcaucuccauugccaucgggauuaucucucugaugcuccaaauaggaaacaucauuucaaucugggcuagucacagcauucagacagguauccagaauaacacuggcauaugcaaucagagaauuaucacguacgagaacuccaccugggugaaucauacauaugucaacauuaauaacacuaauguuguggcaggggaagacaaaaccucuguaacacuugccggaaacucgucacuguguagcaucaguggcugggcgaucuacaccaaggauaauuccauuaggauagguucuaaaggggacguguucgucauccgggagccuuuuauuagcugcucccacuuggaaugucgcacuuucuuuuuaacacaaggagcucugcuaaacgauaagcauucaaauggcaccgugaaagaccgaaguccauaucgugcccucaugagcugcccgcugggcgaggcacccucuccuuacaacuccaaguucgaaucaguugccuggagcgcuagugcaugucacgaugggaugggauggcuuacgaucgguauaucuggcccagacaacggggccguggcuguccugaaguauaauggaauuaucacuggcaccaucaaauccuggaagaaacagauuuugagaacacaggagagcgagugcguguguaugaacgguucgugcuuuacuaucaugaccgaugggcccucuaauaaggccgcguccuacaaaauuuucaagauagaaaagggaaaaguaacaaagucaaucgagcucaacgcaccuaauuuucauuaugaagaguguaguugcuacccagacaccggcauuguuaugugugugugcagggauaacuggcacggcagcaaucggcccugggucuccuucaaccagaaucuggacuaccaaaucggguauaucugcucuggaguguuuggugauaacccucgcccagaggacggcgaagggagcuguaauccggugacggucgauggagccaacggcguuaaagguuucucauacaaguaugacaaugggguguggauuggcagaacuaaaaguaacaggcugcggaagggauuugagaugauaugggaccccaauggcuggacaaacaccgauuccgacuucagcguaaaacaggauguggucgcuaucacugacuggucuggguacucaggaaguuuugugcagcacccugaacucacagguuuagauugcauucgcccauguuucuggguugagcuggugcgaggccuucccagagaaaacaccacgaucuggaccagcggguccucuauuucguucugcggagucaauagcgacacagccaacugguccuggccugauggcgcagaguugccauuuacuaucgacaaguga

SEQ ID NO: 144376 - RNA, 1413 nt, Artificial Sequence
  derived and/or modified sequence opt3 from neuraminidase__InfluenzaA__AFJ78609
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaauucuugccggaaacucaagccuguguaguaucuccggcugggcgaucuacacaaaggauaauucuauuaggauagguagcaaaggggacguguucgucauccgggagccuuuuauuuccugcucacacuuggaaugucgcaccuucuuuuuaacucaaggagcucugcuaaacgauaagcauaguaauggcacagugaaagaccgaagcccauaucgugcccucaugucuugcccgcugggcgaggcacccuccccuuacaacucaaaguucgaaagcguugccuggagugcuucugcaugucacgaugggaugggauggcuuaccaucgguauauccggcccagacaacggggccguggcuguccugaaguauaauggaauuaucacgggcacuaucaaaagcuggaagaaacagauuuugagaacccaggagucggagugcguguguaugaacgguucuugcuuuacaaucaugacugaugggcccuccaauaaggccgcgucauacaaaauuuucaagauagaaaagggaaaaguaaccaagaguaucgagcucaacgcaccuaauuuuuauuacgaagaguguagcugcuacccagacacaggcauuguuaugugugugugcagggauaacuggcauggcuccaaucggcccugggucucuuucaaccagaaucuggacuaucaaaucggguacaucugcagcggaguguuuggugauaacccucgcccagaggacggcgaagggucauguaauccggugaccgucgauggagccaacggcguuaaagguuucaguuauaaguacgggaauggcguguggauuggaagaacgaaauccaacaggcugcggaagggcuuugagaugauaugggaccccaauggguggacuaacacagacagcgauuucucuguaaaacaggacguggucgcuaucaccgauuggucaggauauagugguagcuuugugcagcacccugaacucacuggcuuagacugcauucgcccauguuucuggguugagcuggugcgagggcuucccagagaaaacacaaccaucuggacguccggaucuucgauuagcuucugcggcgucaauuccgauaccgccaacuggucauggccugacggugcagaguugccauuuacaaucgauaaguga

SEQ ID NO: 144377 - RNA, 1413 nt, Artificial Sequence; identical to SEQ ID NO: 139477
  derived and/or modified sequence opt3 from neuraminidase__InfluenzaA__AFJ78620

SEQ ID NO: 144378 - RNA, 1413 nt, Artificial Sequence; identical to SEQ ID NO: 144251
  derived and/or modified sequence opt3 from neuraminidase__InfluenzaA__AFJ78631

SEQ ID NO: 144379 - RNA, 1413 nt, Artificial Sequence; identical to SEQ ID NO: 139477
  derived and/or modified sequence opt3 from neuraminidase__InfluenzaA__AFJ78642

SEQ ID NO: 144380 - RNA, 1413 nt, Artificial Sequence; identical to SEQ ID NO: 139477
  derived and/or modified sequence opt3 from neuraminidase__InfluenzaA__AFJ78653

SEQ ID NO: 144381 - RNA, 1410 nt, Artificial Sequence; identical to SEQ ID NO: 138754
  derived and/or modified sequence opt3 from neuraminidase__InfluenzaA__AFJ78664

SEQ ID NO: 144382 - RNA, 1410 nt, Artificial Sequence; identical to SEQ ID NO: 138754
  derived and/or modified sequence opt3 from neuraminidase__InfluenzaA__AFJ78674

SEQ ID NO: 144383 - RNA, 1410 nt, Artificial Sequence; identical to SEQ ID NO: 138754
  derived and/or modified sequence opt3 from neuraminidase__InfluenzaA__AFJ78684

SEQ ID NO: 144384 - RNA, 1410 nt, Artificial Sequence; identical to SEQ ID NO: 138754
  derived and/or modified sequence opt3 from neuraminidase__InfluenzaA__AFJ78694

SEQ ID NO: 144385 - RNA, 1410 nt, Artificial Sequence; identical to SEQ ID NO: 138754
  derived and/or modified sequence opt3 from neuraminidase__InfluenzaA__AFJ78704

SEQ ID NO: 144386 - RNA, 1410 nt, Artificial Sequence; identical to SEQ ID NO: 138754
  derived and/or modified sequence opt3 from neuraminidase__InfluenzaA__AFJ78714

SEQ ID NO: 144387 - RNA, 1410 nt, Artificial Sequence
  derived and/or modified sequence opt3 from neuraminidase__InfluenzaA__AFJ78724
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucacccucaugacagauggaccaucugacggccaggcuuccuacaaaaucuuucggauugaaaaggguaaaaucgucaagucaguggagaugaaugcccccaacuaucauuacgaagagugcaguuguuacccugauagcuccgagauuacuugcgugugccgcgacaauuggcacgggucuaacagaccaugggucagcuucaaucagaaccuggaauaucagauaggauacaucuguucaggcauuuuuggcgauaauccgaggcccaacgacaaaaccgggaguugcggaccuguuuccagcaauggugcgaacggcgugaagggguucucuuuuaaguauggaaacggcguauggaucggucggacaaaaucaaucaguagccgcaauggguucgagaugauuugggauccaaacggcuggaccggaacggacaauaacuuuuccauaaagcaagacaucgugggcauuaaugaauggucuggguacucggggagcuucguccagcaucccgagcugacuggucucgauuguauccgaccuugcuucuggguggaauuaauuagaggcaggccaaaagagaacacaaucuggaccuccgggucaaguauaucuuuuuguggaguuaauagcgacacugugggcugguccuggcccgauggugcagagcugccguucacaaucgacaaguga

SEQ ID NO: 144388 - RNA, 1410 nt, Artificial Sequence; identical to SEQ ID NO: 138754
  derived and/or modified sequence opt3 from neuraminidase__InfluenzaA__AFJ78734

SEQ ID NO: 144389 - RNA, 1410 nt, Artificial Sequence; identical to SEQ ID NO: 138754
  derived and/or modified sequence opt3 from neuraminidase__InfluenzaA__AFJ78744

SEQ ID NO: 144390 - RNA, 1410 nt, Artificial Sequence; identical to SEQ ID NO: 138754
  derived and/or modified sequence opt3 from neuraminidase__InfluenzaA__AFJ78754

SEQ ID NO: 144391 - RNA, 1410 nt, Artificial Sequence; identical to SEQ ID NO: 138754
  derived and/or modified sequence opt3 from neuraminidase__InfluenzaA__AFJ78764

SEQ ID NO: 144392 - RNA, 1410 nt, Artificial Sequence; identical to SEQ ID NO: 138754
  derived and/or modified sequence opt3 from neuraminidase__InfluenzaA__AFJ78774

SEQ ID NO: 144393 - RNA, 1410 nt, Artificial Sequence; identical to SEQ ID NO: 138754
  derived and/or modified sequence opt3 from neuraminidase__InfluenzaA__AFJ78784

SEQ ID NO: 144394 - RNA, 1410 nt, Artificial Sequence
  derived and/or modified sequence opt3 from neuraminidase__InfluenzaA__AFJ78794
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcggggagauuacuugcgucugccgcgacaauuggcacggauccaacagaccauggguuucuuucaaucagaaccucgaauaucagauaggcuacaucuguagcggcauuuuuggggauaauccgaggcccaacgacaaaaccggaucaugcgguccugugaguuccaauggcgcgaacgggguaaagggauucagcuuuaaguauggcaacgguguguggaucgggcggacaaaaucuaucucaagucgcaauggcuucgagaugauuugggauccaaacggauggaccggcacggacaauaacuuuagcauaaagcaagacaucgucgggauuaaugaaugguccggauacucugguucguucgugcagcaucccgagcugacuggccuggauuguauccgaccuugcuucuggguugaacucauuagagggaggccaaaagagaacacaaucuggaccagcggauccucaauaaguuuuuguggcgucaauucugacacuguggguuggagcuggcccgauggggcagaguuaccguucacaaucgacaaguga

SEQ ID NO: 144395 - RNA, 1410 nt, Artificial Sequence; identical to SEQ ID NO: 138754
  derived and/or modified sequence opt3 from neuraminidase__InfluenzaA__AFJ78804

SEQ ID NO: 144396 - RNA, 1410 nt, Artificial Sequence; identical to SEQ ID NO: 138754
  derived and/or modified sequence opt3 from neuraminidase__InfluenzaA__AFJ78814

SEQ ID NO: 144397 - RNA, 1410 nt, Artificial Sequence; identical to SEQ ID NO: 138754
  derived and/or modified sequence opt3 from neuraminidase__InfluenzaA__AFJ78824

SEQ ID NO: 144398 - RNA, 1410 nt, Artificial Sequence; identical to SEQ ID NO: 138754
  derived and/or modified sequence opt3 from neuraminidase__InfluenzaA__AFJ78834

SEQ ID NO: 144399 - RNA, 1410 nt, Artificial Sequence; identical to SEQ ID NO: 138754
  derived and/or modified sequence opt3 from neuraminidase__InfluenzaA__AFJ78844

SEQ ID NO: 144400 - RNA, 1410 nt, Artificial Sequence; identical to SEQ ID NO: 141003
  derived and/or modified sequence opt3 from neuraminidase__InfluenzaA__AFJ78854

SEQ ID NO: 144401 - RNA, 1410 nt, Artificial Sequence; identical to SEQ ID NO: 138754
  derived and/or modified sequence opt3 from neuraminidase__InfluenzaA__AFJ78864

SEQ ID NO: 144402 - RNA, 1410 nt, Artificial Sequence; identical to SEQ ID NO: 138754
  derived and/or modified sequence opt3 from neuraminidase__InfluenzaA__AFJ78874

SEQ ID NO: 144403 - RNA, 1410 nt, Artificial Sequence; identical to SEQ ID NO: 138754
  derived and/or modified sequence opt3 from neuraminidase__InfluenzaA__AFJ78884

SEQ ID NO: 144404 - RNA, 1410 nt, Artificial Sequence; identical to SEQ ID NO: 138754
  derived and/or modified sequence opt3 from neuraminidase__InfluenzaA__AFJ78894

SEQ ID NO: 144405 - RNA, 1410 nt, Artificial Sequence; identical to SEQ ID NO: 138754
  derived and/or modified sequence opt3 from neuraminidase__InfluenzaA__AFJ78904

SEQ ID NO: 144406 - RNA, 1410 nt, Artificial Sequence; identical to SEQ ID NO: 138754
  derived and/or modified sequence opt3 from neuraminidase__InfluenzaA__AFJ78914

SEQ ID NO: 144407 - RNA, 1410 nt, Artificial Sequence
  derived and/or modified sequence opt3 from neuraminidase__InfluenzaA__AFJ78924
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauauguggacaucagcaacacuaauuucgcugcaggccaguccguagugucugucaaacuggccgggaacucgucauugugcccugugagcggaugggcgauauacaguaaggauaauuccauuagaaucggcucuaaaggugacguuuuugugauuagggagccauucaucagcuguuccccguuagaaugccggaccuuuuuccugacacagggggcucuacucaacgauaagcauucaaauggaaccaucaaagaccgcagucccuaucgaacucugaugagcuguccuauuggcgagauaccaucucccuacaacucccguuuugaaucagucgccuggagcgcaagugccugccacgauggcaucaacuggcuuacaauugggaucucuggaccugacaauggugcuguggcaguacugaaguauaacggcauaauuaccgauacgaucaaguccuggagaaauaacaucuugaggacucaagagagcgagugugccugcguuaaugggucguguuucaccgugaugacagacggaccaucugauggccaggcuuccuacaaaauuuuucggaucgaaaaggguaaaauugucaagucaguggagaugaacgcccccaauuaucauuacgaagagugcaguuguuacccugacagcuccgagauaacuugcgugugccgcgauaacuggcacgggucuaauagaccaugggucagcuucaaccagaaucucgaauaucagaucggauacauuuguucaggcaucuuuggcgacaacccgaggcccaaugauaaaaccgggaguugcggaccuguuuccagcaacggugcgaauggcgugaagggguucucuuuuaaguauggaaacggcguauggaucggucggacaaaaucaauuaguagccgcaacggguucgagaugauaugggacccaaauggcuggaccggaacggacaacaauuuuuccaucaagcaagauauugugggcaucaacgaauggucuggguacucggguagcuucguccagcaucccgagcugacuggacuggacuguauucgaccuugcuucuggguggaacucaucagaggcaggccaaaagagaauacaauauggaccuccgggucaaguaucucuuuuuguggaguuaacagcgauacugugggcugguccuggcccgacggugcagaguuaccguucacaauugauaaguga

SEQ ID NO: 144408 - RNA, 1410 nt, Artificial Sequence
  derived and/or modified sequence opt3 from neuraminidase__InfluenzaA__AFJ97569
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacgagaccaucaaagaucgcagucccuaucgaacucugaugagcuguccuauuggagaagucccaucucccuacaacucccguuuugagucaguggccuggagcgcaagugccugccacgacggcauaaauuggcuuacaaucggcauuucugggccugauaacggagcuguagcaguucugaaguauaaugguaucauaaccgacacgauuaaguccuggagaaacaauaucuugaggacucaagagagcgaaugugccugcgugaacggcucguguuucaccgucaugacagaugggccaucugacggacaggcuuccuacaaaaucuuucggauugagaagggcaaaaucgugaagucaguggaaaugaaugcccccaacuaucauuacgaggagugcaguuguuacccugauagcuccgaaauuacuugcgucugccgcgacaauuggcacgguucuaacagaccauggguuagcuucaaucagaaccucgaguaucagauaggguacaucuguucaggaauuuuuggcgauaauccgaggcccaacgacaaaaccggcaguugcgggccuguguccagcaauggagcgaacgguguaaagggcuucucuuuuaaguaugggaacggaguguggaucggccggacaaaaucaaucaguagccgcaaugguuucgaaaugauuugggauccaaacggguggaccggcacggacaauaacuuuuccauaaagcaagacaucgucggaauuaaugaguggucuggcuacucggggagcuucgugcagcaucccgaacugacuggacuggauuguauccgaccuugcuucuggguugagcucauuagagguaggccaaaagagaacacaaucuggaccuccggcucaaguauaucuuuuuguggggugaauagcgacacugucuccuggucauggcccgauggagcagaauuaccguucacaaucgacaaguga

SEQ ID NO: 144409 - RNA, 1410 nt, Artificial Sequence; identical to SEQ ID NO: 138744
  derived and/or modified sequence opt3 from neuraminidase__InfluenzaA__AFK14107

SEQ ID NO: 144410 - RNA, 1410 nt, Artificial Sequence; identical to SEQ ID NO: 138754
  derived and/or modified sequence opt3 from neuraminidase__InfluenzaA__AFK14117

SEQ ID NO: 144411 - RNA, 1410 nt, Artificial Sequence; identical to SEQ ID NO: 139521
  derived and/or modified sequence opt3 from neuraminidase__InfluenzaA__AFK14141

SEQ ID NO: 144412 - RNA, 1410 nt, Artificial Sequence
  derived and/or modified sequence opt3 from neuraminidase__InfluenzaA__AFK14150
augaaccccaaucagaagaucauuaccauaggcagcgugugcaugacaaucgggauggccaaccugauucuccaaaucggaaauauuaucuccauauggaucucucacucaauuagacuugguaaccagaaucagaucgagacuuguaaccagagugucauuacguacgaaaauaacaccuggguuaaucaaacauaugugaacaucagcaauacuaacuucgcugcaggccaguccguagugucugucaaacuggccggaaauucgucauugugcccugugagcgggugggcgauauacaguaaggacaacuccauuaggaucggcucuaaaggugauguuuuugugauucgggagccauucaucagcuguuccccguuagaaugccgcaccuuuuuccugacacagggggcucuacucaaugacaagcauucaaacggaaccaucaaagaucgaagucccuaucguacucugaugagcuguccuauuggcgaggucccaucucccuacaacuccagauuugaaucaguggccuggagcgcaagugccugccacgacggcauaaauuggcuuacaaucgggauuucuggaccugauaacggugcuguagcaguucugaaguauaauggcaucauaaccgacacgauuaaguccuggaggaacaauaucuugcggacucaggagagcgagugugccugcgugaacgggucguguuucaccgucaugacagauggaccaucugacgaacaggcuuccuacaaaaucuuucgcauugagaagggcaaaaucgugaagucaguggaaaugaaugcccccaacuaucauuacgaggagugcaguuguuacccugauagcuccgaaauuacuugcgucugcagagacaauuggcacgguucuaacaggccauggguuagcuucaaucaaaaccucgaguaucagauaggguacaucuguucaggaauuuuuggcgauaauccgcggcccaacgacaaaaccggcaguugcgggccuguguccagcaauggagcgaacgguguaaagggcuucucuuuuaaguaugggaacggaguguggaucggccgcacaaaaucaaucaguagccgaaaugguuucgaaaugauuugggauccaaacggguggaccggcacggacaauaacuuuuccauaaagcaggacaucgucggaauuaaugaguggucuggcuacucggggagcuucgugcaacaucccgaacugacuggacuggauuguaucagaccuugcuucuggguugagcucauuaggggucggccaaaagagaacacaaucuggaccuccggcucaaguauaucuuuuuguggggugaauagcgacacugucggaugguccuggcccgauggcgcagaauuaccguucacaaucgacaaguga

SEQ ID NO: 144413 - RNA, 1410 nt, Artificial Sequence; identical to SEQ ID NO: 139337
  derived and/or modified sequence opt3 from neuraminidase__InfluenzaA__AFK14159

SEQ ID NO: 144414 - RNA, 1410 nt, Artificial Sequence; identical to SEQ ID NO: 138754
  derived and/or modified sequence opt3 from neuraminidase__InfluenzaA__AFK14168

SEQ ID NO: 144415 - RNA, 1410 nt, Artificial Sequence; identical to SEQ ID NO: 138754
  derived and/or modified sequence opt3 from neuraminidase__InfluenzaA__AFK14177

SEQ ID NO: 144416 - RNA, 1410 nt, Artificial Sequence
  derived and/or modified sequence opt3 from neuraminidase__InfluenzaA__AFK14186
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuucgaagagugcaguuguuacccugauagcuccgagauuacuugcgucugccgcgacaauuggcacgggucuaacagaccauggguuagcuuuaaucagaaccucgaauaccagauaggauauaucuguucaggcauuuucggcgauaauccgaggcccaacgacaaaaccgggaguugcggaccuguguccagcaauggugcgaacggcguaaagggguuuucuuucaaguacggaaacggcguguggaucggucggacaaaaucaaucaguagccgcaauggguuugagaugauuugggauccaaacggcuggaccggaacggacaauaacuucuccauaaagcaagacaucgucggcauuaaugaauggucuggguauucggggagcuucgugcagcaucccgagcugacuggucuggauuguauccgaccuugcuuuuggguugaacucauuagaggcaggccaaaagagaacacaaucuggaccuccgggucaaguauaucuuucuguggagugaauagcgacacugucggcugguccuggcccgauggugcagaguuaccguuuacaaucgacaaguga

SEQ ID NO: 144417 - RNA, 1410 nt, Artificial Sequence; identical to SEQ ID NO: 140735
  derived and/or modified sequence opt3 from neuraminidase__InfluenzaA__AFK14195

SEQ ID NO: 144418 - RNA, 1410 nt, Artificial Sequence; identical to SEQ ID NO: 138754
  derived and/or modified sequence opt3 from neuraminidase__InfluenzaA__AFK14204

SEQ ID NO: 144419 - RNA, 1410 nt, Artificial Sequence; identical to SEQ ID NO: 140735
  derived and/or modified sequence opt3 from neuraminidase__InfluenzaA__AFK14213

SEQ ID NO: 144420 - RNA, 1410 nt, Artificial Sequence
  derived and/or modified sequence opt3 from neuraminidase__InfluenzaA__AFK14222
augaaccccaaucagaagaucauuaccauaggcagcgugugcaugacaaucgggauggccaaccugauucuccaaaucggaaauauuaucuccauauggaucucucacucaauuagacuugguaaccagaaucagaucgagacuuguaaccagagugucauuacguacgaaaauaacaccuggguuaaucaaacauaugugaacaucagcaauacuaacuucgcugcaggccaguccguagugucugucaaacuggccggaaauucgucauugugcccugugagcggaugggcgauauacaguaaggacaacuccauuaggaucggcucuaaaggugauguuuuugugauucgggagccauucaucagcuguuccccguuagaaugccgcaccuuuuuccugacacagggggcucuacucaaugacaagcauucaaacggaaccaucaaagaucgaagucccuaucguacucugaugagcuguccuauuggcgaggucccaucucccuacaacuccagauuugaaucaguggccuggagcgcaagugccugccacgacggcauaaauuggcuuacaaucgggauuucuggaccugauaacggugcuguagcaguucugaaguauaauggcaucauaaccgacacgauuaaguccuggaggaacaauaucuugcggacucaggagagcgagugugccugcgugaacgggucguguuucaccgucaugacagauggaccaucugacggccaggcuuccuacaaaaucuuucgcauugaaaaggguaaaaucgugaagucaguggagaugaaugcccccaacuaucauuacgaagagugcaguuguuacccugauagcuccgagauuacuugcgucugcagagacaauuggcacgggucuaacaggccauggguuagcuucaaucaaaaccucgaauaucagauaggauacaucuguucaggcauuuuuggcgauaauccgcggcccaacgacaaaaccgggaguugcggaccuguguccagcaauggugcgaacggcguaaagggguucucuuuuaaguauggaaacggcguguggaucggucgcacaaaaucaaucaguagccgaaauggguucgagaugauuugggauccaaacggcuggaccggaacggacaauaacuuuuccauaaagcaggacaucgucggcauuaaugaauggucuggguacucggggagcuucgugcaacaucccgagcugacuggucuggauuguaucagaccuugcuucuggguugaacucauuaggggccggccaaaagagaacacaaucuggaccuccgggucaaguauaucuuuuuguggagugaauagcgacacugucggcugguccuggcccgauggugcagaguuaccguucacaaucgacaaguga

SEQ ID NO: 144421 - RNA, 1410 nt, Artificial Sequence; identical to SEQ ID NO: 139337
  derived and/or modified sequence opt3 from neuraminidase__InfluenzaA__AFK14231

SEQ ID NO: 144422 - RNA, 1410 nt, Artificial Sequence; identical to SEQ ID NO: 138754
  derived and/or modified sequence opt3 from neuraminidase__InfluenzaA__AFK14240

SEQ ID NO: 144423 - RNA, 1410 nt, Artificial Sequence; identical to SEQ ID NO: 139521
  derived and/or modified sequence opt3 from neuraminidase__InfluenzaA__AFK14249

SEQ ID NO: 144424 - RNA, 1410 nt, Artificial Sequence; identical to SEQ ID NO: 138754
  derived and/or modified sequence opt3 from neuraminidase__InfluenzaA__AFK14257

SEQ ID NO: 144425 - RNA, 1410 nt, Artificial Sequence; identical to SEQ ID NO: 138754
  derived and/or modified sequence opt3 from neuraminidase__InfluenzaA__AFK14266

SEQ ID NO: 144426 - RNA, 1410 nt, Artificial Sequence; identical to SEQ ID NO: 138754
  derived and/or modified sequence opt3 from neuraminidase__InfluenzaA__AFK14274

SEQ ID NO: 144427 - RNA, 1410 nt, Artificial Sequence
  derived and/or modified sequence opt3 from neuraminidase__InfluenzaA__AFK14281
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacagacgugaacaucagcaauacuaacuucgcugcaggccaguccguagugucugucaaacuggccggaaauucgucauugugcccugugagcggaugggcgauauauaguaaggauaacuccauuagaaucggcucuaaaggugacguuuuugugauuagggagccauucaucagcuguuccccguuagaaugccggaccuuuuuccugacacagggggcucuacucaaugauaagcauucaaacggaaccaucaaagaccgcagucccuaccgaacucugaugagcuguccuauuggcgaggucccaucucccuauaacucccguuuugaaucaguggccuggagcgcaagugccugccacgauggcauaaauuggcuuacaaucgggauuucuggaccugacaacggugcuguagcaguucugaaguacaauggcaucauaaccgauacgauuaaguccuggagaaacaauaucuugaggacucaagagagcgagugugccugcgugaacgggucguguuucaccgucaugacagacggaccaucugauggccaggcuuccuauaaaaucuuucggauugaaaaggguaaaaucgugaagucaguggagaugaaugcccccaacuaccauuaugaagagugcaguuguuacccugacagcuccgagauuacuugcgucugccgcgauaauuggcacgggucuaacagaccauggguuagcuucaaucagaaccucgaauaccagauaggauauaucuguucaggcauuuuuggcgacaauccgaggcccaacgauaaaaccgggaguugcggaccuguguccagcaauggugcgaacggcguaaagggguucucuuuuaaguacggaaacggcguguggaucggucggacaaaaucaaucaguagccgcaauggguucgagaugauuugggacccaaacggcuggaccggaacggacaauaacuuuuccauaaagcaagauaucgucggcauuaaugaauggucuggguauucggggagcuucgugcagcaucccgagcugacuggucuggacuguauccgaccuugcuucuggguugaacucauuagaggcaggccaaaagagaacacaaucuggaccuccgggucaaguauaucuuuuuguggagugaauagcgauacugucggcugguccuggcccgacggugcagaguuaccguucacaaucgauaaguga

SEQ ID NO: 144428 - RNA, 1410 nt, Artificial Sequence; identical to SEQ ID NO: 138754
  derived and/or modified sequence opt3 from neuraminidase__InfluenzaA__AFK14289

SEQ ID NO: 144429 - RNA, 1410 nt, Artificial Sequence; identical to SEQ ID NO: 139337
  derived and/or modified sequence opt3 from neuraminidase__InfluenzaA__AFK14298

SEQ ID NO: 144430 - RNA, 1410 nt, Artificial Sequence; identical to SEQ ID NO: 138754
  derived and/or modified sequence opt3 from neuraminidase__InfluenzaA__AFK14307

SEQ ID NO: 144431 - RNA, 1410 nt, Artificial Sequence; identical to SEQ ID NO: 140735
  derived and/or modified sequence opt3 from neuraminidase__InfluenzaA__AFK14316

SEQ ID NO: 144432 - RNA, 1410 nt, Artificial Sequence
  derived and/or modified sequence opt3 from neuraminidase__InfluenzaA__AFK14325
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaacgcgguaagaucgugaaaucaguggagaugaaugcccccaacuaucauuacgaagagugcaguuguuacccugauagcuccgagauuacuugcgucugcagagacaauuggcacgggucuaacaggccauggguuagcuucaaucagaaccucgaauaucagauaggauacaucuguucaggcauuuuuggcgauaauccgcggcccaacgacaagaccgggaguugcggaccuguguccagcaauggugcgaacggcguaaaaggguucucuuuuaaguauggaaacggcguguggaucggucgcacaaagucaaucaguagccgaaauggguucgagaugauuugggauccaaacggcuggaccggaacggacaauaacuuuuccauaaaacaagacaucgucggcauuaaugaauggucuggguacucggggagcuucgugcagcaucccgagcugacuggucuggauuguaucagaccuugcuucuggguugaacucauuaggggccggccaaaggagaacacaaucuggaccuccgggucaaguauaucuuuuuguggagugaauagcgacacugucggcugguccuggcccgauggugcagaguuaccguucacaaucgacaaauga

SEQ ID NO: 144433 - RNA, 1410 nt, Artificial Sequence; identical to SEQ ID NO: 138754
  derived and/or modified sequence opt3 from neuraminidase__InfluenzaA__AFK14334

SEQ ID NO: 144434 - RNA, 1410 nt, Artificial Sequence; identical to SEQ ID NO: 138754
  derived and/or modified sequence opt3 from neuraminidase__InfluenzaA__AFK14343

SEQ ID NO: 144435 - RNA, 1410 nt, Artificial Sequence; identical to SEQ ID NO: 138754
  derived and/or modified sequence opt3 from neuraminidase__InfluenzaA__AFK14352

SEQ ID NO: 144436 - RNA, 1410 nt, Artificial Sequence; identical to SEQ ID NO: 138754
  derived and/or modified sequence opt3 from neuraminidase__InfluenzaA__AFK14360

SEQ ID NO: 144437 - RNA, 1410 nt, Artificial Sequence; identical to SEQ ID NO: 138754
  derived and/or modified sequence opt3 from neuraminidase__InfluenzaA__AFK14369

SEQ ID NO: 144438 - RNA, 1410 nt, Artificial Sequence
  derived and/or modified sequence opt3 from neuraminidase__InfluenzaA__AFK14387
augaaccccaaucagaagaucauuaccauaggcagcgugugcaugacaaucgggauggccaaccugauucuccaaaucggaaauauuacuuccaucuggauaucucacucaauccagcuugguaaccagaaucagauugacacguguaaccaaagugucaucaccuacgagaauaacacauggguuaaucagacuuaugugaacauuagcaauaccaacuucgcugcaggccaguccguagugucugucaaacuggccggaaauucgucauugugcccugugagcggaugggcgaucuacaguaaggauaacuccauaagaauuggcucuaaaggugacguuuuugugaucagggaaccauucauuagcuguuccccguuagagugccggacauuuuuccugacccagggggcucuacucaaugauaagcauucaaacggaacuaucaaagaccgcagucccuaucgaacacugaugagcuguccuaucggcgaagucccaucucccuacaacucccguuuugagucaguggccuggagcgcaagugccugccacgauggcauuaauuggcuuaccauagggaucucuggaccugacaacggugcuguagcaguucugaaguauaauggcauuaucacggauacuauaaaguccuggagaaacaauauuuugaggacccaagaaagcgagugugccugcgugaacgggucguguuucacagucaugacugacggaccaucugauggccaggcuuccuacaaaaucuuucggaucgagaaggguaaaauugugaagucaguggaaaugaaugcccccaacuaucauuacgaggaaugcaguuguuacccugacagcuccgagauuaccugcgucugccgcgauaauuggcacgggucuaacagaccauggguuagcuucaaucagaaccucgaguaucagaucggauacauauguucaggcaucuuuggcgacaauccgaggcccaacgauaaaacagggaguugcggaccuguguccagcaauggugcgaacggcguaaagggguucucuuuuaaguauggaaacggcguguggauuggucggaccaaaucaaucaguagccgcaauggguucgaaaugaucugggacccaaacggcuggacgggaacugacaauaacuuuuccauuaagcaagauauagucggcaucaaugaguggucuggguacucggggagcuucgugcagcaucccgaacugacaggucuggacuguauucgaccuugcuucuggguugagcucaucagaggcaggccaaaagaaaacaccauuuggacuuccgggucaaguaucucuuuuuguggagugaauagcgauacagucggcugguccuggcccgacggugcagaguuaccguucaccauagauaaguga

SEQ ID NO: 144439 - RNA, 1410 nt, Artificial Sequence; identical to SEQ ID NO: 139337
  derived and/or modified sequence opt3 from neuraminidase__InfluenzaA__AFK14397

SEQ ID NO: 144440 - RNA, 1410 nt, Artificial Sequence; identical to SEQ ID NO: 138754
  derived and/or modified sequence opt3 from neuraminidase__InfluenzaA__AFK14406

SEQ ID NO: 144441 - RNA, 1410 nt, Artificial Sequence; identical to SEQ ID NO: 138754
  derived and/or modified sequence opt3 from neuraminidase__InfluenzaA__AFK14415

SEQ ID NO: 144442 - RNA, 1410 nt, Artificial Sequence; identical to SEQ ID NO: 138754
  derived and/or modified sequence opt3 from neuraminidase__InfluenzaA__AFK14424

SEQ ID NO: 144443 - RNA, 1410 nt, Artificial Sequence
  derived and/or modified sequence opt3 from neuraminidase__InfluenzaA__AFK14433
augaaccccaaucagaagaucauuaccauaggcagcgugugcaugaucauugggauggccaaccugauccuccaaauuggaaauaucauauccaucuggauuucucacucaauccagcuugguaaccagaaucagauugagacauguaaccaaagugucaucacuuacgaaaauaacacguggguuaaucagaccuaugugaacauaagcaauacaaacuucgcugcaggccaguccguagugucugucaaacuggccggaaauucgucauugugcccugugagcggaugggcgauuuacaguaaggacaacuccaucagaauuggcucuaaaggugauguuuuugugaucagggagccauucaucagcuguuccccguuagaaugccggaccuuuuuccugacucagggggcucuacucaaugacaagcauucaaacggaacaauuaaagaucgcagucccuaucgaacccugaugagcuguccuauaggcgaggucccaucucccuacaacucccguuuugaaucaguggccuggagcgcaagugccugccacgacggcaucaauuggcuuacuauugggaucucuggaccugauaacggugcuguagcaguucugaaguauaauggcauaauuacagacaccaucaaguccuggagaaacaauaucuugaggacgcaagagagcgagugugccugcgugaacgggucguguuucacugucaugaccgauggaccaucugacggccaggcuuccuacaaaauuuuucggaucgaaaaggguaaaauugugaagucaguggagaugaaugcccccaacuaucauuacgaagagugcaguuguuacccugauagcuccgagauaacaugcgucugccgcgacaauuggcacgggucuaacagaccauggguuagcuucaaucagaaccucgaauaucagaucggauacauuuguucaggcaucuuuggcgauaauccgaggcccaacgacaaaacugggaguugcggaccuguguccagcaauggugcgaacggcguaaagggguucucuuuuaaguauggaaacggcguguggaucggucggaccaaaucaauuaguagccgcaauggguucgagaugauaugggauccaaacggcuggacaggaaccgacaauaacuuuuccaucaagcaagacauugucggcaucaaugaauggucuggguacucggggagcuucgugcagcaucccgagcugacgggucuggauuguauucgaccuugcuucuggguugaacucaucagaggcaggccaaaagagaacacuauauggacauccgggucaaguaucucuuuuuguggagugaauagcgacaccgucggcugguccuggcccgauggugcagaguuaccguucacuauugacaaguga

SEQ ID NO: 144444 - RNA, 1410 nt, Artificial Sequence; identical to SEQ ID NO: 138754
  derived and/or modified sequence opt3 from neuraminidase__InfluenzaA__AFK14442

SEQ ID NO: 144445 - RNA, 1410 nt, Artificial Sequence
  derived and/or modified sequence opt3 from neuraminidase__InfluenzaA__AFK14451
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagccucugcgaaacuggcuggaaauucgucauugugcccugugagcggaugggccauauacaguaaggacaacuccauuagaaucggcucuaaaggugaugucuuugugauuagggagccauucaucagcuguuccccguuagaaugccggaccuuuuuccugacacagggggcacuacucaaugacaagcauucaaacggaaccaucaaagaucgcagucccuaucgaacucugaugagcuguccuauuggcgagguuccaucucccuacaacucccguuuugaaucaguggccuggagcgcuagugcaugccacgacggcauaaauuggcuuacaaucgggauuucuggaccugauaacggugccgucgcugugcugaaguauaauggcaucauaaccgacacgauuaaguccuggagaaacaauaucuugaggacucaagagagcgagugugccugcguaaacgggucguguuucaccguuaugacagauggaccaucugacggccaggcguccuacaaaaucuuucggauugaaaaggguaaaaucgugaagucagucgagaugaaugcacccaacuaucauuacgaagagugcaguuguuacccugauagcuccgagauuacuugcgugugccgcgacaauuggcacgggucuaacagaccaugggugagcuucaaucagaaccucgaauaucagauaggauacaucuguucaggcauuuuuggcgauaauccgaggcccaacgacaaaaccgggaguugcggaccugucuccagcaauggugccaacggcguuaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucguaggcauuaaugaauggucuggguacucggggagcuucgugcagcaucccgagcugacuggucuggauuguauccgaccuugcuucugggucgaacucauuagaggcaggccaaaagagaacacaaucuggaccuccgggucaauaaucaguuuuuguggaguuaauucugacacugugggcuggagcuggcccgauggugcugaguuaccguucacaauugacaaguga

SEQ ID NO: 144446 - RNA, 1410 nt, Artificial Sequence; identical to SEQ ID NO: 138754
  derived and/or modified sequence opt3 from neuraminidase__InfluenzaA__AFK14458

SEQ ID NO: 144447 - RNA, 1410 nt, Artificial Sequence; identical to SEQ ID NO: 138754
  derived and/or modified sequence opt3 from neuraminidase__InfluenzaA__AFK14467

SEQ ID NO: 144448 - RNA, 1410 nt, Artificial Sequence; identical to SEQ ID NO: 138754
  derived and/or modified sequence opt3 from neuraminidase__InfluenzaA__AFK14476

SEQ ID NO: 144449 - RNA, 1410 nt, Artificial Sequence; identical to SEQ ID NO: 141813
  derived and/or modified sequence opt3 from neuraminidase__InfluenzaA__AFK14485

SEQ ID NO: 144450 - RNA, 1410 nt, Artificial Sequence; identical to SEQ ID NO: 138754
  derived and/or modified sequence opt3 from neuraminidase__InfluenzaA__AFK14504

SEQ ID NO: 144451 - RNA, 1410 nt, Artificial Sequence; identical to SEQ ID NO: 138754
  derived and/or modified sequence opt3 from neuraminidase__InfluenzaA__AFK14514

SEQ ID NO: 144452 - RNA, 1410 nt, Artificial Sequence; identical to SEQ ID NO: 138754
  derived and/or modified sequence opt3 from neuraminidase__InfluenzaA__AFK14522

SEQ ID NO: 144453 - RNA, 1410 nt, Artificial Sequence; identical to SEQ ID NO: 138754
  derived and/or modified sequence opt3 from neuraminidase__InfluenzaA__AFK14529

SEQ ID NO: 144454 - RNA, 1410 nt, Artificial Sequence; identical to SEQ ID NO: 138754
  derived and/or modified sequence opt3 from neuraminidase__InfluenzaA__AFK14538

SEQ ID NO: 144455 - RNA, 1410 nt, Artificial Sequence; identical to SEQ ID NO: 141129
  derived and/or modified sequence opt3 from neuraminidase__InfluenzaA__AFK14547

SEQ ID NO: 144456 - RNA, 1410 nt, Artificial Sequence
  derived and/or modified sequence opt3 from neuraminidase__InfluenzaA__AFK14555
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguaauaucugugaaacuggccggaaauucgucauugugcccugucagcggaugggcgauuuacaguaaggacaacuccaucagaauuggcucuaaaggugauguguuuguuaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggugccaucucccuacaacucccguuuugaaucagucgccuggagcgcaagugccugccacgacggcaucaauuggcuuacaauugggaucucuggaccugauaacggugcuguggcaguacugaaguauaauggcauaauuaccgacacgaucaaguccuggagaaacaauaucuugaggacucaagagagcgagugugccugcguuaacgggucguguuucaccgugaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcaauggguucgagaugauaugggauccaaacggcuggaccggaacggacaauaacuuuuccaucaagcaagacauugugggcaucaaugaauggucuggguacucggggagcuucguccagcaucccgagcugacuggucuggauuguauucgaccuugcuucuggguggaacucaucagaggcaggccaaaagagaacacaauauggaccuccgggucaaguaucucuuuuuguggaguuaauagcgacacugugggcugguccuggcccgauggugcagaguuaccguucacaauugacaaguga

SEQ ID NO: 144457 - RNA, 1410 nt, Artificial Sequence; identical to SEQ ID NO: 138754
  derived and/or modified sequence opt3 from neuraminidase__InfluenzaA__AFK14564

SEQ ID NO: 144458 - RNA, 1410 nt, Artificial Sequence; identical to SEQ ID NO: 138754
  derived and/or modified sequence opt3 from neuraminidase__InfluenzaA__AFK14573

SEQ ID NO: 144459 - RNA, 1410 nt, Artificial Sequence
  derived and/or modified sequence opt3 from neuraminidase__InfluenzaA__AFK14579
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacauguguucaggcaucuuuggcgauaauccgaggcccaacgacaaaaccgggaguugcggaccuguguccagcaauggugcgaacggcguaaagggguucucuuuuaaguauggaaacggcguguggauuggucggacaaaaucaaucaguagccgcaauggguucgagaugaucugggauccaaacggcuggaccggaacggacaauaacuuuuccauuaagcaagacauagucggcaucaaugaauggucuggguacucggggagcuucgugcagcaucccgagcugacuggucuggauuguauucgaccuugcuucuggguugaacucaucagaggcaggccaaaagagaacacaauuuggaccuccgggucaaguaucucuuuuuguggagugaauagcgacacugucggcugguccuggcccgauggugcagaguuaccguucacaauagacaaguga

SEQ ID NO: 144460 - RNA, 1410 nt, Artificial Sequence; identical to SEQ ID NO: 138754
  derived and/or modified sequence opt3 from neuraminidase__InfluenzaA__AFK14588

SEQ ID NO: 144461 - RNA, 1410 nt, Artificial Sequence; identical to SEQ ID NO: 138754
  derived and/or modified sequence opt3 from neuraminidase__InfluenzaA__AFK14597

SEQ ID NO: 144462 - RNA, 1410 nt, Artificial Sequence; identical to SEQ ID NO: 138754
  derived and/or modified sequence opt3 from neuraminidase__InfluenzaA__AFK14604

SEQ ID NO: 144463 - RNA, 1410 nt, Artificial Sequence; identical to SEQ ID NO: 138754
  derived and/or modified sequence opt3 from neuraminidase__InfluenzaA__AFK14632

SEQ ID NO: 144464 - RNA, 1410 nt, Artificial Sequence; identical to SEQ ID NO: 138744
  derived and/or modified sequence opt3 from neuraminidase__InfluenzaA__AFK14641

SEQ ID NO: 144465 - RNA, 1410 nt, Artificial Sequence; identical to SEQ ID NO: 138754
  derived and/or modified sequence opt3 from neuraminidase__InfluenzaA__AFK14651

SEQ ID NO: 144466 - RNA, 1410 nt, Artificial Sequence; identical to SEQ ID NO: 138754
  derived and/or modified sequence opt3 from neuraminidase__InfluenzaA__AFK14656

SEQ ID NO: 144467 - RNA, 1410 nt, Artificial Sequence; identical to SEQ ID NO: 138754
  derived and/or modified sequence opt3 from neuraminidase__InfluenzaA__AFK14663

SEQ ID NO: 144468 - RNA, 1410 nt, Artificial Sequence; identical to SEQ ID NO: 138754
  derived and/or modified sequence opt3 from neuraminidase__InfluenzaA__AFK14672

SEQ ID NO: 144469 - RNA, 1410 nt, Artificial Sequence; identical to SEQ ID NO: 138754
  derived and/or modified sequence opt3 from neuraminidase__InfluenzaA__AFK14680

SEQ ID NO: 144470 - RNA, 1410 nt, Artificial Sequence; identical to SEQ ID NO: 138754
  derived and/or modified sequence opt3 from neuraminidase__InfluenzaA__AFK14690

SEQ ID NO: 144471 - RNA, 1410 nt, Artificial Sequence; identical to SEQ ID NO: 138754
  derived and/or modified sequence opt3 from neuraminidase__InfluenzaA__AFK14707

SEQ ID NO: 144472 - RNA, 1410 nt, Artificial Sequence; identical to SEQ ID NO: 138754
  derived and/or modified sequence opt3 from neuraminidase__InfluenzaA__AFK14715

SEQ ID NO: 144473 - RNA, 1410 nt, Artificial Sequence; identical to SEQ ID NO: 138754
  derived and/or modified sequence opt3 from neuraminidase__InfluenzaA__AFK14724

SEQ ID NO: 144474 - RNA, 1410 nt, Artificial Sequence; identical to SEQ ID NO: 138754
  derived and/or modified sequence opt3 from neuraminidase__InfluenzaA__AFK14733

SEQ ID NO: 144475 - RNA, 1410 nt, Artificial Sequence; identical to SEQ ID NO: 138754
  derived and/or modified sequence opt3 from neuraminidase__InfluenzaA__AFK14751

SEQ ID NO: 144476 - RNA, 1410 nt, Artificial Sequence; identical to SEQ ID NO: 138754
  derived and/or modified sequence opt3 from neuraminidase__InfluenzaA__AFK14757

SEQ ID NO: 144477 - RNA, 1410 nt, Artificial Sequence; identical to SEQ ID NO: 138754
  derived and/or modified sequence opt3 from neuraminidase__InfluenzaA__AFK14766

SEQ ID NO: 144478 - RNA, 1410 nt, Artificial Sequence; identical to SEQ ID NO: 139337
  derived and/or modified sequence opt3 from neuraminidase__InfluenzaA__AFK14774

SEQ ID NO: 144479 - RNA, 1410 nt, Artificial Sequence; identical to SEQ ID NO: 144456
  derived and/or modified sequence opt3 from neuraminidase__InfluenzaA__AFK14781

SEQ ID NO: 144480 - RNA, 1410 nt, Artificial Sequence; identical to SEQ ID NO: 139337
  derived and/or modified sequence opt3 from neuraminidase__InfluenzaA__AFK14790

SEQ ID NO: 144481 - RNA, 1410 nt, Artificial Sequence
  derived and/or modified sequence opt3 from neuraminidase__InfluenzaA__AFK14800
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccacgggagaacacaaucuggaccuccgggucaaguauaucuuuuuguggagugaauagcgacacugucggcugguccuggcccgauggugcagaguuaccguucacaaucgacaaauga

SEQ ID NO: 144482 - RNA, 1410 nt, Artificial Sequence; identical to SEQ ID NO: 140735
  derived and/or modified sequence opt3 from neuraminidase__InfluenzaA__AFK14809

SEQ ID NO: 144483 - RNA, 1410 nt, Artificial Sequence; identical to SEQ ID NO: 140735
  derived and/or modified sequence opt3 from neuraminidase__InfluenzaA__AFK14816

SEQ ID NO: 144484 - RNA, 1410 nt, Artificial Sequence; identical to SEQ ID NO: 138754
  derived and/or modified sequence opt3 from neuraminidase__InfluenzaA__AFK14824

SEQ ID NO: 144485 - RNA, 1410 nt, Artificial Sequence; identical to SEQ ID NO: 138754
  derived and/or modified sequence opt3 from neuraminidase__InfluenzaA__AFK14841

SEQ ID NO: 144486 - RNA, 1410 nt, Artificial Sequence; identical to SEQ ID NO: 139827
  derived and/or modified sequence opt3 from neuraminidase__InfluenzaA__AFK14849

SEQ ID NO: 144487 - RNA, 1410 nt, Artificial Sequence
  derived and/or modified sequence opt3 from neuraminidase__InfluenzaA__AFK14856
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucuaauggccaggcuuccuacaaaaucuuuaagaucgaaaaagguaagauugugaaaucagucgagaugaacgcccccaauuaucauuacgaagagugcaguuguuacccugacagcuccgagaucacuugcguuugccgggauaacuggcacgggucuaaucgcccaugggugagcuucaaccagaaucucgaauaucagauuggauacauauguucaggcaucuuuggcgacaacccgagacccauugauaagaccgggaguugcggaccuguauccagcaauggugcgaacggcgugaagggguucucuuuuaaauauggaaacggcgucuggaucgguaggacaaagucaaucaguagccggaauggguucgagaugauuugggacccaaacggcuggaccggaacggauaauaacuuuuccauaaaacaagacaucgugggcauuaaugaauggucuggguacucggggagcuucguucagcaucccgagcugacuggucuggacuguauccgcccuugcuucuggguggaacucauucgaggcagaccaaaggagaacacaaucuggaccuccgggucaaguauaucuuuuuguggagucaauagcgauacugugggcugguccuggcccgacggugcagaguuaccguucacaaucgauaaauga

SEQ ID NO: 144488 - RNA, 1410 nt, Artificial Sequence; identical to SEQ ID NO: 138754
  derived and/or modified sequence opt3 from neuraminidase__InfluenzaA__AFK14870

SEQ ID NO: 144489 - RNA, 1410 nt, Artificial Sequence; identical to SEQ ID NO: 138754
  derived and/or modified sequence opt3 from neuraminidase__InfluenzaA__AFK14879

SEQ ID NO: 144490 - RNA, 1410 nt, Artificial Sequence; identical to SEQ ID NO: 138754
  derived and/or modified sequence opt3 from neuraminidase__InfluenzaA__AFK14885

SEQ ID NO: 144491 - RNA, 1410 nt, Artificial Sequence; identical to SEQ ID NO: 138754
  derived and/or modified sequence opt3 from neuraminidase__InfluenzaA__AFK14894

SEQ ID NO: 144492 - RNA, 1410 nt, Artificial Sequence; identical to SEQ ID NO: 138754
  derived and/or modified sequence opt3 from neuraminidase__InfluenzaA__AFK14903

SEQ ID NO: 144493 - RNA, 1410 nt, Artificial Sequence; identical to SEQ ID NO: 138754
  derived and/or modified sequence opt3 from neuraminidase__InfluenzaA__AFK14912

SEQ ID NO: 144494 - RNA, 1410 nt, Artificial Sequence; identical to SEQ ID NO: 138754
  derived and/or modified sequence opt3 from neuraminidase__InfluenzaA__AFK14921

SEQ ID NO: 144495 - RNA, 1410 nt, Artificial Sequence; identical to SEQ ID NO: 138754
  derived and/or modified sequence opt3 from neuraminidase__InfluenzaA__AFK14931

SEQ ID NO: 144496 - RNA, 1410 nt, Artificial Sequence
  derived and/or modified sequence opt3 from neuraminidase__InfluenzaA__AFK25604
augaaccccaaucagaagaucauuaccauaggcagcgugugcaugacaaucgggauggccaaccugauucuccaaaucggaaauauuaucuccauauggaucucucacucaauucagcuuagaaaccagagucagaucgagacuuguaaucaaagcgucauuacguacgaaaacaauaccuggguuaaccagacauaugugaauaucuccaacacuaauuucgcugcaggucagucuguagugucggucaaacuggccggcaacagcucauugugcccugugagugggugggcgauauacuccaaggacaauucuauuaggaucggaagcaaaggcgauguuuuugugauucgggagccauucaucuccuguucaccguuagaaugccgcaccuuuuuccugacacagggugcucuacucaacgacaagcauaguaaugggaccaucaaagaucgaagccccuaucguacucugaugucuuguccuauuggagaggucccaucccccuacaacucaagauuugaaagcguggccuggagugcaucugccugccacgacggcauaaacuggcuuacaaucggcauuuccgggccugauaauggagcuguagcaguucugaaguauaacgguaucauaaccgacacgauuaagagcuggaggaauaacaucuugcggacucaagagucggagugugccugcgugaauggcucuuguuucaccaucaugacagaugggccauccgacggacaggcuucauacaaaauuuuucgcaucgaaaagggcaaaauugucaagaguguggagaugaacgcccccaauuauuacuacgaagagugcagcuguuauccugauuccucugagauaacuugcgugugcagagacaacuggcaugguagcaauaggccaugggucucauucaaccagaaucucgaauaccagaucggguauauuuguaguggaaucuuuggcgauaacccgcggcccaaugacaaaaccggcuccugcgggccuguuagcucuaacggagcgaauggugugaagggcuucucauuuaaguacgggaacggaguauggaucggccgcacaaaaaguauuagcucccgaaaggguuucgagaugauaugggauccaaacggguggaccggcacggacaauaacuuuucuaucaaacaagacauugugggaaucaaugaauggucgggcuauagcggguccuucguccagcaccccgagcugacuggacuggauuguauuagaccuugcuucuggguggaacucaucaggggucggccaaaggagaacacaauauggaccucaggcaguucuaucagcuuuugugggguuaauuccgacacugugggauggucauggcccgauggcgcagaguuaccguucacaauugacaaauga

SEQ ID NO: 144497 - RNA, 1410 nt, Artificial Sequence; identical to SEQ ID NO: 144496
  derived and/or modified sequence opt3 from neuraminidase__InfluenzaA__AFK25606

SEQ ID NO: 144498 - RNA, 1410 nt, Artificial Sequence; identical to SEQ ID NO: 140105
  derived and/or modified sequence opt3 from neuraminidase__InfluenzaA__AFK74537

SEQ ID NO: 144499 - RNA, 1410 nt, Artificial Sequence; identical to SEQ ID NO: 138754
  derived and/or modified sequence opt3 from neuraminidase__InfluenzaA__AFK74547

SEQ ID NO: 144500 - RNA, 1410 nt, Artificial Sequence; identical to SEQ ID NO: 141746
  derived and/or modified sequence opt3 from neuraminidase__InfluenzaA__AFK74557

SEQ ID NO: 144501 - RNA, 1410 nt, Artificial Sequence; identical to SEQ ID NO: 138754
  derived and/or modified sequence opt3 from neuraminidase__InfluenzaA__AFK74567

SEQ ID NO: 144502 - RNA, 1410 nt, Artificial Sequence; identical to SEQ ID NO: 138754
  derived and/or modified sequence opt3 from neuraminidase__InfluenzaA__AFK74578

SEQ ID NO: 144503 - RNA, 1410 nt, Artificial Sequence; identical to SEQ ID NO: 143869
  derived and/or modified sequence opt3 from neuraminidase__InfluenzaA__AFK74588

SEQ ID NO: 144504 - RNA, 1410 nt, Artificial Sequence; identical to SEQ ID NO: 138754
  derived and/or modified sequence opt3 from neuraminidase__InfluenzaA__AFK74598

SEQ ID NO: 144505 - RNA, 1410 nt, Artificial Sequence; identical to SEQ ID NO: 138754
  derived and/or modified sequence opt3 from neuraminidase__InfluenzaA__AFK74608

SEQ ID NO: 144506 - RNA, 1410 nt, Artificial Sequence; identical to SEQ ID NO: 138754
  derived and/or modified sequence opt3 from neuraminidase__InfluenzaA__AFK74618

SEQ ID NO: 144507 - RNA, 1410 nt, Artificial Sequence; identical to SEQ ID NO: 138754
  derived and/or modified sequence opt3 from neuraminidase__InfluenzaA__AFK74628

SEQ ID NO: 144508 - RNA, 1410 nt, Artificial Sequence; identical to SEQ ID NO: 138754
  derived and/or modified sequence opt3 from neuraminidase__InfluenzaA__AFK74638

SEQ ID NO: 144509 - RNA, 1410 nt, Artificial Sequence; identical to SEQ ID NO: 138754
  derived and/or modified sequence opt3 from neuraminidase__InfluenzaA__AFK74648

SEQ ID NO: 144510 - RNA, 1410 nt, Artificial Sequence; identical to SEQ ID NO: 143878
  derived and/or modified sequence opt3 from neuraminidase__InfluenzaA__AFK74658

SEQ ID NO: 144511 - RNA, 1410 nt, Artificial Sequence; identical to SEQ ID NO: 143878
  derived and/or modified sequence opt3 from neuraminidase__InfluenzaA__AFK74668

SEQ ID NO: 144512 - RNA, 1410 nt, Artificial Sequence; identical to SEQ ID NO: 138754
  derived and/or modified sequence opt3 from neuraminidase__InfluenzaA__AFK74678

SEQ ID NO: 144513 - RNA, 1410 nt, Artificial Sequence; identical to SEQ ID NO: 138754
  derived and/or modified sequence opt3 from neuraminidase__InfluenzaA__AFK74688

SEQ ID NO: 144514 - RNA, 1410 nt, Artificial Sequence; identical to SEQ ID NO: 138754
  derived and/or modified sequence opt3 from neuraminidase__InfluenzaA__AFK74698

SEQ ID NO: 144515 - RNA, 1410 nt, Artificial Sequence; identical to SEQ ID NO: 143885
  derived and/or modified sequence opt3 from neuraminidase__InfluenzaA__AFK74708

SEQ ID NO: 144516 - RNA, 1410 nt, Artificial Sequence; identical to SEQ ID NO: 141746
  derived and/or modified sequence opt3 from neuraminidase__InfluenzaA__AFK74718

SEQ ID NO: 144517 - RNA, 1410 nt, Artificial Sequence; identical to SEQ ID NO: 138754
  derived and/or modified sequence opt3 from neuraminidase__InfluenzaA__AFK74728

SEQ ID NO: 144518 - RNA, 1410 nt, Artificial Sequence; identical to SEQ ID NO: 138754
  derived and/or modified sequence opt3 from neuraminidase__InfluenzaA__AFK74738

SEQ ID NO: 144519 - RNA, 1410 nt, Artificial Sequence; identical to SEQ ID NO: 138754
  derived and/or modified sequence opt3 from neuraminidase__InfluenzaA__AFK74748

SEQ ID NO: 144520 - RNA, 1410 nt, Artificial Sequence; identical to SEQ ID NO: 138754
  derived and/or modified sequence opt3 from neuraminidase__InfluenzaA__AFK74758

SEQ ID NO: 144521 - RNA, 1410 nt, Artificial Sequence; identical to SEQ ID NO: 138754
  derived and/or modified sequence opt3 from neuraminidase__InfluenzaA__AFK74768

SEQ ID NO: 144522 - RNA, 1410 nt, Artificial Sequence; identical to SEQ ID NO: 138754
  derived and/or modified sequence opt3 from neuraminidase__InfluenzaA__AFK74778

SEQ ID NO: 144523 - RNA, 1410 nt, Artificial Sequence; identical to SEQ ID NO: 141746
  derived and/or modified sequence opt3 from neuraminidase__InfluenzaA__AFK74788

SEQ ID NO: 144524 - RNA, 1410 nt, Artificial Sequence; identical to SEQ ID NO: 141746
  derived and/or modified sequence opt3 from neuraminidase__InfluenzaA__AFK74798

SEQ ID NO: 144525 - RNA, 1410 nt, Artificial Sequence; identical to SEQ ID NO: 141746
  derived and/or modified sequence opt3 from neuraminidase__InfluenzaA__AFK74808

SEQ ID NO: 144526 - RNA, 1410 nt, Artificial Sequence; identical to SEQ ID NO: 141746
  derived and/or modified sequence opt3 from neuraminidase__InfluenzaA__AFK74818

SEQ ID NO: 144527 - RNA, 1410 nt, Artificial Sequence; identical to SEQ ID NO: 138754
  derived and/or modified sequence opt3 from neuraminidase__InfluenzaA__AFK74828

SEQ ID NO: 144528 - RNA, 1410 nt, Artificial Sequence; identical to SEQ ID NO: 140645
  derived and/or modified sequence opt3 from neuraminidase__InfluenzaA__AFK74838

SEQ ID NO: 144529 - RNA, 1410 nt, Artificial Sequence; identical to SEQ ID NO: 138754
  derived and/or modified sequence opt3 from neuraminidase__InfluenzaA__AFK74848

SEQ ID NO: 144530 - RNA, 1410 nt, Artificial Sequence; identical to SEQ ID NO: 138754
  derived and/or modified sequence opt3 from neuraminidase__InfluenzaA__AFK74898

SEQ ID NO: 144531 - RNA, 1410 nt, Artificial Sequence; identical to SEQ ID NO: 138754
  derived and/or modified sequence opt3 from neuraminidase__InfluenzaA__AFK74908

SEQ ID NO: 144532 - RNA, 1410 nt, Artificial Sequence; identical to SEQ ID NO: 138754
  derived and/or modified sequence opt3 from neuraminidase__InfluenzaA__AFK74918

SEQ ID NO: 144533 - RNA, 1410 nt, Artificial Sequence; identical to SEQ ID NO: 138754
  derived and/or modified sequence opt3 from neuraminidase__InfluenzaA__AFK74928

SEQ ID NO: 144534 - RNA, 1410 nt, Artificial Sequence
  derived and/or modified sequence opt3 from neuraminidase__InfluenzaA__AFK74938
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaauaccgggaguugcggaccuguguccagcaacggugcgaacggcguaaaaggguucucuuuuaaguauggaaauggcguguggaucggucggacaaagucaaucaguagccgcaacggguucgagaugauuugggauccaaauggcuggaccggaacggacaacaauuuuuccauaaaacaagacaucgucggcauuaacgaauggucuggguacucggggagcuucgugcagcaucccgagcugacuggucuggauuguauccgaccuugcuucuggguugaacucauuagaggcaggccaaaggagaauacaaucuggaccuccgggucaaguauaucuuuuuguggagugaacagcgacacugucggcugguccuggcccgauggugcagaguuaccguucacaaucgacaaauga

SEQ ID NO: 144535 - RNA, 1410 nt, Artificial Sequence; identical to SEQ ID NO: 138754
  derived and/or modified sequence opt3 from neuraminidase__InfluenzaA__AFK74948

SEQ ID NO: 144536 - RNA, 1410 nt, Artificial Sequence; identical to SEQ ID NO: 140645
  derived and/or modified sequence opt3 from neuraminidase__InfluenzaA__AFK74958

SEQ ID NO: 144537 - RNA, 1410 nt, Artificial Sequence; identical to SEQ ID NO: 141746
  derived and/or modified sequence opt3 from neuraminidase__InfluenzaA__AFK74968

SEQ ID NO: 144538 - RNA, 1410 nt, Artificial Sequence; identical to SEQ ID NO: 138754
  derived and/or modified sequence opt3 from neuraminidase__InfluenzaA__AFK74978

SEQ ID NO: 144539 - RNA, 1410 nt, Artificial Sequence; identical to SEQ ID NO: 140645
  derived and/or modified sequence opt3 from neuraminidase__InfluenzaA__AFK74988

SEQ ID NO: 144540 - RNA, 1410 nt, Artificial Sequence; identical to SEQ ID NO: 138754
  derived and/or modified sequence opt3 from neuraminidase__InfluenzaA__AFK74998

SEQ ID NO: 144541 - RNA, 1410 nt, Artificial Sequence; identical to SEQ ID NO: 141746
  derived and/or modified sequence opt3 from neuraminidase__InfluenzaA__AFK75008

SEQ ID NO: 144542 - RNA, 1410 nt, Artificial Sequence; identical to SEQ ID NO: 138754
  derived and/or modified sequence opt3 from neuraminidase__InfluenzaA__AFK75018

SEQ ID NO: 144543 - RNA, 1410 nt, Artificial Sequence; identical to SEQ ID NO: 138754
  derived and/or modified sequence opt3 from neuraminidase__InfluenzaA__AFK75028

SEQ ID NO: 144544 - RNA, 1410 nt, Artificial Sequence; identical to SEQ ID NO: 138754
  derived and/or modified sequence opt3 from neuraminidase__InfluenzaA__AFK75038

SEQ ID NO: 144545 - RNA, 1410 nt, Artificial Sequence; identical to SEQ ID NO: 138754
  derived and/or modified sequence opt3 from neuraminidase__InfluenzaA__AFK75048

SEQ ID NO: 144546 - RNA, 1410 nt, Artificial Sequence; identical to SEQ ID NO: 138754
  derived and/or modified sequence opt3 from neuraminidase__InfluenzaA__AFK75058

SEQ ID NO: 144547 - RNA, 1410 nt, Artificial Sequence; identical to SEQ ID NO: 141746
  derived and/or modified sequence opt3 from neuraminidase__InfluenzaA__AFK75068

SEQ ID NO: 144548 - RNA, 1410 nt, Artificial Sequence; identical to SEQ ID NO: 138754
  derived and/or modified sequence opt3 from neuraminidase__InfluenzaA__AFK75078

SEQ ID NO: 144549 - RNA, 1410 nt, Artificial Sequence; identical to SEQ ID NO: 138754
  derived and/or modified sequence opt3 from neuraminidase__InfluenzaA__AFK75088

SEQ ID NO: 144550 - RNA, 1410 nt, Artificial Sequence; identical to SEQ ID NO: 138754
  derived and/or modified sequence opt3 from neuraminidase__InfluenzaA__AFK75098

SEQ ID NO: 144551 - RNA, 1410 nt, Artificial Sequence; identical to SEQ ID NO: 140667
  derived and/or modified sequence opt3 from neuraminidase__InfluenzaA__AFK75108

SEQ ID NO: 144552 - RNA, 1410 nt, Artificial Sequence; identical to SEQ ID NO: 138754
  derived and/or modified sequence opt3 from neuraminidase__InfluenzaA__AFK77860

SEQ ID NO: 144553 - RNA, 1410 nt, Artificial Sequence; identical to SEQ ID NO: 138754
  derived and/or modified sequence opt3 from neuraminidase__InfluenzaA__AFK77870

SEQ ID NO: 144554 - RNA, 1410 nt, Artificial Sequence; identical to SEQ ID NO: 138754
  derived and/or modified sequence opt3 from neuraminidase__InfluenzaA__AFK77880

SEQ ID NO: 144555 - RNA, 1410 nt, Artificial Sequence
  derived and/or modified sequence opt3 from neuraminidase__InfluenzaA__AFK77890
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaagggaucucaagucgcaauggcuucgagaugauuugggauccaaacggauggaccggcacggacaauaacuuuagcauaaagcaagacaucgucgggauuaaugaaugguccggauacucugguucguucgugcagcaucccgagcugacuggccuggauuguauccgaccuugcuucuggguugaacucauuagagggaggccaaaagagaacacaaucuggaccagcggauccucaauaaguuuuuguggcgucaauucugacacuguggguuggagcuggcccgauggggcagaguuaccguucacaaucgacaaguga

SEQ ID NO: 144556 - RNA, 1410 nt, Artificial Sequence
  derived and/or modified sequence opt3 from neuraminidase__InfluenzaA__AFK77900
augaaccccaaucagaagaucauuaccauaggcagcgugugcaugacaaucgggauggccaaccugauucuccaaaucggaaauauuaucuccauauggaucucucacucaauucagaucgguaaccagaaucagauugagacuuguaaccaaagugucaucacguacgaaaauaacaccuggguuaaucagacauaugugaacauaagcaauacuaacuucgcugcaggccaguccguagccucugugaaacuugcgggaaauucgucacugugcccugucagcggaugggcuauuuacaguaaggacaacuccaucagaauuggcucuaaaggugauguguuuguuaucagggagccauucaucagcuguuccccguuggaaugccggaccuuuuucuuaacacagggggcccugcuaaaugacaagcauucaaacggaaccauuaaagaucgcagucccuaucgagcacucaugagcuguccuauaggcgaggugccaucucccuacaacucccguuuugaaucagucgccuggagcgcuagugcaugccacgacggcaucaauuggcugacuauugggaucucuggaccugauaacggugccguggcuguacuuaaguauaauggcauaauuacagacaccaucaaguccuggagaaacaauauccugaggacgcaagagagcgagugugccugcguuaacgggucguguuucacuauuaugaccgauggaccaucugacggccaggcguccuacaaaaucuuucggauugaaaaggguaaaauagugaagucagucgagaugaaugcacccaacuaucauuacgaagagugcaguuguuacccugauagcuccgagaucacaugcgugugccgcgacaauuggcacgggucuaacagaccaugggugagcuucaaucagaacuuggaauaucagauuggauacaucuguucaggcaucuuuggcgauaauccgaggcccaacgacaaaacugggaguugcggaccugucuccagcaauggugccaacggcguuaagggguucucuuuuaaguauggaaacggcguguggauuggucggaccaaaucaauaaguagccgcaagggguucgagaugaucugggauccaaauggcuggacaggaaccgacaacaauuuuuccauuaaacaagacaucguaggcaugaacgaauggucuggguacucggggagcuucgugcagcaucccgagcucacgggucuggauuguauucgaccuugcuucugggucgaacugaucagaggcaggccaaaggagaauacuauauggacauccgggucaaguaucucuuuuuguggagugaacagcgacaccguuggcugguccuggcccgauggugcugagcucccguucacuauugacaaauga

SEQ ID NO: 144557 - RNA, 1410 nt, Artificial Sequence
  derived and/or modified sequence opt3 from neuraminidase__InfluenzaA__AFK78031
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagccucugugaaacuggcgggaaauucgucauugugcccugucagcggaugggcuauauacaguaaggacaacuccauuagaaucggcucuaaaggugauguguuuguuauuagggagccauucaucagcuguuccccguuagaaugccggaccuuuuuccugacacagggggcccuacucaaugacaagcauucaaacggaaccaucaaagaucgcagucccuaucgagcacugaugagcuguccuauuggcgaggugccaucucccuacaacucccguuuugaaucagucgccuggagcgcuagugcaugccacgacggcauaaauuggcuuacuaucgggauuucuggaccugauaacggugccguggcuguacugaaguauaauggcaucauaacagacaccauuaaguccuggagaaacaauaucuugaggacgcaagagagcgagugugccugcguuaacgggucguguuucacuaucaugaccgauggaccaucugacggccaggcguccuacaaaauuuuucggaucgaaaaggguaaaauugugaagucagucgagaugaaugcacccaacuaucauuacgaagagugcaguuguuacccugauagcuccgagauaacaugcgugugccgcgacaauuggcacgggucuaacagaccaugggugagcuucaaucagaaccucgaauaucagaucggauacauuuguucaggcaucuuuggcgauaauccgaggcccaacgacaaaacugggaguugcggaccugucuccagcaauggugccaacggcguuaagggguucucuuuuaaguauggaaacggcguguggaucggucggaccaaaucaauuaguagccgcaagggguucgagaugauaugggauccaaauggcuggacaggaaccgacaacaauuuuuccaucaaacaagacauuguaggcaugaacgaauggucuggguacucggggagcuucgugcagcaucccgagcugacgggucuggauuguauccgaccuugcuucugggucgaacucauuagaggcaggccaaaggagaauacuaucuggacauccgggucaaguauaucuuuuuguggagugaacagcgacaccguuggcugguccuggcccgauggugcugaguuaccguucacuaucgacaaauga

SEQ ID NO: 144558 - RNA, 1410 nt, Artificial Sequence; identical to SEQ ID NO: 138754
  derived and/or modified sequence opt3 from neuraminidase__InfluenzaA__AFK78190

SEQ ID NO: 144559 - RNA, 1362 nt, Artificial Sequence
  derived and/or modified sequence opt3 from neuraminidase__InfluenzaA__AFM68957
augaaccccaaucagaagaucauuaccauaggcagcaucugcaugguggucgggauuaucucccugauucuccaaaucggaaacauaaucucuauuuggaucucacacaguauucagacagguaaucagaaccauacuggcaucuguaaucaggggauaauuacgcacaacguuguggccggacaagacagcaccuccguaauccuuacaggcaauucuucgcugugcccuauuagagguugggcuauccauucaaaagauaacgggaucaggauuggaagcaagggcgacguguucgucauacgggagccauuuaucaguuguucccacuuggaaugccgcacuuucuuuuuaacccagggcgcacugcuaaaugauaaacauucuuacgggacaagcaaggaccgauccccguaucgugcccucaugucaugucccgugggagaggcgccuaguccauacaacagcagauucgaaucuguugcuugguccgccucagcaugccacgaugguaugggcuggcugaccauugggaucagcggacccgacaauggcgccguggcuguccuuaaauauaacgguauaauuacugagacaaucaagaguuggaggaagaaaauccugcggacccaggaaucugaguguacgugcgugaauggguccuguuuuacuauuaugaccgauggaccuagcgacggcuuggcaucguacaagaucuucaaaauugagaagggcaaaguaacaaagucuauagaacucaacgccccaaauucccacuaugaggaaugcucauguuaccccgauacugggaagguuaugugcgugugccgcgacaacuggcauggaaguaacagaccuugggucagcuuugaucagaaucuggacuaucaaaucgguuacauuuguuccggcguguucggggauaacccaaggccgaaagacggaaccggcucuugcggucccgugagcgcugacggggccaauggcgucaagggauuuucauaccgguauggcaacgggguuuggaucggacgcacaaaaagugauuccagccgacacgguuucgagaugaucugggacccuaauggcuggaccgagacggauucuagauuuucagugaggcaggacguaguggcgaugacugaucggaguggguacagcggauccuucguccagcauccagaacugacaggccucgacuguaugcgucccugcuuuuggguggaguuaauucgcggucagccugaagaggaaaccauauggacuucugggucgaucauuagcuucuguggcguuaacuccgauacaguggacuggucauggccagauggagcagagcugcccuucaccaucgacaaguga

SEQ ID NO: 144560 - RNA, 1410 nt, Artificial Sequence
  derived and/or modified sequence opt3 from neuraminidase__InfluenzaA__AFM68968
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaccccacaucguacacugcuuaugaacgaacugggcguucccuuucacuuggguacuagacagguguguaucgccuggucaagcaguuccugccaugaugggaaggcauggcuccacgucugugugaccggauaugacaaaaaugccacagcuucuuucaucuacgauggcaggcugguagacagcauuggcuccuggucaaagaacauacugcggacccaggagagugaaugcguuuguaucaaugggacgugcacuguggucaugacagauggaagcgcaucugagcgcgccgacaccaaaauucucuuuaucgaggaagguaagauagugcacauuuccccuuuaucaggcagcgcucaacauguggaggaaugcaguuguuauccaagauacccgggggucaggugcguuugucgggauaacuggaagggaucuaaucgccccaucguggacaucaacguaaaagacuacuccauugccagcucguaugugugcucuggccuggucggugauacuccucgaaagaacgacagauccucaaguagcuacuguaggaauccaaacaaugagaaagggaaccacggagugaagggcugggcguucgaugacggcaaugauguuuggauggggcggacaaucuccgaagagucucguagcggauaugagaccuuuaaagugauugguggcuggucaacgcccaacaguaaacuucagauaaaucgccaggucaucguggacuccgauaacagaagcggguacucuggaauuuucucaguagaaggcaagaguugcaucaauagguguuuuuauguugaguugauccggggucgagaacaggagacccgcgugugguggacaagcaacuccauugucguguucugcgggacuucuggcaccuacggaacaggcucguggccugacggggcagauauaaaucugaugccaaucuga

SEQ ID NO: 144561 - RNA, 1410 nt, Artificial Sequence
  derived and/or modified sequence opt3 from neuraminidase__InfluenzaA__AFM68979
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccaucauaaucgagagaaacauuacugaaaucguauauuugaccaauacaaccauugagaaggaaaucuguccuaaauuaguggaguacaggaacuggaguaagccacagugcaaaauaacuggguucgcacccuuuagcaaggacaauuccauucggcugucugccggagguggcaucugggucacacgcgagccuuaugugucgugugauccagggaagugcuaccaauucgcgcuaggacagggcaccacgcucgacaacaaacauucaaaugauacuauucacgaccgaacccccuaucguacacugcuuaugaacgaacuggguguuccuuuucauuuggggacuagacagguguguaucgcuuggagcaguuccucuugccacgauggaaaggccuggcuccaugucugugugaccggcuacgacaaaaaugcaacagccagcuucaucuaugauggcaggcugguagacuccauugggucauggaguaagaacauacugcggacccaggagagcgaaugcguuuguaucaauggaacgugcacuguggucaugacagaugguucugcuuccgagcgcgcagacaccaaaauucucuuuaucgaggaaggcaagauagugcacauuucaccauuaagcgggagugcccaacacguggaggaaugcucuuguuacccgagauaccccggagucaggugcguuugucgggauaacuggaagggcuccaaucgcccugugguagacaucaacgugaaagauuauagcaucgucucgucuuacgugugcuccggucugguuggggacacuccacgaaagaacgacagaucaaguagcuccuauuguaggaaucccaacaaugagaaaggaaaccauggcgugaagggcugggcuuucgaugacgggaaugaugucuggaugggacggacaauuucugaagagagccguucagguuacgagaccuuuaaagugaucggcggguggaguacgccuaacuccaaacuucagauuaaucgccagguaauaguugacagcgauaacagaucuggauauucaggcaucuucaguguggaagguaagagcugcauuaauagguguuuuuacgucgaguugauccgggggcgagaacaggagacccgcgugugguggacauccaacucuaucgucguguucugcggcacuucgggaaccuauggcacagggagcuggccagacggagccgauauuaaucugaugcccauauga

SEQ ID NO: 144562 - RNA, 1410 nt, Artificial Sequence; identical to SEQ ID NO: 144561
  derived and/or modified sequence opt3 from neuraminidase__InfluenzaA__AFM68990

SEQ ID NO: 144563 - RNA, 1410 nt, Artificial Sequence; identical to SEQ ID NO: 136829
  derived and/or modified sequence opt3 from neuraminidase__InfluenzaA__AFM71723

SEQ ID NO: 144564 - RNA, 1410 nt, Artificial Sequence; identical to SEQ ID NO: 144151
  derived and/or modified sequence opt3 from neuraminidase__InfluenzaA__AFM71734

SEQ ID NO: 144565 - RNA, 1410 nt, Artificial Sequence; identical to SEQ ID NO: 143965
  derived and/or modified sequence opt3 from neuraminidase__InfluenzaA__AFM71745

SEQ ID NO: 144566 - RNA, 1410 nt, Artificial Sequence; identical to SEQ ID NO: 140625
  derived and/or modified sequence opt3 from neuraminidase__InfluenzaA__AFM71771

SEQ ID NO: 144567 - RNA, 1410 nt, Artificial Sequence; identical to SEQ ID NO: 143651
  derived and/or modified sequence opt3 from neuraminidase__InfluenzaA__AFM71782

SEQ ID NO: 144568 - RNA, 1410 nt, Artificial Sequence; identical to SEQ ID NO: 143651
  derived and/or modified sequence opt3 from neuraminidase__InfluenzaA__AFM71794

SEQ ID NO: 144569 - RNA, 1410 nt, Artificial Sequence; identical to SEQ ID NO: 138615
  derived and/or modified sequence opt3 from neuraminidase__InfluenzaA__AFM71805

SEQ ID NO: 144570 - RNA, 1410 nt, Artificial Sequence
  derived and/or modified sequence opt3 from neuraminidase__InfluenzaA__AFM71827
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaaggauguguggauggggcgaaccauuagcgagaaaucaagauugggauaugagacauuuaaggucaucgaagguuggaguaacccaaaauccaagcugcagauuaauaggcaagugauaguagaccggggcaaccguagcggguacucuggaaucuucucaguugagggcaagaguuguauuaaucgcugcuuuuauguggaacuaaucagagguaggaaagaggaaacugagguccucuggaccagcaacuccaucguggucuucugugggacaucuggcacuuacggaaccggcucguggcccgauggggccgacauuaaucugaugccuauauga

SEQ ID NO: 144571 - RNA, 1410 nt, Artificial Sequence; identical to SEQ ID NO: 141534
  derived and/or modified sequence opt3 from neuraminidase__InfluenzaA__AFM71838

SEQ ID NO: 144572 - RNA, 1365 nt, Artificial Sequence; identical to SEQ ID NO: 137735
  derived and/or modified sequence opt3 from neuraminidase__InfluenzaA__AFM71849

SEQ ID NO: 144573 - RNA, 1410 nt, Artificial Sequence; identical to SEQ ID NO: 136111
  derived and/or modified sequence opt3 from neuraminidase__InfluenzaA__AFM71860

SEQ ID NO: 144574 - RNA, 1410 nt, Artificial Sequence; identical to SEQ ID NO: 136343
  derived and/or modified sequence opt3 from neuraminidase__InfluenzaA__AFM71871

SEQ ID NO: 144575 - RNA, 1410 nt, Artificial Sequence; identical to SEQ ID NO: 136343
  derived and/or modified sequence opt3 from neuraminidase__InfluenzaA__AFM71882

SEQ ID NO: 144576 - RNA, 1410 nt, Artificial Sequence
  derived and/or modified sequence opt3 from neuraminidase__InfluenzaA__AFM71893
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgagguggucgaguauaggaacuggaguaaaccucagugccaaaucaccggguucgcgccauuuagcaaggauaauuccauacgguuaucugcuggaggugacauuugggugacucgcgaacccuacguuucgugugauccuggcaaaugcuaucaguucgcccuggggcagggaacaacccuagacaacaagcacucaaauggcacgauccaugaucguauuccacaccgaacucuccugaugaacgagcuuggugugcccuuucaucuggggaccaagcaggucuguguggcauggagcaguuccucuugccacgacggaaaagccugguugcacguauguguuacaggcgaugacagaaaugcuacugccagcuucaucuacgauggcaggcucguggacuccaucgggucauggagucaaaacauucugcggacccaggaaagcgagugcgucuguauaaauggaacaugcaccguggugaugacggaugguucugcauccggccgcgcugacacuagaauccuguuuauuaaggaggggaaaaucguccauauaucaccucucagcggaagugcccagcacauugaagagugcucuuguuauccaagguacccggauguucggugcaucugucgcgacaacuggaagggcuccaaucgacccgugaucgacauuaacauggaagauuauagcaucgacucgucuuacguaugcuccgguuuagugggggauacaccuagaaacgacgauucaaguagcaauuccaacuguagggacccaaauaacgagcggggaaaucccggcgucaaaggcugggcguucgauaacggggacgauguguggaugggacguaccauuaauaaggaaucucgcagcgguuacgagacuuuuaagguuauaggcggguggucaacaccuaacaguaaaucccaggugaauagacaagucaucguggacaacaauaacuggagcggauauucuggcauuuucucaguagaggguaagaguugcaucaauagguguuuuuacguugaacugauccgggggcgaccacaggagacccgcgugugguggacgagcaacuccauugucguguucugcggcaccucuggaacauauggcacugggucguggcccgauggagcaaauauaaacuuuaugccgaucuga

SEQ ID NO: 144577 - RNA, 1410 nt, Artificial Sequence
  derived and/or modified sequence opt3 from neuraminidase__InfluenzaA__AFM71904
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgagguggucgaguauaggaacuggaguaaaccucagugccaaaucaccggguucgcgccauuuagcaaggauaauuccauacgguuaucugcuggaggugacauuugggugacucgcgaacccuacguuucgugugauccuggcaaaugcuaucaguucgcccuggggcagggaacaacccuagacaacaagcacucaaaugugacgauccaugaucguauuccacaccgaacucuccugaugaacgagcuuggcguccccuuucaucuggguaccaaacagguguguguagcauggagcaguuccucuugccacgacgggaaggccugguugcacguuugugugacaggagaugacagaaaugcuacugccagcuucaucuacgauggcaggcucgucgacuccaucggcucauggagucaaaacauucugcggacccaggaaagcgagugcguguguauaaaugggacaugcaccguggucaugacggauggaucugcauccggucgcgcugacacuagaauccuguuuauuaaggagggcaaaaucguucauauaucaccucucagcgggagugcccagcacauugaagagugcucuuguuauccaagguacccggaugugcggugcaucugucgcgacaacuggaagggauccaaucgacccguaaucgacauuaacauggaagauuauagcaucgacucgggcuacgugugcucugguuuagucggggauacaccuagaaacgacgauuccucaaguaauagcaacuguagggacccaaauaacgagcggggaaaucccggcgugaaaggcugggcguucgauaacggggacgauguuuggaugggacguaccauuaauaaggaaucccgcucugguuacgagacuuuuaaggugauaggcggguggagcacaccuaacucaaaaagucaggucaauagacaagugaucguagacaacaauaacugguccggauauagcggcauuuucucuguugaggguaagucaugcaucaauagguguuuuuacguggaacugauccgggggcgaccacaggagacccgcgucugguggacgaguaacagcauuguggucuucugcggcaccuccggaacauauggcacugggucuuggcccgauggagcaaauauaaacuuuaugccgaucuga

SEQ ID NO: 144578 - RNA, 1410 nt, Artificial Sequence; identical to SEQ ID NO: 136988
  derived and/or modified sequence opt3 from neuraminidase__InfluenzaA__AFM71915

SEQ ID NO: 144579 - RNA, 1410 nt, Artificial Sequence; identical to SEQ ID NO: 136988
  derived and/or modified sequence opt3 from neuraminidase__InfluenzaA__AFM71926

SEQ ID NO: 144580 - RNA, 1410 nt, Artificial Sequence; identical to SEQ ID NO: 136988
  derived and/or modified sequence opt3 from neuraminidase__InfluenzaA__AFM71937

SEQ ID NO: 144581 - RNA, 1410 nt, Artificial Sequence; identical to SEQ ID NO: 143996
  derived and/or modified sequence opt3 from neuraminidase__InfluenzaA__AFM71948

SEQ ID NO: 144582 - RNA, 1410 nt, Artificial Sequence; identical to SEQ ID NO: 143996
  derived and/or modified sequence opt3 from neuraminidase__InfluenzaA__AFM71959

SEQ ID NO: 144583 - RNA, 1410 nt, Artificial Sequence
  derived and/or modified sequence opt3 from neuraminidase__InfluenzaA__AFM71970
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccauaugaaccgaucauaaucgagagaaacauuacugaaaucguauacuugaccaauacaaccauugagaaggaaaucugccccaaauuaguggaguauaggaacuggucaaagccucaguguaaaauaacuggguucgccccauuuaguaaggauaauagcauucggcuguccgcgggaggugacaucugggucacacgcgagcccuacgugucuugcgauccuggcaaguguuaucaauucgcucuagggcagggaaccacgcucgaaaacaaacauucgaaugacacuauucacgaucgaaccccacaucguacacugcuuaugaacgagcugggcguucccuuucacuuggguacuagacaggugugcaucgccuggucaagcaguuccugucaugacgggaaggcauggcuccacgucugcgugaccggauacgauaaaaaugccacagcuucuuucaucuaugacggcaggcugguagauagcauuggcuccuggucacagaacauacugcggacccaagaaagugaguguguuugcaucaaugggacguguacuguggucaugacagacggaagcgcaucuggucgcgccgauaccaagauucucuuuaucgaggaaggcaaaauagugcacauuuccccuuuaucagggagcgcucagcauguggaggaaugcaguugcuacccaagauacccgggagucagguguaucugccgggacaacuggaagggcucuaaucgccccguuguggauaucaacguaaaggacuauuccauugacagcucguacguguguucuggucuggucggggauacuccucgaaagaacgacagauccucaaguagcuauugcaggaauccaaacaaugagaaaggaaaccacggcgugaaaggcugggccuucgaugacgggaaugauguuuggaugggacggacaaucuccgaagacucucguagcgguuacgagaccuuuaaggugauuggcggguggucaacgcccaacaguaaacuucagauaaaucgccaggucaucguggauuccgcgaacagaagcggauauucuggcauuuucucaguagaggguaagaguuguaucaauaggugcuuuuacguugaauugauccgggggcgagagcaagaaacccgcgugugguggacaagcaacuccauugucguguucuguggcacuucuggaaccuauggcacagggucguggccugacggagcagauauaaaucugaugccaaucuga

SEQ ID NO: 144584 - RNA, 1410 nt, Artificial Sequence; identical to SEQ ID NO: 144004
  derived and/or modified sequence opt3 from neuraminidase__InfluenzaA__AFM71981

SEQ ID NO: 144585 - RNA, 1410 nt, Artificial Sequence
  derived and/or modified sequence opt3 from neuraminidase__InfluenzaA__AFM71992
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggagucaggagauucugcggacgcaagaaagcgagugugugugcauaaacggcacuuguacagucgugaugaccgacggcucugcuuccgggaaagcagauacuaagauccucuuuauugaggaaggaaaaaucgugcauacaucaaccuuaagcgguagugcccagcacgucgaggaaugcucuugcuauccucgcuacccaggcguuagaugugugugcagggacaacuggaagggguccaaucggccgauaguagauauuaacaucaaggaccacagcaucgugucgucuuacgucuguuccggacuggugggcgacacgccccgcaaaaaugauucaaguagcuccucucauugccuugacccuaacaaugaggaaggugggcacggaguuaagggcugggcuuucgaugacggcaacgauguguggauggggcgaaccauuaaugagacaagcagauugggauaugagacuuuuaaagucaucgaagguuggucaaacccaaagaguaaacugcagaugaauaggcaagugauuguagaccggggcaaccguuccggguacagcggaauauucucuguugagggcaagucauguaucaaucgcugcuuuuauguggaacuaauuagagguaggaaagaggaaaccgagguccucuggacaaguaacagcaucguggucuucugugggacuuccggcaccuacggaacaggcucuuggcccgauggggccgaccugaaucuuaugccuaucuga

SEQ ID NO: 144586 - RNA, 1410 nt, Artificial Sequence; identical to SEQ ID NO: 144560
  derived and/or modified sequence opt3 from neuraminidase__InfluenzaA__AFM72013

SEQ ID NO: 144587 - RNA, 1365 nt, Artificial Sequence; identical to SEQ ID NO: 137735
  derived and/or modified sequence opt3 from neuraminidase__InfluenzaA__AFM72024

SEQ ID NO: 144588 - RNA, 1410 nt, Artificial Sequence; identical to SEQ ID NO: 141011
  derived and/or modified sequence opt3 from neuraminidase__InfluenzaA__AFM72035

SEQ ID NO: 144589 - RNA, 1410 nt, Artificial Sequence; identical to SEQ ID NO: 141011
  derived and/or modified sequence opt3 from neuraminidase__InfluenzaA__AFM72046

SEQ ID NO: 144590 - RNA, 1413 nt, Artificial Sequence
  derived and/or modified sequence opt3 from neuraminidase__InfluenzaA__AFM72057
augaaccccaaucagaagaucauuaccauaggcagcaucugcacaacuauugggaucauuucccugauccuccaaauaggaaacaucauuucuaucugggugucacacaguauucagacggguagccagaaucauaccggcaucuguaaccagagaauaauuacauacgaaaauuccacuugggucaaccaaaccuauguuaauaucaacaauacaaacgugguagccgggaaagacaccacuucugugacacuugcuggaaauucgucacugugcccuauuaggggcugggcaaucuacagcaaggauaacaguauccggauugguuccaaaggggacgucuucgugauacgcgaaccauuuaucucuuguagccacuuggagugccgaaccuucuuuuuaacgcagggagcccugcuaaaugauaagcauuccaacggcacuguuaaagaccguucaccguauagagcgcucaugaguugucccauuggcgaagcuccuagcccauacaauucuagguucgaguccguggccuggucagcaagcgccugccacgaugggaugggauggcugaccaucgguauaaguggccccgacgauggggcugucgcagugcuuaaguauaacggaauuaucacagaaacuaucaagucuuggcggaaacgcauucugagaacccaggaguccgaguguguaugcguuaacggcagcuguuuuacaaucaugaccgacgguccuucgaaugggccagccucuuacaggauuuucaagauagaaaaaggaaagaucacgaaauccauugaguuggaugcucccaacucacauuaugaagagugcaguuguuacccugacacuggcacagugaugugcgucugccgggauaauuggcacggcagcaaccgcccauggguguccuuuaaucagaaccucgacuaccaaaucggguauaucuguucuggaguguucggugauaauccgcgacccaaggacggcaaggggagcugcgacccugucaccguugauggagccgacggcgugaaagguuuuucauacagauaugggaacggcguauggauuggaaggacuaagaguaauuccagccggaaaggcuucgagaugauaugggauccaaacggguggacagacaccgauucuaauuuucuggugaagcaggacgucguggcgaugacggauuggucaggauacagugguagcuucguucagcaccccgaacugaccggccucgacuguaugcguccuugcuuuuggguggaguuaauccgcgggagaccaagggagaaaacaacuauuuggaccuccggaucuucgaucagcuucuguggcgucaacuccgauacagcaaauuggucauggcccgacggugccgagcugccguucacuauugauaaguga

SEQ ID NO: 144591 - RNA, 1413 nt, Artificial Sequence; identical to SEQ ID NO: 137075
  derived and/or modified sequence opt3 from neuraminidase__InfluenzaA__AFM72068

SEQ ID NO: 144592 - RNA, 1410 nt, Artificial Sequence
  derived and/or modified sequence opt3 from neuraminidase__InfluenzaA__AFM72090
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccaucauaaucgagagaaacauuacugaaaucguauauuugaccaauacaaccauugagaaggaaaucuguccuaaauuaguggaguacaggaacuggaguaagccacagugcaaaauaacuggguucgcacccuuuagcaaggacaauuccauucggcugucugccggaggugauaucugggucacacgcgagccuuaugugucgugugacccaggcaagugcuaccaauucgcgcuagggcagggaaccacgcucaacaauaaacauucaaacgauacuguucacgaccgaacccccuaucguacacugcuuaugaaugaacugggcgugccuuuucauuuggguacuaagcaggucuguauugcuuggagcaguuccucuugccacgaugggaaagccuggcuccauguguguguaaccggacacgacaagaacgcaacagccagcuucaucuacgauggcagacugguugacuccaucggcucauggaguaaaaauauucugaggacccaggagagcgaaugcguguguauaaacgggacgugcacugucgugaugacagauggaucugcuuccgagcgggcagacaccaagauccucuuuauugaggaagguaagaucgugcacauaucaccauuaagcggcagugcccaacaugucgaggaaugcucuuguuauccgcgcuaccccgggguuagaugcguguguagggauaauuggaaaggauccaaccggccuauuguagacaucaacgugaaggauuacagcaucgucucgucuuaugugugcuccggccugguuggugacacuccacgcaaaaaugaccgaucaaguagcuccuacuguagaaaccccaauaacgagaaggggaaucacggagugaaaggcugggcuuucgaugacggcaacgaugucuggauggggaggacaauuggagaggaacuucgguuggguuaugagaccuuuaaggugaucggcggguggucuacgccuaauagcaaacugcagauuaaccgucagguaauaguugacucaaagaaucgcaguggauacuccggcaucuucagcguggaagguaagucuugcauuaacagauguuuuuaugucgagcuaaucagggggcgggaacaggagacccgagugugguggacaucaaauaguaucgucguguucugcggcacuagcggaaccuacggcacaggguccuggccagauggagccgacauuaaccucaugcccauauga

SEQ ID NO: 144593 - RNA, 1410 nt, Artificial Sequence
  derived and/or modified sequence opt3 from neuraminidase__InfluenzaA__AFM72101
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggcaaugccgugcgaacccacuaucauagagagaaacaucaccgaaauuguguauuugacaaauaccacuaucgagaaggaaauuuguccuaaauuaguagaguacaggaacuggaguaagccacagugcaaaaucacaggguucgcccccuuuagcaaggacaauuccauacggcugucugcgggaggugauauuugggugacccgcgagccuuaugucucgugugacccaggcaagugcuaccaauucgcucuagggcagggaacgacucucaacaaucgacauucaaacgauaccgugcacgaccguacacccuauagaacucugcuuaugaaugaacugggcguuccuuuucauuuggguaccaaacagguguguaucgccuggagcaguuccucuugccacgaugggaaggcauggcuccaugucugugugacaggacacgacaaaaacgccaccgcuagcuucauuuacgauggcaggcugguagacuccaucggcucauggaguaagaauauccugcggacgcaggagagcgaaugcguuuguauuaacgggacuugcacaguggucaugaccgauggaucugcauccgagcgcgccgacacuaaaauacucuuuaucgaggaagguaagauugugcacaucucaccauuaagcggcagugcucaacauguggaggaaugcucuuguuauccgagauaccccggggucaggugcguuugucgggauaauuggaagggauccaaccgcccuauaguggacauuaacguaaaagauuacagcaucgugucgucuuaugucugcuccggccuggugggugacacaccacgaaagaaugacagaucaaguagcuccuacuguaggaaccccaauaacgagaaagggucucacggaguuaagggcugggccuucgaugacggcaaugauguguggauggggcggaccaucggagaggaacuucguagcgguuaugagacguuuaaagucauuggcggguggucaaccccuaacaguaaguugcagaucaaucgccaggugauuguagacuccggaaacagaagcggcuacucugguauauucucaguugaagggaaaaguugcaucaauagguguuuuuauguggagcugauucggggccgagaacaggagacacgcgucugguggacuagcaacuccaucguggucuucugcggaaccucuggcacauacgggacuggaucguggccagauggugcggacaucaaucuaaugcccauuuga

SEQ ID NO: 144594 - RNA, 1410 nt, Artificial Sequence; identical to SEQ ID NO: 136829
  derived and/or modified sequence opt3 from neuraminidase__InfluenzaA__AFM72112

SEQ ID NO: 144595 - RNA, 1410 nt, Artificial Sequence
  derived and/or modified sequence opt3 from neuraminidase__InfluenzaA__AFM72123
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccacuaucauagagagaaacaucaccgaaauuguauauuugacaaauaccacuaucgagaaggaaauuuguccuaaauuaguggaguacaggaacuggaguaagccacagugcaaaaucacaggguucgcacccuuuagcaaggacaauuccauacggcugucugccggaggugauauuugggucacccgcgagccuuaugugucgugugacccaggcaagugcuaccaauucgcgcuagggcagggaacgacucucaacaaucgacauucaaacgauaccguucacgaccguacacccuauagaacucugcuuaugaaugaacugggcgugccuuuucauuuggguaccaaacaggucuguaucgcuuggagcaguuccucuugccacgaugggaaggccuggcuccauguguguguaacaggacacgacaaaaacgcaaccgccagcuucauuuacgauggcaggcugguugacuccaucggcucauggaguaagaauauccugcggacgcaggagagcgaaugcguguguauuaacgggacuugcacagucgugaugaccgauggaucugcuuccgagcgcgcagacacuaaaauacucuuuaucgaggaagguaagauugugcacaucucaccauuaagcggcagugcccaacaugucgaggaaugcucuuguuauccgagauaccccgggguuaggugcgugugucgggauaauuggaagggauccaaccgcccuauaguagacauuaacgugaaagauuacagcaucgucucgucuuaugugugcuccggccugguuggugacacaccacgaaagaaugacagaucaaguagcuccuacuguaggaaccccaauaacgagaaagggucucacggagugaagggcugggcuuucgaugacggcaaugaugucuggauggggcggaccaucggagaggaacuucguagcgguuaugagacguuuaaagugauuggcggguggucaaccccuaacaguaaguugcagacaaaucgccagguaaucguugacuccggaaacagaagcggcuacucugguauuuucucaguggaagggaaaaguugcauaaauagguguuuuuaugucgagcugauccggggccgagaacaggagacucgcgugugguggaccagcaacuccauugucguguucugcggaacaucuggcacuuacgggaccggaucguggccagauggugccgacaucaaucuaaugcccaucuga

SEQ ID NO: 144596 - RNA, 1410 nt, Artificial Sequence; identical to SEQ ID NO: 144151
  derived and/or modified sequence opt3 from neuraminidase__InfluenzaA__AFM72134

SEQ ID NO: 144597 - RNA, 1410 nt, Artificial Sequence
  derived and/or modified sequence opt3 from neuraminidase__InfluenzaA__AFM72145
augaaccccaaucagaagaucauuaccauaggcagcgugucccugacaaucgccacuauuugcuuccucaugcaaaucgcuauucuugcaaucacggucacccugcacuuuaaacaguacgaguguaacucuccuccaaauaaccagguuauguugugcgaaccgacaauaaucgagagaaauacuaccgaaauuguguauuuaacaaacaccacuaucgagaaggaaguaugucccaaacuggccgaguacaggaauuggucaaagccucagugcaaaauuacaggguucgcgccauuuaguaaggacaacagcauccggcuauccgcuggaggugauauaugggugacccgcgagcccuaugucucuugugacccuggcaagugcuaccaauucgcccucgggcagggaacgacucugaauaaccgacauucgaaugauaccgugcacgaccguacaccauauagaacucuucugaugaacgaauugggcguucccuuucaucucgguaccaaacagguguguauugcauggucaagcaguuccugccacgaugggaaggccuggcugcaugucugugugacaggacacgacgagaaugcuaccgcaucuuucaucuacgauggcaggcugguagacagcauuggcuccuggaguaaaaacauccuccggacgcaggaaucagagugcguuuguaucaaugggacuugcacaguggucaugaccgauggaagcgccucugagcgcgcugacacuaagauuuuauuuauagaagaggguaaaaucgugcacauuuccccucugucaggcagcgcccaacauguggaagagugcaguuguuauccaagauacccgggggucaggugcguuugucgggauaacuggaagggaucuaaccgccccaucguggacauaaauguaaaggauuacuccauugugagcucguaugucugcucuggccuugugggugacacaccucgaaagaacgacuccucaaguagcuccuacuguagaaauccaaacaaugaaaaagggucucacggaguuaaaggcugggcguucgaugacggcaacgauguguggauggggaggaccaucagcgaggaguugcggucaggauaugaaacguuuaaggucaucgguggcuggaguaaacccaauuccaagcugcagauuaaccgucaggugaucguagaccgcgggaauagaagcggauacucuggcauuuucucaguugaggguaaaaguugcauaaacagguguuuuuauguggaacuaauccgggggcgaaagcaggagaccgaagucugguggacaagcaauuccauuguggucuucugcggcacuucuggaaccuacggcacagggucguggccugauggagcagacaucaaccucaugccaaucuga

SEQ ID NO: 144598 - RNA, 1410 nt, Artificial Sequence; identical to SEQ ID NO: 137201
  derived and/or modified sequence opt3 from neuraminidase__InfluenzaA__AFM72156

SEQ ID NO: 144599 - RNA, 1410 nt, Artificial Sequence
  derived and/or modified sequence opt3 from neuraminidase__InfluenzaA__AFM72167
augaaccccaaucagaagaucauuaccauaggcagcaucucccugacaauugccacuaucugcuuccucaugcaaauugcuauccuugugacgaccgucacacugcacuuuaaacaguacgaguguaacucuccuccaaauaaccagguuauguugugcgaaccgacuauaaucgagagaaauauuaccgaaaucguguauuuaacaaacaccacuauugagaaggaaaucugucccgagcuggcagaguacaggaauuggucaaaaccucagugcaagauaacaggguucgccccauuuaguaaagacaacagcauucggcuauccgcgggaggugauaucuggguaacccgcgaacccuaugugucuugugacccuggcaagugcuaccaauucgcucucgggcagggaacgacucugaauaaccgacauucgaaugauaccguccacgaccguacaccauauagaacucuucugaugaacgaguugggcgugcccuuucaucucgguaccaagcagguuuguauugccuggucaagcaguuccugccacgaugggaaagcauggcugcaugugugugucacaggacacgacgaaaaugccaccgcuucuuucaucuacgauggcaggcugguggacagcaucggcuccuggucaaagaacauucuccggacgcaggagagugagugcguauguauaaaugggacuugcacaguugugaugaccgauggaagcgcaucugaacgcgccgacacuaaaaucuuauuuauugaggaagguaagaucguccacauauccccucugucaggcagcgcucaacauguggaggaaugcaguuguuauccaagauacccgggggugaggugcgucugucgggauaacuggaaaggaucuaaccgccccauuguugacaucaaugugaaggauuacuccaucguaagcucguaugugugcucuggccuugucggugacacaccucgaaagaacgacuccucaaguagcuccuacuguuggaauccaaacaaugagaaagggggacacggcgugaagggcugggccuucgaugacgggaacgauguuuggaugggaagaaccauuucugaggaauugaggagcgguuaugagacguuuaaagugaucggcggguggucaaagcccaauaguaaacugcagauuaaccggcaggucauaguggaccguggaaaucgcuccggcuacagcgguaucuucucuguagaagggaagucaugcauuaacagauguuuuuauguugagcuaaucaggggccggaaacaggaaaccgaggugugguggacaaguaauagcaucgucguguucugcggaacuuccggcaccuacgggacaggaucuuggccugauggugcggacauuaaccucaugccaauauga

SEQ ID NO: 144600 - RNA, 1410 nt, Artificial Sequence
  derived and/or modified sequence opt3 from neuraminidase__InfluenzaA__AFM72178
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccgagcuggcagaguacaggaauuggucaaaaccucagugcaagaucacaggguucgccccauuuaguaaagacaacagcauacggcuauccgcgggaggugauauuugggugacccgcgaacccuaugucucuugugacccuggcaagugcuaccaauucgcucucgggcagggaacgacucugaauaaccgacauucgaaugauaccgugcacgaccguacaccauauagaacucuucugaugaacgaguugggcguucccuuucaucucgguaccaaacagguguguaucgccuggucaagcaguuccugccacgaugggaaggcauggcugcaugucugugugacaggacacgacgaaaaugccaccgcuucuuucauuuacgauggcaggcugguagacagcaucggcuccuggucaaagaacauccuccggacgcaggagagugagugcguuuguauuaaugggacuugcacaguggucaugaccgauggaagcgcaucugaacgcgccgacacuaaaauauuauuuaucgaggaagguaagauugugcacaucuccccucugucaggcagcgcucaacauguggaggaaugcaguuguuauccaagauacccgggggucaggugcguuugucgggauaacuggaaaggaucuaaccgccccauaguggacauuaauguaaaggauuacuccaucgugagcucguaugucugcucuggccuugugggugacacaccucgaaagaacgacuccucaaguagcuccuacuguuggaauccaaacaaugagaaagggggacacggcguuaagggcugggccuucgaugacgggaacgauguguggaugggaagaaccaucucugaggaauugaggagcgguuaugagacguuuaaagucauuggcggguggucaaagcccaauaguaaacugcagaucaaccgucaggugauuguagaccggggaaaucgcuccggcuacagcgguauauucucuguugaagggaagucaugcaucaacagauguuuuuauguggagcuaauuaggggccggaaacaggaaaccgaggucugguggacaaguaauagcaucguggucuucugcggaacuuccggcaccuacgggacaggaucuuggccugauggugcggacaucaaccucaugccaauuuga

SEQ ID NO: 144601 - RNA, 1410 nt, Artificial Sequence
  derived and/or modified sequence opt3 from neuraminidase__InfluenzaA__AFM72189
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucggcuccuggaguaaaaagauccuccggacgcaggaaucagagugcguuuguauuaacggcacuugcacaguggucaugaccgacgggagcgcaucuggacgcgccgauacuaaaauauuauuuaucgaggaagguaagauugugcacaucuccccucugcuuggcucagcucaacauguggaggaaugcagcuguuauccaagauacccgggggucaggugcguuugucgggacaauuggaagggaaguaaccgccccauaguggauauuaacguaaaagacuacucuaucguguccagcuaugucugcucgggcuuggugggugacacaccucgaaagaaugauucuuccucaaguagccacugucugaacccaaauaacgaggaagggggacauggcguuaaaggcugggccuucgacgauggggacgauguguggaugggaagaaccaucuccgagaagcuaaggucugguuacgagacguuuaaagucauugaaggcuggagcaagcccaauucaaaacuccagaucaaccgucaggugauuguagaccgggggaaucgcaguggauauuccggcauauucagcguugaggguaagucuugcaucaacagauguuuuuacguggaacugauuagggggcggaagcaggagaccgaagucugguggacaucaaauaguaucguggucuucugcggcacuagcggaaccuauggcacaggguccuggccugauggagcggacaucaaccuuaugccaauuuga

SEQ ID NO: 144602 - RNA, 1410 nt, Artificial Sequence; identical to SEQ ID NO: 144601
  derived and/or modified sequence opt3 from neuraminidase__InfluenzaA__AFM72200

SEQ ID NO: 144603 - RNA, 1410 nt, Artificial Sequence; identical to SEQ ID NO: 137765
  derived and/or modified sequence opt3 from neuraminidase__InfluenzaA__AFM72211

SEQ ID NO: 144604 - RNA, 1410 nt, Artificial Sequence; identical to SEQ ID NO: 137765
  derived and/or modified sequence opt3 from neuraminidase__InfluenzaA__AFM72222

SEQ ID NO: 144605 - RNA, 1413 nt, Artificial Sequence; identical to SEQ ID NO: 138469
  derived and/or modified sequence opt3 from neuraminidase__InfluenzaA__AFM72233

SEQ ID NO: 144606 - RNA, 1410 nt, Artificial Sequence; identical to SEQ ID NO: 136589
  derived and/or modified sequence opt3 from neuraminidase__InfluenzaA__AFM72249

SEQ ID NO: 144607 - RNA, 1410 nt, Artificial Sequence; identical to SEQ ID NO: 136077
  derived and/or modified sequence opt3 from neuraminidase__InfluenzaA__AFM72260

SEQ ID NO: 144608 - RNA, 1410 nt, Artificial Sequence; identical to SEQ ID NO: 136077
  derived and/or modified sequence opt3 from neuraminidase__InfluenzaA__AFM72271

SEQ ID NO: 144609 - RNA, 1410 nt, Artificial Sequence
  derived and/or modified sequence opt3 from neuraminidase__InfluenzaA__AFM72293
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacuauaccgugcacgaccgaacaccauaccguacucuucugaugaaugaauugggcguucccuuucaucucgguaccaaacagguguguaucgccuggucaagcaguuccugccacgaugggaaggcauggcugcaugucugugugacaggagacgaugagaacgccaccgcuucuuucauuuauaauggcagacugguagacagcaucggcuccuggucaaagaaaauccucaggacgcaggaaagugagugcguuuguauuaacgggacuugcacaguggucaugaccgauggaagcgcaucugguaaggccgacacuaaaauauuauuuaucgaggaaggcaagauugugcacacauccucacugagcgggagugcucaacacguggaggaaugcucuuguuacccucgguacccaggaguccgcugcguuuguagagauaacuggaagggcuccaauaggccgaucguggacauaaacguaaaagauuauagcauugugucgucuuacgucugcuccggucuugugggggacacgccccggaagaaugacucaaguagcuccucucauuguuuggauccuaacaaugaggaaggaggccacggcguuaaagggugggccuucgacgauggaaacgacguguggaugggucgcaccaucagcgagaagcugcgaucaggcuaugagaccuuuaaagucaucgaaggguggaguaagccaaauuccaaacuacagauuaacagacaggugaucguagauaggggaaaucggagcggcuacucugguauuuucucaguugaggggaagaguugcauaaaccguuguuuuuauguggaacucauccgcggcagaaagcaggagacagaaguccuguggacuagcaauuccauuguggucuucugcggaaccucuggcacauacgggacuggaucguggcccgacggugcggauaucaaccuuaugccuaucuga

SEQ ID NO: 144610 - RNA, 1410 nt, Artificial Sequence; identical to SEQ ID NO: 137945
  derived and/or modified sequence opt3 from neuraminidase__InfluenzaA__AFM72304

SEQ ID NO: 144611 - RNA, 1410 nt, Artificial Sequence
  derived and/or modified sequence opt3 from neuraminidase__InfluenzaA__AFM72315
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacgagaacgcaaccgccagcuucaucuacaauggaagacugguagauuccaucguuucauggaguaagaaaauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugagaaaggugggcacggaguuaagggcugggcuuucgaugacggcaacgauguguggauggggcgcaccauuagcgaaaaauugcgaucaggauacgagacauuuaaggucaucgaggguuggaguaauccaaacuccaaacugcagauuaauagacaggugauaguagacagggauaaccggagcggcuauucugggaucuucucaguugaaggaaagaguuguauuaaucguugcuuuuacguggagcuaauccgcggcagaaaccaggaaacugagguccucuggaccagcaauuccaucguggucuucugugguacaucugggacuuauggcaccggaucguggcccgacggcgccgauauuaaccugaugccuauauga

SEQ ID NO: 144612 - RNA, 1410 nt, Artificial Sequence
  derived and/or modified sequence opt3 from neuraminidase__InfluenzaA__AFM72326
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacgagaacgcaaccgccagcuucaucuacaauggaagacugguagauuccaucguuucauggaguaagaaaauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccaaacuccaaguuccagauuaauagacaggugauaguagacagggauaaccggagcggcuauucugggaucuuuucaguugagggaaaaaguuguauuaaucguugcuucuacguggaacugauccgcggcagaaaccaggagacugaaguccuauggaccagcaauuccaucguggucuucugugguacaucugggacuuauggcaccggaucguggcccgacggcgccgauauuaaccucaugccuauauga

SEQ ID NO: 144613 - RNA, 1410 nt, Artificial Sequence
  derived and/or modified sequence opt3 from neuraminidase__InfluenzaA__AFM72337
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaauggcacuuguacagucgugaugaccgauggcucugcuuccgggaaggcagacacuaaaauccucuuuauugaggaaggaaagaucgugcauacaucaaccuuaagcgguagugcccaacacgucgaggaaugcucuugcuauccucgcuacccaggcguuagaugugugugcagggauaacuggaagggguccaaccggccgauaguagacauuaauaucaaagaccacagcaucgugucgucuuacgucuguuccggacuggugggcgauacgccccgcaagaacgacucaaguagcuccucucauugccuugauccuaauaacgaggaaggugggcacggaguuaaaggcugggcuuucgacgauggcaaugacguguggauggggcgaaccauuaacgagacaagcagauugggauaugagacuuuuaaggucaucgaagguuggucaaauccaaaaaguaagcugcagauuaacaggcaagugauaguagaucggggcaaucguuccggguacagcggaaucuucucuguugagggcaaaucauguauuaaccgcugcuuuuauguggaacuaaucagagguaggaaggaggaaaccgagguccucuggacaaguaauagcaucguggucuucugugggacuuccggcaccuacggaacaggcucuuggcccgacggggccgaucugaaccuuaugccuauuuga

SEQ ID NO: 144614 - RNA, 1410 nt, Artificial Sequence
  derived and/or modified sequence opt3 from neuraminidase__InfluenzaA__AFM72348
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcauccccuuucaccucgguaccagacagguuuguauugccuggucaagcaguuccugccaugacgggaaggcauggcugcacgugugugucacaggagaugacaaaaacgccaccgcuucuuucaucuauaauggcaggcugguggauagcaucggcuccuggucaaagaaaauucuccggacgcaggagagugaaugcguauguauaaacgggacuugcacaguugugaugaccgacggaagcgcaucugguaaggccgauacuaaaaucuuauuuauugaggagggcaagaucguccacauauccacacugucagggagcgcucaacauguggaagagugcaguuguuacccucgcuauccaggagugagaugcgucuguagggacaacuggaagggcucuaaucggccgauuguugauaucaacgugaaagacuacuccaucguaagcucguacgugugcucuggucuugucggggacacuccccgcaagaaugauuccucaaguagcucccacuguuuggacccuaacaaugaagagggaggccauggcgugaaagggugggccuucgaugacggaaacgauguuuggaugggucgaacgauuucugaaaagcugagaagcggcuaugagaccuuuaaagugaucgagggguggucaaagccaaauaguaaacuacagauuaacaggcaggucauaguggaacggggaaaucguuccggcuacagcgguaucuucucuguagaggggaagucaugcauuaaccgcuguuuuuauguugaacucaucagaggcaggaaggaggaaacagaggugugguggaccaguaauagcaucgucguguucugcggaaccuccggcacauacgggacuggaucuuggcccgacggugcggauauuaaccugaugccuauauga

SEQ ID NO: 144615 - RNA, 1410 nt, Artificial Sequence
  derived and/or modified sequence opt3 from neuraminidase__InfluenzaA__AFM72359
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuuuauugaggagggaaagaucgugcacacaucaaccuuaagcgguagugcccaacacgucgaagagugcucuugcuauccucgguacccaggcguucgcugugugugcagagauaacuggaaaggguccaacaggccgauaguagacauuaauaucaaggacuacagcaucgugucgucuuaugucuguuccggacuggugggcgauacgccccggaaaaacgacucaaguagcuccucucauugccuugauccuaauaacgaagagggugggcacggaguuaagggcugggcuuucgacgauggcaaugacguguggauggggcgcaccauuagcgaaaaauugcgaucaggauacgagacauuuaaggucaucgaggguuggaguaacccaaauuccaaacugcagauuaacagacaggugauaguagauaggggcaaucggagcggguauucuggaaucuucucaguugaaggcaagaguuguauuaaccguugcuuuuacguggagcuaauccgcgguagaaaggaagagacuaaaguccucuggaccagcaauuccaucguggucuucugugggacaucuggcacuuauggaaccggcucguggcccgacggggccgauauuaaccugaugccuauauga

SEQ ID NO: 144616 - RNA, 1410 nt, Artificial Sequence; identical to SEQ ID NO: 144615
  derived and/or modified sequence opt3 from neuraminidase__InfluenzaA__AFM72370

SEQ ID NO: 144617 - RNA, 1410 nt, Artificial Sequence; identical to SEQ ID NO: 141534
  derived and/or modified sequence opt3 from neuraminidase__InfluenzaA__AFM72381

SEQ ID NO: 144618 - RNA, 1410 nt, Artificial Sequence; identical to SEQ ID NO: 141534
  derived and/or modified sequence opt3 from neuraminidase__InfluenzaA__AFM72392

SEQ ID NO: 144619 - RNA, 1410 nt, Artificial Sequence; identical to SEQ ID NO: 138418
  derived and/or modified sequence opt3 from neuraminidase__InfluenzaA__AFM72403

SEQ ID NO: 144620 - RNA, 1410 nt, Artificial Sequence; identical to SEQ ID NO: 138418
  derived and/or modified sequence opt3 from neuraminidase__InfluenzaA__AFM72414

SEQ ID NO: 144621 - RNA, 1410 nt, Artificial Sequence; identical to SEQ ID NO: 138082
  derived and/or modified sequence opt3 from neuraminidase__InfluenzaA__AFM72425

SEQ ID NO: 144622 - RNA, 1410 nt, Artificial Sequence; identical to SEQ ID NO: 138082
  derived and/or modified sequence opt3 from neuraminidase__InfluenzaA__AFM72436

SEQ ID NO: 144623 - RNA, 1410 nt, Artificial Sequence; identical to SEQ ID NO: 138082
  derived and/or modified sequence opt3 from neuraminidase__InfluenzaA__AFM72447

SEQ ID NO: 144624 - RNA, 1410 nt, Artificial Sequence; identical to SEQ ID NO: 138082
  derived and/or modified sequence opt3 from neuraminidase__InfluenzaA__AFM72458

SEQ ID NO: 144625 - RNA, 1410 nt, Artificial Sequence; identical to SEQ ID NO: 138082
  derived and/or modified sequence opt3 from neuraminidase__InfluenzaA__AFM72469

SEQ ID NO: 144626 - RNA, 1410 nt, Artificial Sequence
  derived and/or modified sequence opt3 from neuraminidase__InfluenzaA__AFM72491
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugaugugugaaccgacuauaaucgagagaaauauuaccgaaaucguguaucugacaaacaccacuauugagaaggaaaucugccccaaauuggcugaguacaggaauuggaguaagccucagugugacauaacaggguucgcaccauuuagcaaagauaacuccauucgguuaucugccggaggugacaucuggguaacccgcgagcccuaugugucgugcgauccugacaaguguuaccaauucgcgcugggccaggggacgacucuaaauaacguccauucaaaugauaccgugcgagaccguacaccauauagaacucuccugaugaacgaacuuggaguucccuuucaccugggcaccaaacaggugugcauugcuuggagcaguuccucuugucaugaugguaaggccugguugcacgucugcaucacaggggacgauaagaaugcaaccgccagcuucaucuacaacggaaggcucguggacuccauuguaucauggaguaaagagauacugcggacgcaggaaagcgaguguguuugcaucaauggcacuuguacaguggucaugaccgauggcucugcuuccgggaaggcagacacuaaaauucuguuuaucgaggaaggaaagauagugcauacaucaacccucagcgguagugcccaacacguggaggaaugcucuugcuauccucgcuacccaggcgucagauguguuugcagggauaacuggaagggguccaaccggccgauuguggacaucaauaucaaagaccacagcauuguaucgucuuacguguguuccggauuagucggcgauacgccccgcaagaacgacucaaguagcuccucucauugccuggauccuaauaacgaggaaggugggcacggagugaaaggcugggcuuucgacgauggcaaugacguuuggauggggcgaaccaucagcgagaagucaagacuuggauaugagacauuuaaagugauugaagguuggaguaacccaaauuccaaguugcagauaaacaggcaggucaucguggaucggggcaaucguagcggguacucuggaauuuucucaguagagggcaaaaguuguaucaaccgcugcuuuuauguugaacugaucagagguaggaaggaggaaacugaggugcuauggaccagcaauuccauugucguguucugugggacaucuggcacuuacggaaccggcucguggcccgacggggccgauauaaaccucaugccuaucuga

SEQ ID NO: 144627 - RNA, 1410 nt, Artificial Sequence; identical to SEQ ID NO: 144626
  derived and/or modified sequence opt3 from neuraminidase__InfluenzaA__AFM72502

SEQ ID NO: 144628 - RNA, 1413 nt, Artificial Sequence; identical to SEQ ID NO: 138648
  derived and/or modified sequence opt3 from neuraminidase__InfluenzaA__AFM72513

SEQ ID NO: 144629 - RNA, 1413 nt, Artificial Sequence; identical to SEQ ID NO: 138648
  derived and/or modified sequence opt3 from neuraminidase__InfluenzaA__AFM72524

SEQ ID NO: 144630 - RNA, 1413 nt, Artificial Sequence; identical to SEQ ID NO: 138648
  derived and/or modified sequence opt3 from neuraminidase__InfluenzaA__AFM72535

SEQ ID NO: 144631 - RNA, 1413 nt, Artificial Sequence; identical to SEQ ID NO: 138648
  derived and/or modified sequence opt3 from neuraminidase__InfluenzaA__AFM72546

SEQ ID NO: 144632 - RNA, 1413 nt, Artificial Sequence; identical to SEQ ID NO: 138648
  derived and/or modified sequence opt3 from neuraminidase__InfluenzaA__AFM72557

SEQ ID NO: 144633 - RNA, 1410 nt, Artificial Sequence
  derived and/or modified sequence opt3 from neuraminidase__InfluenzaA__AFM72579
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaaugauacagugcacgaccgaacuccauaucguacccugcuuaugaacgaacugggaguucccuuucauuugggcacaaaacaggugugcaucgcuuggagcaguuccucuugucacgaugguaaggccuggcuccaugucugcauuaccggggacgauaagaaugcaacggccagcuucaucuacaacggaagacugguggacuccaucguaucauggaguaaagagauucugaggacucaggaaagcgaguguguuugcauaaauggcacauguaccguggucaugacugauggcucugcuuccgggaaggcagacacaaaaauccucuuuauugaggaaggaaagaucgugcacaccucaauauuaagcgguagugcccaacacguggaggaaugcucuugcuauccucgguacccaggcguccgcuguguuugcagagauaacuggaagggguccaacaggccgauuguggacaucaauaucaaagaccauagcauuguaucgucuuacguguguuccggacuggucggcgauacgccccggaagaacgacucaaguagcuccucucacugccuugauccuaauaacgaggaaggugggcauggagugaaaggcugggcuuucgacgauggcaaugacguuuggauggggcgcaccaucagcgagaagucacgauugggauaugagacauuuaaagugauugaagguuggaguaacccaaaguccaaacugcagauaaauagacaggucaucguggauaggggcaaccggagcggguacucuggaauuuucucaguagagggcaagaguuguaucaaucguugcuuuuauguugaacuaauccgcgguagaaaggaggaaacugaggugcucuggaccagcaacuccauugucguguucugugggacaucuggcacuuacggaaccggcucguggcccgacggggccgauauaaaucugaugccuaucuga

SEQ ID NO: 144634 - RNA, 1413 nt, Artificial Sequence
  derived and/or modified sequence opt3 from neuraminidase__InfluenzaA__AFM72802
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaugugcaaccagagaaucauaacguacgaaaauucuaccugggugaaccacacauaugucaauauuaacaauacuaacguuguggcagggaaagacaagaccccuguaacacuugccggaaauucgucacuguguagcaucaguggcugggcgauucauaccaaagauaacuccaucaggaucgguucuaagggggacguguucgucauucgggagccauuuauaagcugcucccacuuggaguguaaaacuuucuuuuuaacacaaggagcucugcuaaaugauaagcauucaaacggcaccgugaaggaccgcaguccguaccgagcccucaugagcugcccccugggcgaagcaccuucuccauauaauuccaaauucgagucaguugccuggagcgcuagugcaugucacgaugggaucggauggcuuacgauugguaucucuggccccgacaacggggccguggcuguccugaaguacaacggaauaauuacuggcaccaucaaauccuggaagaaacagaucuugcguacacaggaaagcgagugcguguguaugaaugguucgugcuuuacuauuaugaccgaugggccuucuaacggagccgcguccuauaagaucuucaagauugagaaaggcaagguaauaaaaucaauggaacucaaugcaccaaacuuucacuacgaggaauguaguugcuaucccgacacaggcaccguuaugugugugugcagagauaauuggcaugggagcaacaggccuugggucuccuucaaucagaaccuggacuaccaaaucggauacauuugcucugguguguuuggcgauaauccacggccggaggacggggagggaagcuguaaccccgugacggucgauggcgccaaugguguuaagggguucucauauaaauacggcaacggaguguggaucggccgcacuaagaguaauagaaucaggaaaggguuugaaaugauuugggacccuaacggauggacaaauaccgacuccgauuucagcguaaagcaggacauaguggcuaucacugauuggucugguuauucaggcaguuuuguccagcacccagagcugacagggcucgacugcauucggcccuguuucuggguggaauuaguucgcggacugccucgagagaacaccacgaucuggaccagcggcuccucuauuucguucugcggugugaacagcgauaucgccaauugguccuggccagacggggcagaacuucccuuuacaauagauaaguga

SEQ ID NO: 144635 - RNA, 1413 nt, Artificial Sequence; identical to SEQ ID NO: 144634
  derived and/or modified sequence opt3 from neuraminidase__InfluenzaA__AFM72813

SEQ ID NO: 144636 - RNA, 1413 nt, Artificial Sequence; identical to SEQ ID NO: 144634
  derived and/or modified sequence opt3 from neuraminidase__InfluenzaA__AFM72824

SEQ ID NO: 144637 - RNA, 1410 nt, Artificial Sequence; identical to SEQ ID NO: 138744
  derived and/or modified sequence opt3 from neuraminidase__InfluenzaA__AFM72835

SEQ ID NO: 144638 - RNA, 1410 nt, Artificial Sequence; identical to SEQ ID NO: 138744
  derived and/or modified sequence opt3 from neuraminidase__InfluenzaA__AFM72845

SEQ ID NO: 144639 - RNA, 1410 nt, Artificial Sequence; identical to SEQ ID NO: 138744
  derived and/or modified sequence opt3 from neuraminidase__InfluenzaA__AFM72855

SEQ ID NO: 144640 - RNA, 1410 nt, Artificial Sequence; identical to SEQ ID NO: 138744
  derived and/or modified sequence opt3 from neuraminidase__InfluenzaA__AFM72865

SEQ ID NO: 144641 - RNA, 1410 nt, Artificial Sequence
  derived and/or modified sequence opt3 from neuraminidase__InfluenzaA__AFM72875
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagucagauaguagcuccucuagccauugccuugacccuaauaacgaggaaggugggcacggaguuaaaggcugggcuuucgaugacggcaaugauguguggauggggcgaaccauuucagagaagaguagauugggauaugagacauuuaaagucaucgaagguugguccaacccaaagagcaaacugcagauuaauaggcaagugauaguagaccggggcaaccguucuggguacucaggaaucuucaguguugagggcaagagcuguauuaaucgcugcuuuuauguggaacuaaucagagguaggaaggaggaaacugagguccucuggaccuccaacucuaucguggucuucugugggacaucgggcacuuacggaaccggcagcuggcccgauggggccgacauuaaucugaugccuguguga

SEQ ID NO: 144642 - RNA, 1410 nt, Artificial Sequence; identical to SEQ ID NO: 138615
  derived and/or modified sequence opt3 from neuraminidase__InfluenzaA__AFM72886

SEQ ID NO: 144643 - RNA, 1410 nt, Artificial Sequence; identical to SEQ ID NO: 138615
  derived and/or modified sequence opt3 from neuraminidase__InfluenzaA__AFM72897

SEQ ID NO: 144644 - RNA, 1410 nt, Artificial Sequence
  derived and/or modified sequence opt3 from neuraminidase__InfluenzaA__AFM72908
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacacgaaagaccacagcaucgugucgucuuacgucuguuccggacuggugggcgacacccccaggaagaaugauucaaguagcuccucucauugccuugacccuaacaaugaggaaggugggcacggaguuaaaggcugggcuuucgaugacggcaacgauguguggauggggcgaacaaucagcgagaagucaagauugggauaugagacuuuuaaagucauugaagguuggaguaauccaaaguccaaacugcagaucaaccgccaggugauuguagaccggggcaaucguagcggguacucuggaauauucucaguugagggcaagaguuguaucaaccgcugcuuuuauguggaacuaauuagagguaggaaggaggaaaccgagguccucuggacaagcaauuccaucguggucuucugugggacuucuggcaccuacggaacaggcucguggcccgauggggccgacaucaaccugaugccuguguga

SEQ ID NO: 144645 - RNA, 1410 nt, Artificial Sequence
  derived and/or modified sequence opt3 from neuraminidase__InfluenzaA__AFM72919
augaaccccaaucagaagaucauuaccauaggcagcgugucccugacaaucucuacuauuugcuucuuuaugcaaaucgccauucucaucacgaccgucacacuucacuucaaacagcaugaguuuaacucaccuccaaauaaccagguuaugcugugugaaccgacuauaaucgagagaaauauuaccgaaaucguguacuugacaaacaccacuauugagaaggaaaucugccccaaauuagcugaguauaggaauuggaguaagccucagugugacauaacaggguucgcaccauuuagcaaagauaacuccauucggcugucugccggaggugacaucuggguaacccgcgagcccuacgugucgugcgauccugacaaguguuaucaauucgcgcuaggccaggggacgacucucaauaacguccacucaaauaacaccgugcgagaucguacaccauacagaacucugcuuaugaaugaacugggaguucccuuucauuugggcaccaaacaggugugcauugcuuggagcaguuccucuugucacgacgguaaggccuggcuccaugucugcaucacaggggaugacaagaacgcaaccgccagcuucaucuauaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuacccucgcuauccaggcguuagaugugugugcagggacaacuggaagggguccaaucggccgauaguagauauuaacacgaaagaccauagcaucgugucgucuuacgucuguuccggacuggugggcgacacccccaggaagaaugauucaaguagcuccucucacugccuugacccuaacaaugaggaaggugggcauggaguuaaaggcugggcuuucgaugacggcaacgauguguggauggggcgaacaaucagcgagaagucaagauugggauacgagacuuuuaaagucauugaagguuggaguaauccaaaguccaaacugcagaucaaccgccaggugauuguagaccggggcaaucguagcggguauucuggaauauucucaguugagggcaagaguuguaucaaccgcugcuuuuacguggaacuaauuagagguaggaaggaggaaaccgagguccucuggacaagcaauuccaucguggucuucugugggacuucuggcaccuauggaacaggcucguggcccgauggggccgacaucaaccugaugccuguguga

SEQ ID NO: 144646 - RNA, 1410 nt, Artificial Sequence; identical to SEQ ID NO: 139921
  derived and/or modified sequence opt3 from neuraminidase__InfluenzaA__AFM72930

SEQ ID NO: 144647 - RNA, 1410 nt, Artificial Sequence; identical to SEQ ID NO: 139921
  derived and/or modified sequence opt3 from neuraminidase__InfluenzaA__AFM72941

SEQ ID NO: 144648 - RNA, 1410 nt, Artificial Sequence; identical to SEQ ID NO: 139921
  derived and/or modified sequence opt3 from neuraminidase__InfluenzaA__AFM72952

SEQ ID NO: 144649 - RNA, 1410 nt, Artificial Sequence; identical to SEQ ID NO: 139921
  derived and/or modified sequence opt3 from neuraminidase__InfluenzaA__AFM72963

SEQ ID NO: 144650 - RNA, 1410 nt, Artificial Sequence; identical to SEQ ID NO: 139921
  derived and/or modified sequence opt3 from neuraminidase__InfluenzaA__AFM72974

SEQ ID NO: 144651 - RNA, 1410 nt, Artificial Sequence; identical to SEQ ID NO: 141534
  derived and/or modified sequence opt3 from neuraminidase__InfluenzaA__AFM72985

SEQ ID NO: 144652 - RNA, 1410 nt, Artificial Sequence; identical to SEQ ID NO: 141534
  derived and/or modified sequence opt3 from neuraminidase__InfluenzaA__AFM72996

SEQ ID NO: 144653 - RNA, 1410 nt, Artificial Sequence; identical to SEQ ID NO: 141534
  derived and/or modified sequence opt3 from neuraminidase__InfluenzaA__AFM73007

SEQ ID NO: 144654 - RNA, 1410 nt, Artificial Sequence
  derived and/or modified sequence opt3 from neuraminidase__InfluenzaA__AFM73018
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacucauccuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcaucuggauuggucggacaaaaaguauaagcucccgcaagggguucgagaugaucugggauccaaacggcuggaccggaacggacaauaacuuuucuauuaaacaagacaucguaggcauuaaugaauggucgggguacagcggauccuucgugcagcaucccgagcugacuggucuggauuguauccgaccuugcuucugggucgaacucauaagaggcaggccaaaggagaacacaaucuggaccucagggaguucuauuagcuuuuguggagugaauagcgacacuguuggcuggucauggcccgauggugcagaguuaccguucacaaucgacaaauga

SEQ ID NO: 144655 - RNA, 1410 nt, Artificial Sequence; identical to SEQ ID NO: 144654
  derived and/or modified sequence opt3 from neuraminidase__InfluenzaA__AFM73028

SEQ ID NO: 144656 - RNA, 1410 nt, Artificial Sequence; identical to SEQ ID NO: 144654
  derived and/or modified sequence opt3 from neuraminidase__InfluenzaA__AFM73038

SEQ ID NO: 144657 - RNA, 1410 nt, Artificial Sequence; identical to SEQ ID NO: 140489
  derived and/or modified sequence opt3 from neuraminidase__InfluenzaA__AFM73048

SEQ ID NO: 144658 - RNA, 1410 nt, Artificial Sequence
  derived and/or modified sequence opt3 from neuraminidase__InfluenzaA__AFM73058
augaaccccaaucagaagaucauuaccauaggcagcuucugcaugacaaucgggcuggccaaccucauucuucaaaucggaaauauuaucuccauauggaucucucacucaauucagcuggguaaccagaaucagaucgagacuuguaaccaaagugugauuacguacgaaaauaacaccugggucaaucagacauauguuaacaucagcaauacuaacuuugcugcaggccaguccgugguaucugugaaauuggccggaaauucgucauuaugcccugucagcggaugggcgauauacaguaaggacaacuccgugagaauuggcucuaaaggugauguuuucgugaucagggagccauuuauuagcuguuccccgcuggaaugccggaccuucuuucuaacacagggggcucuccugaaugacaagcauucaaacggaaccaucaaagaucgcagucccuaucgaacucuuaugagcuguccuaucggcgaggucccaucucccuacaacucccguuucgaaucaguggccuggagcgcaagugccugccacgacggcauuaauuggcugacaauagggaucucuggaccugauaacggugcuguagcaguuuugaaguauaauggcauuaucaccgacacgauaaaguccuggagaaacaauauucucaggacucaagagagcgagugugccugcgugaacgggucguguuuuaccgucaugacagauggaccaucugacggccaggcuuccuacaaaaucuuccggaucgaaaaggguaaaauugugaagucaguggagaugaaugcccccaacuaucauuacgaagagugcaguuguuacccugauagcuccgagaucacuugcgucugccgcgacaauuggcacgggucuaacagaccauggguuagcuuuaaucagaaccuggaauauaggauuggauacauauguucaggcaucuucggcgauaauccgcggcccaacgacaaaaccgggaguugcggaccuguguccagcaauggugcgaacggcguaaagggguuuucuuucaaguauggaaacggcguguggauuggucgcacaaaaucaaucaguagccgaaauggguuugagaugaucugggauccaaacggcuggaccggaacggacaagaauuucuccauuaaacaggacauagucggcaucaacgaauggucuggguacucggggagcuucgugcaacaucccgagcugacuggucucgauuguauuagaccuugcuuuuggguugaauuaaucaggggccggccaaaggagaauacaauuuggaccuccgggucaaguaucucuuucuguggagugaacagcgacacugucggcugguccuggcccgauggugcagagcugccguuuacaauagacaaauga

SEQ ID NO: 144659 - RNA, 1410 nt, Artificial Sequence; identical to SEQ ID NO: 140489
  derived and/or modified sequence opt3 from neuraminidase__InfluenzaA__AFM73068

SEQ ID NO: 144660 - RNA, 1413 nt, Artificial Sequence; identical to SEQ ID NO: 136967
  derived and/or modified sequence opt3 from neuraminidase__InfluenzaA__AFM73480

SEQ ID NO: 144661 - RNA, 1350 nt, Artificial Sequence
  derived and/or modified sequence opt3 from neuraminidase__InfluenzaA__AFM78569
augaaccccaaucagaagaucauuaccauaggcagcaucugcauggugauugggaucgucucccugaugcuccaaauuggaaacaugaucucuauauggguuauccacucaauucagacagguaaucagcaucaggccgagaguaucagcaacacuaauccucuuacggaaaaagcuguggcauccguaacccuggccggcaacucuucguuguguccaauuagagggugggcggugcacucaaaggacaauaacaucaggauaggaagcaaaggcgaugucuucgugauucgggagccguuuaucaguugcucccauuuagaaugucgcacauucuuucugacucaaggugcucuacucaaugacaagcacucuaacgggaccguuaaagaucgaagcccccaucguacacugauguccugcccugugggagaggccccaucacccuacaauaguagauucgaaagcgucgcauggucugccuccgcuugucacgacggcaccucauggcuuacuauuggcaucagcgggccugauaacgaggcaguggccguacugaaguauaauggaaucauuacagacaccauaaagaguuggaggaacgauaucuugcggacgcaggagucugaaugcgcuuguguuaaugguuccugcuuuacugugaugaccgacggcccaagcaacgggcaggccucguacaaaauuuucaagauggagaaaggaaaggucgugaaaucuguggaacucgaugcgcccaacuaucacuacgaggaguguuccugcuauccugacgcaggcgaaaucacaugugucugccgcgauaauuggcaugguucaaacagaccauggguuaguuuuaaucagaaccuggaguaccaaauaggguauauuugcagcggaguguucggcgacaauccgaggcccaacgauggcacuggguccuguggaccuaugucuccaaauggugccuacggcguaaagggguuuagcuucaaguacggaaacggcguguggaucggucggaccaaaucaacaaauagucgcuccggguuugaaaugaucugggaccccaacggcuggaccggaacggacagcucuuucucagucaagcaggauauuguggcuaucacugacuggaguggcuauagcggguccuuuguucagcacccugagcugacaggacucgauugcauucgaccauguuucuggguggaauuaauaagagguaggcccaaagagucuaccaucuggacuucgggcagcuccauuucauucugcggggucaauagugacacagugucuuggagcuggccggauggagccgagcugccuuuuaccaucgacaaguga

SEQ ID NO: 144662 - RNA, 1410 nt, Artificial Sequence
  derived and/or modified sequence opt3 from neuraminidase__InfluenzaA__AFM85180
augaaccccaaucagaagaucauuaccauaggcagcgugucccugacaaucgccacuauuugcuuccucacgcaaaucgcuauucuugucaccacaguuacucugcacuuuaaacaguacgaguguaacucuucaccuaauaaccaggugauguugugcgaaccaaccaucauagagagaaauaucacagaaauuguauauuuaaccaacacuacaaucgagaaggaaauuuguccgaaacuggcagaguacaggaauuggaguaagccccagugcaacaucaccggguucgccccuuuuagcaaagacaauuccauacggcuaucugcgggaggugauauuugggugacgcgcgagccauaugucucguguggccccgacaagugcuaccaauucgcucucgggcagggaacuacccugaacaauggccauucaaacgauacagugcacgaccgaacuccuuaucguacccuucugaugaaugaauuggguguuccauuucaucucgggacaaaacagguguguaucgccuggagcaguuccucuugccacgauggaaaggcauggcugcaugucugugugaccggcgacgauaagaacgccacggcuagcuucauuuacaauggcagacugguagacuccaucgggucauggaguaaaaagauccucaggacucaggagagcgaaugcguuuguauuaacggaacaugcaccguggucaugacugaugguucugcauccggcaaagccgacacaaagauauuauuuaucgaggaggggaagauugugcacaccucacugcuuagcggaagugcucaacacguggaagagugcucuuguuauccccgguacccuggcguccgcugcguuuguagagauaacuggaaagguuccaauaggccaaucguggacauaaacguaaaggauuacagcauugugucgucuuaugucugcuccggguuggugggagacacgccgcggaaaaaugacucaaguagcuccucucauugucuggaucccaacaaugaagagggcggccacgggguuaagggaugggccuucgacgaugguaacgacguguggaugggccgcaccaucagcgaaaaacuacgaucaggguacgagacauuuaaggucaucgagggauggaguaaaccuaauuccaagcuccagauuaacagacaggugaucguagauaggggcaaucggagcgguuauucugggauuuucucaguugaaggcaagaguugcauaaaccguuguuuuuacguggagcugauccgcggaagaaaucaggaaacugagguccuuuggaccagcaacuccauuguggucuucugcggcacaucugggacuuauggaaccgguucguggccagacggcgcggauaucaaucugaugcccaucuga

SEQ ID NO: 144663 - RNA, 1410 nt, Artificial Sequence; identical to SEQ ID NO: 136119
  derived and/or modified sequence opt3 from neuraminidase__InfluenzaA__AFN11830

SEQ ID NO: 144664 - RNA, 1410 nt, Artificial Sequence
  derived and/or modified sequence opt3 from neuraminidase__InfluenzaA__AFN11831
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaccccacaucguacacugcuuaugaacgaacugggcguucccuuucacuuggguacuagacagguguguaucgccuggucaagcaguuccugccaugaugggaaggcauggcuccacgucugugugaccggauaugacaaaaaugccacagcuucuuucaucuacgauggcaggcugguagacagcauuggcuccuggucaaagaacauacugcggacccaggagagugaaugcguuuguaucaaugggacgugcacuguggucaugacagauggaagcgcaucuggucgcgccgacaccaaaauucucuuuaucgaggagggcaagauagugcacauuuccccuuuaucagggagcgcucaacauguggaagagugcaguuguuauccaagauacccgggagucaggugcguuugucgggauaacuggaagggcucuaaucgccccgugguagacaucaacgugaaagacuacuccaucgucagcucguaugugugcucuggucugguuggggauacuccucgaaacaaugacagauccucaaguagcuacuguaggaacccaaauaacgaaaagggaaaucacggcgugaaaggcugggccuucgaugacgggaacgaugucuggaugggacggacaauuuccgaggaaucucguagcgguuaugagaccuuuaaggugaucggcggguggucaacgcccaauaguaaacuucagauuaaccgccagguaauaguugacuccgauaauagaagcggauacucuggcaucuucucaguggaggguaagaguugcauuaacagguguuuuuaugucgaauugauccgggggcgagagcaggaaacccgcgugugguggacaagcaauuccaucgucguguucugcggcacuucuggaaccuacggcacagggucguggccugacggagcggauauuaaccugaugccaauauga

SEQ ID NO: 144665 - RNA, 1410 nt, Artificial Sequence; identical to SEQ ID NO: 136592
  derived and/or modified sequence opt3 from neuraminidase__InfluenzaA__AFN11833

SEQ ID NO: 144666 - RNA, 1410 nt, Artificial Sequence; identical to SEQ ID NO: 138527
  derived and/or modified sequence opt3 from neuraminidase__InfluenzaA__AFN11835

SEQ ID NO: 144667 - RNA, 1410 nt, Artificial Sequence
  derived and/or modified sequence opt3 from neuraminidase__InfluenzaA__AFN11836
augaaccccaaucagaagaucauuaccauaggcagcgugucccugacaaucgccacuaugugcuuccucaugcaaauugcuauccuugucacgaccguuacacugcacuuuaaacaguacgaguguucuucaccuccaaacaaucaggugaugccgugcgaacccacuauuaucgagagaaacauaaccgaaaucguauauuugacaaauaccacuauugagaaggaaaucuguccuaaauuaguggaguacaggaacuggaguaagccacagugcaaaauuacaggguucgcacccuuuagcaaggacaauuccauccggcugucugccggaggugauauaugggucacccgcgagccuuaugugucgugugacccaggcaagugcuaccaauucgcgcuagggcagggaacgacucucaacaaucgacauucaaacgauaccguucacgaccguacacccuauagaacucugcuuaugaaugaacugggcgugccuuuucauuuggguaccaaacaggucuguauugcuuggagcaguuccucuugccacgaugggaaggccuggcuccauguguguguaacaggacacgacaaaaacgcaaccgccagcuucaucuacgauggcaggcugguugacuccauuggcucauggaguaagaauauccugcggacgcaggagagcgaaugcguguguaucaacgggacuugcacagucgugaugaccgauggaucugcuuccgagcgcgcagacacuaaaauucucuuuauagaggaagguaagaucauucacaucucaccauuaagcggcagugcccaacauguggaggaaugcucuuguuauccgagauaccccggggucaggugcguuugucgggauaauuggaagggauccaaccgcccuauaguggacauuaacguaaaagauuacagcaucgugucgucuuaugucugcuccggccuggugggugacacaccacgaaagaaugacagaucaaguagcuccuacuguaggaaccccaauaacgagaaagggucucacggaguuaagggcugggcuuucgaugacggcaaugauguguggauggggcggaccaucggagaggaacuucguagcgguuaugagacguuuaaagucauuggcggguggucaaccccuaacaguaaguugcagaucaaucgccaggugauuguagacuccggaaacagaagcggcuacucugguauauucucaguugaagggaaaaguugcaucaauagguguuuuuauguggagcugauucggggccgagaacaggagacacgcgucugguggacuagcaacuccaucguggucuucugcggaaccucuggcacauacgggacuggaucguggccagauggugccgacaucaaucuaaugcccauuuga

SEQ ID NO: 144668 - RNA, 1410 nt, Artificial Sequence
  derived and/or modified sequence opt3 from neuraminidase__InfluenzaA__AFN11839
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugccagcccacuaucauagaaagaaacaucaccgagauuguauauuugacaaauaccacuaucgaaaaggagauuuguccuaaauuaguggaauacaggaacuggaguaagccacaaugcaaaaucacaggguucgcacccuuuagcaaggacaauuccauacggcugucugccggaggugauauuugggucacccgcgagccuuaugugucgugugacccaggcaagugcuaccaguucgcgcuagggcagggaacgacucucaacaaucgacauucaaacgauaccguucacgaccguacacccuauagaacucugcuuaugaaugagcugggcgugccuuuucauuuggguaccaaacaggucuguaucgcuuggagcaguuccucuugccacgaugggaaggccuggcuccauguguguguaacaggacacgacgaaaacgcaaccgccagcuucauuuacgauggcaggcugguugacuccaucggcucauggaguaaaaauauccugcggacgcaagagagcgaaugcguguguauuaacgggacuugcacagucgugaugaccgauggaucugcuuccgagcgcgcagacacuaagauacucuuuaucgaggaagguaaaauugugcacaucucaccauuaagcggcagugcccagcaugucgaggaaugcucuuguuauccgagauaccccgggguuaggugcgugugucgggauaauuggaagggauccaaccgcccuauaguagacauuaacaugaaggauuacagcaucgugucgucuuaugucugcuccggccuggugggugacacaccacgaaagaaugacucaaguagcuccucuuacuguagaaaccccaauaacgagaaagggagccacggaguuaaaggcugggcuuucgaugacggcaaugauguguggauggggaggaccaucucagaggaacuucggaguggauaugagacguuuaaggucauugguggcugguccaccccuaacagcaaauugcagaucaaucgucaggugauuguagacucugggaaccgcucaggauacaguggcauauucagcguugaagguaaguccugcaucaauagauguuuuuauguggagcugauuagggggcggaaacaagaaacaaaggucugguggacuucuaacucgaucguggucuucugcggcaccagcggaacauacggcacuggguccuggccagauggagccgacaucaaucuaaugcccauuuga

SEQ ID NO: 144669 - RNA, 1410 nt, Artificial Sequence
  derived and/or modified sequence opt3 from neuraminidase__InfluenzaA__AFN11840
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacauccuccggacgcaggaaagugagugcguuuguauuaaugggacuugcacaguggucaugaccgauggaagcgcaucugagcgcgccgacacuaagauauuauuuaucgaagaggguaaaauugugcacaucuccccucugucaggcagcgcucaacauguggaagagugcaguuguuauccaagauacccgggggucaggugcguuugucgggauaacuggaagggaucuaaccgccccauaguggacauuaauguaaaggauuacuccaucgugagcucguaugucugcucuggccuugugggugacacaccucgaaagaacgacuccucaaguagcuccuacuguagaaauccaaacaaugaaaaagggucucacggaguuaaaggcugggccuucgaugacggcaacgauguguggauggggaggaccaucggagaggaguugcggagcgguuaugaaacguuuaaggucauuggcggguggucaacccccaauaguaaacugcagaucaaccgucaggugauuguagaccgcggaaauagauccggcuacagcgguauauucucuguugaggggaagucaugcaucaacagguguuuuuauguggagcuaguccggggccgaaaacaggaaacagaagugugguggacuucaaauagcauugucguguucugcggaaccuccggcacauacgggacuggaucuuggccugauggugcggacaucaaccucaugccaaucuga

SEQ ID NO: 144670 - RNA, 1410 nt, Artificial Sequence; identical to SEQ ID NO: 137945
  derived and/or modified sequence opt3 from neuraminidase__InfluenzaA__AFN11841

SEQ ID NO: 144671 - RNA, 1410 nt, Artificial Sequence; identical to SEQ ID NO: 144033
  derived and/or modified sequence opt3 from neuraminidase__InfluenzaA__AFN11842

SEQ ID NO: 144672 - RNA, 1410 nt, Artificial Sequence
  derived and/or modified sequence opt3 from neuraminidase__InfluenzaA__AFN11844
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcgugacaggggaugacaagaacgcaaccgccagcuucaucuacaauggaaggcugguagauuccaucguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagacuacagcaucgugucgucuuaugucuguuccggacuggugggcgacacgccccgcaagaaugauucaaguagcuccucucacugccuugacccuaacaaugaggaaggugggcauggaguuaaaggcugggcuuucgaugacggcaacgauguguggauggggcgaaccauuagcgagaaguugagaucaggauacgagacauuuaaagucaucgaagguuggaguaauccaaacuccaagcugcagauuaauaggcaagugauaguagaccggggcaaccguagcggguauucuggaaucuucucaguugagggcaaaaguuguauuaaucgcugcuuuuacguggaacuaaucagagguaggaaggaggaaacugagguccucuggaccagcaacuccaucguggucuucugugggacaucuggcacuuauggaaccggcucguggcccgauggggccgacauuggacugaugccuauguga

SEQ ID NO: 144673 - RNA, 1410 nt, Artificial Sequence; identical to SEQ ID NO: 144592
  derived and/or modified sequence opt3 from neuraminidase__InfluenzaA__AFN11845

SEQ ID NO: 144674 - RNA, 1410 nt, Artificial Sequence; identical to SEQ ID NO: 144120
  derived and/or modified sequence opt3 from neuraminidase__InfluenzaA__AFN11847

SEQ ID NO: 144675 - RNA, 1410 nt, Artificial Sequence
  derived and/or modified sequence opt3 from neuraminidase__InfluenzaA__AFN11848
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacgagaacgcaaccgccagcuucaucuacaauggaagacugguagauuccaucguuucauggaguaagaaaauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugguccuaacaaugaggaagggggacacggcguuaaaggcugggcuuucgacgaugggaacgacguguggaugggacgcaccauuagcgagaaguugcgaucagguuacgagacauuuaaagucaucgaaggcuggaguaauccaaacuccaagcugcagauuaauagacaggugauaguagauagggggaaccggagcggauauucuggcaucuucucaguugaggguaaaaguuguauuaaucguugcuuuuacguggaacuaauccgcgggagaaagcaggagacugaaguccucuggaccagcaacuccaucguggucuucuguggcacaucuggaacuuauggcaccgggucguggcccgacggagccgauauuaaucugaugccuauauga

SEQ ID NO: 144676 - RNA, 1410 nt, Artificial Sequence
  derived and/or modified sequence opt3 from neuraminidase__InfluenzaA__AFN11850
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgaggacguacaccauauagaacucugcuuaugaaugaacugggcguucccuuucacuuggguaccaaacaggugugcauugcuuggagcaguuccucuugucaugaugggaaggccuggcuccacgucugcaucacaggagacgauaagaacgcaaccgccagcuucaucuacaauggcaggcugguggacuccguaguuucauggaguaaagagauucugcggacgcaggaaagcgagugugugugcauaaacggcacuuguacagucgugaugaccgaugggucugcuuccggaaaggcagacacuaaaauccucuuuauugaggaagguaagaucgugcauacaucaaccuuaagcggcagugcccaacacgucgaggaaugcucuugcuauccucgcuacccagggguuagaugugugugcagggauaacuggaagggauccaaucggccgauaguagacauuaacaucaaagaucacagcaucgugucgucuuacgucuguuccggccuggugggugacacgccccgcaagaaugacucaaguagcuccucucauugccuugauccuaacaaugaggaagggggacacggcguuaaaggcugggcuuucgacgaugggaacgacguguggaugggacgaaccauuagcgagaagucaagauuggguuaugagacauuuaaagucaucgaaggcuggaguaaucauaaguccaaacugcagauuaacaggcaagugauaguagaucgggggaaucguagcggauacucuggcaucuucucaguugaggguaagaguuguauuaaccgcugcuuuuauguggaacuaaucagagggaggaaggaggaaacugagguccucuggaccagcaauuccaucguggucuucuguggcacaucuggaacuuacggcaccgggucguggccagacggagccgaucugaaccuuaugcccauuuga

SEQ ID NO: 144677 - RNA, 1410 nt, Artificial Sequence
  derived and/or modified sequence opt3 from neuraminidase__InfluenzaA__AFN11851
augaaccccaaucagaagaucauuaccauaggcagcgugucccugacaaucgccacuauuugccuccuuaugcaaaucgcuauucuggucacgaccguuacauugcacuucaaacaguacgaguguaacucuccuccaaauaaccaggugauguuaugcgaaccgacuaucauagagagaaauaucaccaagauuguauaucugacaaacaccacuaucgaaaaagagauuugucccaagcuagcagaauacaggaauuggucaaaaccucagugcaagaucacaggguuugccccauucaguaaggacaacagcauacggcucuccgcgggaggugauauuugggugacccgcgagcccuaugucucuugugacccuggcaaaugcuaccaauuugcucuggggcagggaacgacucuuaauaaccgacauucgaaugauaccgugcacgaccguacaccauauagaacucuguugaugaacgagcucggcguucccuuccaucuggguaccaaacagguguguaucgccuggucaagcaguuccugccacgaugggaaggcauggcugcaugucugugugacaggacacgacgaaaaugccaccgcuucuuuuauuuacgauggcaggcucguagacagcaucggcuccuggucaaagaacaucuuacggacgcaggagagugaaugcguuuguauuaaugggacuugcacaguggucaugaccgauggaagcgcaucugagcgcgccgacacuaaaauacuguucaucgaggaagguaagauugugcacaucuccccucuuucaggcagcgcucaacauguggaggaaugcaguuguuauccaagauacccgggggucaggugcguuugucgggauaacuggaagggaucuaaccgccccauaguggacauuaauguaaaagauuacuccaucgugagcucguaugucugcucuggcuuggugggugacacaccucgaaagaacgacuccucaaguagcuccuacuguagaaauccaaacaaugagaaagggucucacggaguuaagggcugggccuuugaugacggcaacgauguguggauggggaggaccaucagcgaggaacugcggucaggauaugagacguucaaagucauugguggcuggaguaagcccaauuccaaacuacagaucaaccgucaggugauuguagaccgcgggaauagaagcggauacucuggcauauuuucaguugaagguaagaguugcaucaacagguguuucuauguggagcucauucgggggcgaaagcaggaaaccgaggucugguggacaagcaauuccaucguggucuuuugcggcacuucuggaaccuacggcacagggucguggccugauggagcggacaucaaccugaugccaauuuga

SEQ ID NO: 144678 - RNA, 1410 nt, Artificial Sequence; identical to SEQ ID NO: 136343
  derived and/or modified sequence opt3 from neuraminidase__InfluenzaA__AFN11853

SEQ ID NO: 144679 - RNA, 1410 nt, Artificial Sequence
  derived and/or modified sequence opt3 from neuraminidase__InfluenzaA__AFN11855
augaaccccaaucagaagaucauuaccauaggcagcgugucccugacaaucucuacuauuugcuucuuuaugcaaacggccauccucauuaccaucgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcaucacaggggacgauaagaaugcaaccgccagcuucaucuacaacggaagacugguggacuccauuguaucauggaguaaagagauacugaggacgcaggaaagcgaguguguuugcaucaauggcacuuguacaguggucaugaccgauggcucugcuuccgggaaggcagacacuaaaauucucuuuaucgaggaaggaaagauagugcacacaucaauuuuaagcgguagugcccaacacguggaggaaugcucuugcuauccucgguacccaggcguccgcuguguuugcagagauaacuggaagggguccaacaggccgaucguggacaucaauauuaaagaccauagcaucguaucgucuuacguguguuccggacuggucggcgauacgccccggaagaacgacucaaguagcuccucucacugccuugauccuaauaacgaggaaggugggcauggagugaaaggcugggcuuucgacgauggcaaugacguuuggauggggcgcaccauuagcgagaagucacgauugggauaugagaccuuuaaagugauagaagguuggaguaacccaaaguccaaacugcagaucaauagacaggucauuguggauaggggcaaccggagcggguacucuggaaucuucucaguagagggcaagaguuguaucaaucguugcuuuuauguugaacuaauucgcgguagaaaggaggaaacagaggugcucuggacuagcaacuccauagucguguucugugggaccucuggcacauacggaacuggcucguggcccgacggggccgauaucaaucugaugccuauuuga

SEQ ID NO: 144680 - RNA, 1410 nt, Artificial Sequence; identical to SEQ ID NO: 137945
  derived and/or modified sequence opt3 from neuraminidase__InfluenzaA__AFN11857

SEQ ID NO: 144681 - RNA, 1410 nt, Artificial Sequence; identical to SEQ ID NO: 138754
  derived and/or modified sequence opt3 from neuraminidase__InfluenzaA__AFN17373

SEQ ID NO: 144682 - RNA, 1410 nt, Artificial Sequence; identical to SEQ ID NO: 144387
  derived and/or modified sequence opt3 from neuraminidase__InfluenzaA__AFN17383

SEQ ID NO: 144683 - RNA, 1410 nt, Artificial Sequence; identical to SEQ ID NO: 138754
  derived and/or modified sequence opt3 from neuraminidase__InfluenzaA__AFN17393

SEQ ID NO: 144684 - RNA, 1410 nt, Artificial Sequence; identical to SEQ ID NO: 138754
  derived and/or modified sequence opt3 from neuraminidase__InfluenzaA__AFN17403

SEQ ID NO: 144685 - RNA, 1410 nt, Artificial Sequence; identical to SEQ ID NO: 138754
  derived and/or modified sequence opt3 from neuraminidase__InfluenzaA__AFN17413

SEQ ID NO: 144686 - RNA, 1410 nt, Artificial Sequence; identical to SEQ ID NO: 138754
  derived and/or modified sequence opt3 from neuraminidase__InfluenzaA__AFN17423

SEQ ID NO: 144687 - RNA, 1410 nt, Artificial Sequence; identical to SEQ ID NO: 138754
  derived and/or modified sequence opt3 from neuraminidase__InfluenzaA__AFN17433

SEQ ID NO: 144688 - RNA, 1410 nt, Artificial Sequence; identical to SEQ ID NO: 138754
  derived and/or modified sequence opt3 from neuraminidase__InfluenzaA__AFN17443

SEQ ID NO: 144689 - RNA, 1410 nt, Artificial Sequence; identical to SEQ ID NO: 138754
  derived and/or modified sequence opt3 from neuraminidase__InfluenzaA__AFN17453

SEQ ID NO: 144690 - RNA, 1410 nt, Artificial Sequence; identical to SEQ ID NO: 138754
  derived and/or modified sequence opt3 from neuraminidase__InfluenzaA__AFN17459

SEQ ID NO: 144691 - RNA, 1410 nt, Artificial Sequence; identical to SEQ ID NO: 138754
  derived and/or modified sequence opt3 from neuraminidase__InfluenzaA__AFN17469

SEQ ID NO: 144692 - RNA, 1410 nt, Artificial Sequence; identical to SEQ ID NO: 138754
  derived and/or modified sequence opt3 from neuraminidase__InfluenzaA__AFN17479

SEQ ID NO: 144693 - RNA, 1410 nt, Artificial Sequence; identical to SEQ ID NO: 138754
  derived and/or modified sequence opt3 from neuraminidase__InfluenzaA__AFN17489

SEQ ID NO: 144694 - RNA, 1410 nt, Artificial Sequence; identical to SEQ ID NO: 138754
  derived and/or modified sequence opt3 from neuraminidase__InfluenzaA__AFN17499

SEQ ID NO: 144695 - RNA, 1410 nt, Artificial Sequence; identical to SEQ ID NO: 138754
  derived and/or modified sequence opt3 from neuraminidase__InfluenzaA__AFN17509

SEQ ID NO: 144696 - RNA, 1410 nt, Artificial Sequence; identical to SEQ ID NO: 138754
  derived and/or modified sequence opt3 from neuraminidase__InfluenzaA__AFN17519

SEQ ID NO: 144697 - RNA, 1410 nt, Artificial Sequence; identical to SEQ ID NO: 138754
  derived and/or modified sequence opt3 from neuraminidase__InfluenzaA__AFN17529

SEQ ID NO: 144698 - RNA, 1410 nt, Artificial Sequence; identical to SEQ ID NO: 138754
  derived and/or modified sequence opt3 from neuraminidase__InfluenzaA__AFN17539

SEQ ID NO: 144699 - RNA, 1410 nt, Artificial Sequence; identical to SEQ ID NO: 138754
  derived and/or modified sequence opt3 from neuraminidase__InfluenzaA__AFN17549

SEQ ID NO: 144700 - RNA, 1410 nt, Artificial Sequence; identical to SEQ ID NO: 138754
  derived and/or modified sequence opt3 from neuraminidase__InfluenzaA__AFN17559

SEQ ID NO: 144701 - RNA, 1410 nt, Artificial Sequence; identical to SEQ ID NO: 138754
  derived and/or modified sequence opt3 from neuraminidase__InfluenzaA__AFN17569

SEQ ID NO: 144702 - RNA, 1410 nt, Artificial Sequence; identical to SEQ ID NO: 138754
  derived and/or modified sequence opt3 from neuraminidase__InfluenzaA__AFN17575

SEQ ID NO: 144703 - RNA, 1410 nt, Artificial Sequence; identical to SEQ ID NO: 138754
  derived and/or modified sequence opt3 from neuraminidase__InfluenzaA__AFN17581

SEQ ID NO: 144704 - RNA, 1410 nt, Artificial Sequence; identical to SEQ ID NO: 138754
  derived and/or modified sequence opt3 from neuraminidase__InfluenzaA__AFN17587

SEQ ID NO: 144705 - RNA, 1410 nt, Artificial Sequence; identical to SEQ ID NO: 138754
  derived and/or modified sequence opt3 from neuraminidase__InfluenzaA__AFN17597

SEQ ID NO: 144706 - RNA, 1410 nt, Artificial Sequence; identical to SEQ ID NO: 144387
  derived and/or modified sequence opt3 from neuraminidase__InfluenzaA__AFN17607

SEQ ID NO: 144707 - RNA, 1410 nt, Artificial Sequence; identical to SEQ ID NO: 138754
  derived and/or modified sequence opt3 from neuraminidase__InfluenzaA__AFN17617

SEQ ID NO: 144708 - RNA, 1410 nt, Artificial Sequence; identical to SEQ ID NO: 138754
  derived and/or modified sequence opt3 from neuraminidase__InfluenzaA__AFN17627

SEQ ID NO: 144709 - RNA, 1410 nt, Artificial Sequence; identical to SEQ ID NO: 138754
  derived and/or modified sequence opt3 from neuraminidase__InfluenzaA__AFN17637

SEQ ID NO: 144710 - RNA, 1410 nt, Artificial Sequence; identical to SEQ ID NO: 138754
  derived and/or modified sequence opt3 from neuraminidase__InfluenzaA__AFN17647

SEQ ID NO: 144711 - RNA, 1410 nt, Artificial Sequence; identical to SEQ ID NO: 138754
  derived and/or modified sequence opt3 from neuraminidase__InfluenzaA__AFN17657

SEQ ID NO: 144712 - RNA, 1410 nt, Artificial Sequence; identical to SEQ ID NO: 138754
  derived and/or modified sequence opt3 from neuraminidase__InfluenzaA__AFN17667

SEQ ID NO: 144713 - RNA, 1410 nt, Artificial Sequence; identical to SEQ ID NO: 138754
  derived and/or modified sequence opt3 from neuraminidase__InfluenzaA__AFN17677

SEQ ID NO: 144714 - RNA, 1410 nt, Artificial Sequence; identical to SEQ ID NO: 144387
  derived and/or modified sequence opt3 from neuraminidase__InfluenzaA__AFN17687

SEQ ID NO: 144715 - RNA, 1410 nt, Artificial Sequence; identical to SEQ ID NO: 138754
  derived and/or modified sequence opt3 from neuraminidase__InfluenzaA__AFN17697

SEQ ID NO: 144716 - RNA, 1410 nt, Artificial Sequence; identical to SEQ ID NO: 144387
  derived and/or modified sequence opt3 from neuraminidase__InfluenzaA__AFN17707

SEQ ID NO: 144717 - RNA, 1410 nt, Artificial Sequence; identical to SEQ ID NO: 138754
  derived and/or modified sequence opt3 from neuraminidase__InfluenzaA__AFN17717

SEQ ID NO: 144718 - RNA, 1410 nt, Artificial Sequence; identical to SEQ ID NO: 144387
  derived and/or modified sequence opt3 from neuraminidase__InfluenzaA__AFN17727

SEQ ID NO: 144719 - RNA, 1410 nt, Artificial Sequence; identical to SEQ ID NO: 138754
  derived and/or modified sequence opt3 from neuraminidase__InfluenzaA__AFN17737

SEQ ID NO: 144720 - RNA, 1410 nt, Artificial Sequence; identical to SEQ ID NO: 138754
  derived and/or modified sequence opt3 from neuraminidase__InfluenzaA__AFN17743

SEQ ID NO: 144721 - RNA, 1410 nt, Artificial Sequence; identical to SEQ ID NO: 144387
  derived and/or modified sequence opt3 from neuraminidase__InfluenzaA__AFN17749

SEQ ID NO: 144722 - RNA, 1410 nt, Artificial Sequence; identical to SEQ ID NO: 138754
  derived and/or modified sequence opt3 from neuraminidase__InfluenzaA__AFN17759

SEQ ID NO: 144723 - RNA, 1410 nt, Artificial Sequence; identical to SEQ ID NO: 138754
  derived and/or modified sequence opt3 from neuraminidase__InfluenzaA__AFN17769

SEQ ID NO: 144724 - RNA, 1410 nt, Artificial Sequence; identical to SEQ ID NO: 138754
  derived and/or modified sequence opt3 from neuraminidase__InfluenzaA__AFN17775

SEQ ID NO: 144725 - RNA, 1410 nt, Artificial Sequence
  derived and/or modified sequence opt3 from neuraminidase__InfluenzaA__AFN17785
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucacccucaugacagauggaccaucugacggccaggcuuccuacaaaaucuuucggauugaaaaggguaaaaucgucaagucaguggagaugaaugcccccaacuaucauuacgaagagugcaguuguuacccugauagcuccgagauuacuugcgugugccgcgacaauuggcacgggucuaacagaccaugggucagcuucaaucagaaccuggaauaucagauaggauacaucuguucaggcauuuuuggcgauaauccgaggcccaacgacaaaaccgggaguugcggaccuguuuccagcaauggugcgaacggcgugaagggguucucuuuuaaguauggaaacggcguauggaucggucggacaaaaucaaucaguagccgcaauggguucgagaugauuugggauccaaacggcuggaccggaacggacaauacuuuuuccauaaagcaagacaucgugggcauuaacgaauggucuggguacucggggagcuucguccagcaucccgagcugacaggucucgauuguauccgaccuugcuucuggguggaauuaauuagaggcaggccaaaagagaauaccaucuggacuuccgggucaaguauaucuuuuuguggaguuaacagcgacacagugggcugguccuggcccgauggugcagagcugccguucaccaucgacaaguga

SEQ ID NO: 144726 - RNA, 1410 nt, Artificial Sequence
  derived and/or modified sequence opt3 from neuraminidase__InfluenzaA__AFN17795
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaacucgucauugugcccugugggaggcugggcgauauacagcaaggacaauaguauuagaaucgguuccaaaggggauguuuuugugauuagggagccauucaucucuuguagcccguuagaaugccggaccuuuuuccugacacagggagcucuacucaaugacaagcauuccaacggcaccaucaaagaucgcucacccuaucgaacucugaugaguuguccuauuggcgaggucccaagccccuacaacucucguuuugaauccguggccuggucagcaagcgccugccacgacgggauaaauuggcuuacaaucggaauuagugguccugauaacggcgcuguagcaguucugaaguauaaugggaucauaaccgacacgauuaagucuuggagaaacaauaucuugaggacucaagaguccgagugugccugcgugaacggaagcuguuucaccgucaugacagauggcccaucggacggucaggcuucuuacaaaaucuuucggauugaaaaggggaaaaucgugaaguccguggagaugaaugcccccaacuaucauuacgaagagugcucauguuacccugauaguagcgagauuacuugcgucugccgcgacaauuggcacggauccaacagaccauggguuucuuucaaucagaaccucgaauaucagauaggcuacaucuguagcggcauuuuuggggauaauccgaggcccaacgacaaaaccggaucaugcgguccugugaguuccaauggcgcgaacgggguaaagggauucagcuuuaaguauggcaacgguguguggaucgggcggacaaaaucuaucucaagucgcaauggcuucgagaugauuugggauccaaacggauggaccggcacggacaauaacuuuagcauaaagcaagacaucgucgggauuaaugaaugguccggauacucugguucguucgugcagcaucccgagcugacuggccuggauuguauccgaccuugcuucuggguugaacucauuagagggaggccaaaagagaacacaaucuggaccagcggauccucaauaaguuuuuguggcgucaauucugacacuguggguuggagcuggcccgauggggcagaguuaccguucacaaucgacaaguga

SEQ ID NO: 144727 - RNA, 1410 nt, Artificial Sequence; identical to SEQ ID NO: 138754
  derived and/or modified sequence opt3 from neuraminidase__InfluenzaA__AFN17805

SEQ ID NO: 144728 - RNA, 1410 nt, Artificial Sequence
  derived and/or modified sequence opt3 from neuraminidase__InfluenzaA__AFN17815
augaaccccaaucagaagaucauuaccauaggcagcguguccaugacaaucgggauggccaaccugauucuccaaaucggaaauauuaucucuauauggaucucacacaguauucagcuugguaaccagaaucagaucgagacuugcaaccaaagcgucauuacguacgaaaauaacaccuggguuaaucagacauaugugaacaucuccaauacuaacuucgcugcaggccagucuguagugucggucaaacuggccgggaauagcagcuuguguccugugaguggaugggcgauauacuccaaggacaacucuauuagaaucggcagcaaaggugauguuuuugugauuagggagccauucaucuccugcucaccguuagaaugucggaccuuuuuccugacacagggggcucuacucaaugacaagcauaguaacggaaccaucaaagaucgcagccccuaucgaacucugaugucuugcccuauuggcgaggucccaucccccuacaacucacguuuugaaagcguggccuggagugcaucugccugucacgacggcauaaauuggcuuacaaucgggauuuccggaccugauaacggugcuguagcaguucugaaguauaauggcaucauaaccgacacgauuaagagcuggagaaacaauaucuugaggacucaagagucggagugcgccugugugaacgggucuugcuucaccgucaugacagauggaccauccgacggccaggcuucauacaaaaucuuucggauugaaaaggguaaaaucgugaagaguguggagaugaaugcccccaacuaucauuacgaagaguguagcugcuacccugauuccucugagauuacuugugucugccgcgacaauuggcacgggagcaacagaccauggguuucauucaaucagaaccucgaauaucagauaggauacaucugcaguggcauuuuuggcgauaauccgaggcccaacgacaaaaccggguccuguggaccugugagcucuaauggugcgaacggcguaaagggguucucauuuaaguauggaaacggcguguggaucggucggacaaaaaguaucagcucccgcaauggguucgagaugauuugggauccaaacggcuggaccggaacggacaauaacuuuucuauaaagcaagacaucgucggcauuaaugaauggucgggguacagcggauccuucgugcagcaucccgagcugacuggucuggauugcauccgaccuuguuucuggguugaacucauuagaggcaggccaaaagagaacacaaucuggaccucagggaguucuauaucauuuugcggagucaauuccgacacugugggcuggucauggcccgauggugcagaguuaccguucacaaucgacaaguga

SEQ ID NO: 144729 - RNA, 1410 nt, Artificial Sequence; identical to SEQ ID NO: 138754
  derived and/or modified sequence opt3 from neuraminidase__InfluenzaA__AFN17825

SEQ ID NO: 144730 - RNA, 1410 nt, Artificial Sequence; identical to SEQ ID NO: 144387
  derived and/or modified sequence opt3 from neuraminidase__InfluenzaA__AFN17835

SEQ ID NO: 144731 - RNA, 1410 nt, Artificial Sequence; identical to SEQ ID NO: 138754
  derived and/or modified sequence opt3 from neuraminidase__InfluenzaA__AFN17845

SEQ ID NO: 144732 - RNA, 1410 nt, Artificial Sequence; identical to SEQ ID NO: 138754
  derived and/or modified sequence opt3 from neuraminidase__InfluenzaA__AFN17855

SEQ ID NO: 144733 - RNA, 1410 nt, Artificial Sequence; identical to SEQ ID NO: 140568
  derived and/or modified sequence opt3 from neuraminidase__InfluenzaA__AFN17865

SEQ ID NO: 144734 - RNA, 1410 nt, Artificial Sequence; identical to SEQ ID NO: 144387
  derived and/or modified sequence opt3 from neuraminidase__InfluenzaA__AFN17875

SEQ ID NO: 144735 - RNA, 1410 nt, Artificial Sequence; identical to SEQ ID NO: 144387
  derived and/or modified sequence opt3 from neuraminidase__InfluenzaA__AFN17885

SEQ ID NO: 144736 - RNA, 1410 nt, Artificial Sequence; identical to SEQ ID NO: 138754
  derived and/or modified sequence opt3 from neuraminidase__InfluenzaA__AFN17895

SEQ ID NO: 144737 - RNA, 1410 nt, Artificial Sequence; identical to SEQ ID NO: 144387
  derived and/or modified sequence opt3 from neuraminidase__InfluenzaA__AFN17905

SEQ ID NO: 144738 - RNA, 1410 nt, Artificial Sequence; identical to SEQ ID NO: 138754
  derived and/or modified sequence opt3 from neuraminidase__InfluenzaA__AFN17911

SEQ ID NO: 144739 - RNA, 1410 nt, Artificial Sequence; identical to SEQ ID NO: 144387
  derived and/or modified sequence opt3 from neuraminidase__InfluenzaA__AFN17921

SEQ ID NO: 144740 - RNA, 1410 nt, Artificial Sequence
  derived and/or modified sequence opt3 from neuraminidase__InfluenzaA__AFN17931
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaggggugauguuuuugugauucgggagccauucaucagcuguuccccguuagaaugccgcaccuuuuuccugacacagggggcucuacucaaugacaaacauucaaacggaaccaucaaggaucgaagucccuaucguacucugaugagcuguccuauuggcgaggucccaucucccuacaacuccagauuugaaucaguggccuggagcgcaagugccugccacgacggcauaaauuggcuuacaaucgggauuucuggaccugauaacggugcuguagcaguucugaaauauaauggcaucauaaccgacacgauuaaguccuggaggaacaauaucuugcggacucaagagagcgagugugccugcgugaacgggucguguuucaccgucaugacagauggaccaucugacggccaggcuuccuacaagaucuuucgcauugaaaaagguaagaucgugaaaucaguggagaugaaugcccccaacuaucauuacgaagagugcaguuguuacccugauagcuccgagauuacuugcgucugcagagacaauuggcacgggucuaacaggccauggguuagcuucaaucagaaccucgaauaucggauaggauacaucuguucaggcauuuuuggcgauaauccgcgccccaacgacaagaccgggaguugcggaccuguguccagcaauggugcgaacggcguaaaaggguucucuuuuaaguauggaaacggcguguggaucggucgaacaaagucaaucaguagcagaaauggguucgagaugauuugggauccaaacggcuggaccggaacggacaauaacuuuuccauaaaacaggacaucgucggcauuaaugaauggucuggguacucggggagcuucgugcaacaucccgagcugacuggucuggauuguaucaggccuugcuucuggguugaacucauucggggccguccaaaggagaacacaaucuggaccuccgggucaaguauaucuuuuuguggagugaauagcgacacugucggcugguccuggcccgauggugcagaguuaccguucacaaucgacaaauga

SEQ ID NO: 144741 - RNA, 1410 nt, Artificial Sequence; identical to SEQ ID NO: 138754
  derived and/or modified sequence opt3 from neuraminidase__InfluenzaA__AFN17941

SEQ ID NO: 144742 - RNA, 1410 nt, Artificial Sequence; identical to SEQ ID NO: 138754
  derived and/or modified sequence opt3 from neuraminidase__InfluenzaA__AFN17951

SEQ ID NO: 144743 - RNA, 1410 nt, Artificial Sequence
  derived and/or modified sequence opt3 from neuraminidase__InfluenzaA__AFN17961
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgucaauucaguggagaugaacgcccccaauuaucauuacgaagagugcaguuguuacccugauagcuccgagauuacuugcgugugccgcgacaacuggcacgggucuaauagaccauggguuagcuucaaccagaaucucgaauaucagauaggauacaucuguucaggcauuuuuggcgauaacccgaggcccaaugacaagaccgggaguugcggaccuguguccagcaacggugcgaacggcguaaaaggguucucuuuuaaguauggaaauggcguguggaucggucggacaaagucaaucaguagccgcaacggguucgagaugauuugggauccaaauggcuggaccggaacggacaacaauuuuuccauaaaacaagacaucgucggcauuaacgaauggucuggguacucggggagcuucgugcagcaucccgagcugacuggucuggauuguauccgaccuugcuucuggguugaacucauuagaggcaggccaaaggagaauacaaucuggaccuccgggucaaguauaucuuuuuguggagugaacagcgacacugucggcugguccuggcccgauggugcagaguuaccguucacaaucgacaaauga

SEQ ID NO: 144744 - RNA, 1410 nt, Artificial Sequence; identical to SEQ ID NO: 138754
  derived and/or modified sequence opt3 from neuraminidase__InfluenzaA__AFN17971

SEQ ID NO: 144745 - RNA, 1410 nt, Artificial Sequence; identical to SEQ ID NO: 138754
  derived and/or modified sequence opt3 from neuraminidase__InfluenzaA__AFN17981

SEQ ID NO: 144746 - RNA, 1410 nt, Artificial Sequence; identical to SEQ ID NO: 138754
  derived and/or modified sequence opt3 from neuraminidase__InfluenzaA__AFN17991

SEQ ID NO: 144747 - RNA, 1410 nt, Artificial Sequence
  derived and/or modified sequence opt3 from neuraminidase__InfluenzaA__AFN18001
augaaccccaaucagaagaucauuaccauaagcuccgugugcaugacaaucggcauggccaaccugauucuccaaaucgggaauauuaucucuauauggaucucacacaguauucagcuuggaaaccagaaucagaucgagacuuguaaccaaagcgucauuacguacgaaaauaacaccuggguuaaucagacauaugugaacaucuccaauacuaacuucgcugcaggucagucuguagugucggucaaacuggccggcaauagcagcuugugcccugugagugggugggcgauauacuccaaggacaacucuauuagaaucggaagcaaaggcgauguuuuugugauuagggagccauucaucuccuguucaccguuagaaugccggaccuuuuuccugacacagggugcucuacucaaugacaagcauaguaacgggaccaucaaagaucgcagccccuaucgaacucugaugucuuguccuauuggagaggucccaucccccuacaacucacguuuugaaagcguggccuggagugcaucugccugccacgacggcauaaauuggcuuacaaucggcauuuccgggccugauaacggagcuguagcaguucugaaguauaaugguaucauaaccgacacgauuaagagcuggagaaacaauaucuugaggacucaagagucggagugugccugcgugaacggcucuuguuucacccucaugacagaugggccauccgacggacaggcuucauacaaaaucuuucggauugaaaagggcaaaaucgucaagaguguggagaugaaugcccccaacuaucauuacgaagagugcagcuguuacccugauuccucugagauuacuugcgugugccgcgacaauuggcacgguagcaacagaccaugggucucauucaaucagaaccuggaauaucagauaggguacaucuguaguggaauuuuuggcgauaauccgaggcccaacgacaaaaccggcuccugcgggccuguuagcucuaauggagcgaacggugugaagggcuucucauuuaaguaugggaacggaguauggaucggccggacaaaaaguaucagcucccgcaaugguuucgagaugauuugggauccaaacggguggaccggcacggacaauaacuuuucuauaaagcaagacaucgugggaauuaaugaauggucgggcuacagcggguccuucguccagcaucccgagcugacuggacucgauuguauccgaccuugcuucuggguggaauuaauuagagguaggccaaaagagaacacaaucuggaccucaggcaguucuauaucauuuugugggguuaauuccgacacugugggauggucauggcccgauggcgcagagcugccguucacaaucgacaaguga

SEQ ID NO: 144748 - RNA, 1410 nt, Artificial Sequence; identical to SEQ ID NO: 138754
  derived and/or modified sequence opt3 from neuraminidase__InfluenzaA__AFN18011

SEQ ID NO: 144749 - RNA, 1410 nt, Artificial Sequence; identical to SEQ ID NO: 138754
  derived and/or modified sequence opt3 from neuraminidase__InfluenzaA__AFN18021

SEQ ID NO: 144750 - RNA, 1410 nt, Artificial Sequence
  derived and/or modified sequence opt3 from neuraminidase__InfluenzaA__AFN18031
augaaccccaaucagaagaucauuaccauaggcagcaucugcaugacaauugggauggccaaccugauccuccaaauuggaaauaucauauccaucuggauuucucacucaauccagcuugguaaccagaaucagauugagacuuguaaccaaagugugaucacguacgaaaauaacaccugggucaaucagacauauguuaacauaagcaauacuaacuucgcugcaggccaguccgugguaucugugaaacuggccggaaauucgucauugugcccugucagcggaugggcgauuuacaguaaggacaacuccaucagaauuggcucuaaaggugauguguuuguuaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggugccaucucccuacaacucccguuuugaaucagucgccuggagcgcaagugccugccacgacggcaucaauuggcuuacaauugggaucucuggaccugauaacggugcuguggcaguacugaaguauaauggcauaauuaccgacacgaucaaguccuggagaaacaauaucuugaggacucaagagagcgagugugccugcguuaacgggucguguuucacccucaugacagauggaccaucugacggccaggcuuccuacaaaauuuuucggaucgaaaaggguaaaauugugaagucagucgagaugaaugcccccaacuaucauuacgaagagugcaguuguuacccugauagcuccgagauaacuugcgugugccgcgacaauuggcacgggucuaacagaccaugggugagcuucaaucagaaccuggaauaucagaucggauacauuuguucaggcaucuuuggcgauaauccgaggcccaacgacaaaaccgggaguugcggaccugucuccagcaauggugcgaacggcguuaagggguucucuuuuaaguauggaaacggcguguggaucggucggacaaaaucaauuaguagccgcaauggguucgagaugauaugggauccaaacggcuggaccggaacggacaauaacuuuuccaucaagcaagacauuguaggcaucaaugaauggucuggguacucggggagcuucgugcagcaucccgagcugacuggucucgauuguauucgaccuugcuucugggucgaauuaaucagaggcaggccaaaagagaacacaauauggaccuccgggucaaguaucucuuuuuguggagugaauagcgacacuguuggcugguccuggcccgauggugcagagcugccguucacaauugacaaguga

SEQ ID NO: 144751 - RNA, 1410 nt, Artificial Sequence; identical to SEQ ID NO: 138754
  derived and/or modified sequence opt3 from neuraminidase__InfluenzaA__AFN18041

SEQ ID NO: 144752 - RNA, 1410 nt, Artificial Sequence; identical to SEQ ID NO: 144387
  derived and/or modified sequence opt3 from neuraminidase__InfluenzaA__AFN18051

SEQ ID NO: 144753 - RNA, 1410 nt, Artificial Sequence; identical to SEQ ID NO: 144387
  derived and/or modified sequence opt3 from neuraminidase__InfluenzaA__AFN18061

SEQ ID NO: 144754 - RNA, 1410 nt, Artificial Sequence; identical to SEQ ID NO: 138754
  derived and/or modified sequence opt3 from neuraminidase__InfluenzaA__AFN18070

SEQ ID NO: 144755 - RNA, 1410 nt, Artificial Sequence; identical to SEQ ID NO: 138754
  derived and/or modified sequence opt3 from neuraminidase__InfluenzaA__AFN18080

SEQ ID NO: 144756 - RNA, 1410 nt, Artificial Sequence; identical to SEQ ID NO: 138754
  derived and/or modified sequence opt3 from neuraminidase__InfluenzaA__AFN18090

SEQ ID NO: 144757 - RNA, 1410 nt, Artificial Sequence; identical to SEQ ID NO: 138754
  derived and/or modified sequence opt3 from neuraminidase__InfluenzaA__AFN18100

SEQ ID NO: 144758 - RNA, 1410 nt, Artificial Sequence; identical to SEQ ID NO: 138754
  derived and/or modified sequence opt3 from neuraminidase__InfluenzaA__AFN18106

SEQ ID NO: 144759 - RNA, 1410 nt, Artificial Sequence
  derived and/or modified sequence opt3 from neuraminidase__InfluenzaA__AFN18108
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauauaggauaggauacaucuguucaggcauuuuuggcgauaauccgcggcccaacgacaaaaccgggaguugcggaccugugcuguccaauggugcgaacggcguaaagggguucagcuuuaaguauggaaacggcguguggaucggucgcacaaaaucuaucucaagucgaaauggguucgagaugauuugggauccaaacggcuggaccggaacggacaauaacuuuagcauaaagcaggacaucgucggcauuaaugaaugguccggguacucuggaucguucgugcaacaucccgagcugacuggucucgauuguaucagaccuugcuucuggguugaauuaauuaggggccggccaaaagagaacacaaucuggaccagcggguccucaauaaguuuuuguggagucaauucugacacugugggcuggagcuggcccgauggugcagagcugccguucacaaucgacaaguga

SEQ ID NO: 144760 - RNA, 1410 nt, Artificial Sequence
  derived and/or modified sequence opt3 from neuraminidase__InfluenzaA__AFN18118
augaaccccaaucagaagaucauuaccauaggcagcgugugcaugacaaucgggauggccaaccugauucuccaaaucggaaauaugauuuccaucuggauaucucacucaauccagcuugguaaccagaaucagauugagacuuguaaccaaagugucaucacguacgaaaauaacaccuggguuaaucagacauaugugaaaauuagcaacacuaauuucgcugcaggccaguccguagugucugucaagcuggccgggaacucgucauugugcccugugagcggaugggcgaucuacaguaaagacaauuccauaagaauuggcucuaagggugauguuuuugugaucagggagccauucauuagcuguuccccguuagaaugccggaccuuuuuccugacacagggggcucuacucaacgacaaacauucaaauggaaccaucaaggaucgcagucccuaucgaacucugaugagcuguccuaucggcgaggucccaucucccuacaacucccguuuugaaucaguggccuggagcgcaagugccugccacgacggcauuaacuggcuuacaauagggaucucuggaccugauaauggugcuguagcaguucugaaguauaacggcauuaucaccgacacgauaaaauccuggagaaauaacauuuugaggacucaagagagcgagugugccugcgugaaugggucguguuucacccucaugacagauggaccaucugacggccaggcuuccuacaagaucuuucggaucgaaaaagguaagauugucaaaucaguggagaugaacgcccccaauuaucauuacgaagagugcaguuguuacccugauagcuccgagaucacuugcgugugccgcgacaacuggcacgggucuaauagaccaugggucagcuucaaccagaaucuggaauaucagauuggauacauauguucaggcaucuuuggcgauaacccgaggcccaaugacaagaccgggaguugcggaccuguuuccagcaacggugcgaauggcgugaagggguucucuuuuaaauauggaaacggcguauggauuggucggacaaagucaaucaguagccgcaacggguucgagaugaucugggauccaaauggcuggaccggaacggacaacaauuuuuccauuaaacaagacauagugggcaucaacgaauggucuggguacucggguagcuucguccagcaucccgagcugacuggacucgauuguauucgaccuugcuucuggguggaauuaaucagaggcaggccaaaggagaauacaauuuggaccuccgggucaaguaucucuuuuuguggaguuaacagcgacacugugggcugguccuggcccgauggugcagagcugccguucacaauagacaaauga

SEQ ID NO: 144761 - RNA, 1410 nt, Artificial Sequence; identical to SEQ ID NO: 138754
  derived and/or modified sequence opt3 from neuraminidase__InfluenzaA__AFN18120

SEQ ID NO: 144762 - RNA, 1410 nt, Artificial Sequence; identical to SEQ ID NO: 138754
  derived and/or modified sequence opt3 from neuraminidase__InfluenzaA__AFN18122

SEQ ID NO: 144763 - RNA, 1410 nt, Artificial Sequence; identical to SEQ ID NO: 144387
  derived and/or modified sequence opt3 from neuraminidase__InfluenzaA__AFN18128

SEQ ID NO: 144764 - RNA, 1410 nt, Artificial Sequence; identical to SEQ ID NO: 144387
  derived and/or modified sequence opt3 from neuraminidase__InfluenzaA__AFN18134

SEQ ID NO: 144765 - RNA, 1410 nt, Artificial Sequence; identical to SEQ ID NO: 138754
  derived and/or modified sequence opt3 from neuraminidase__InfluenzaA__AFN18136

SEQ ID NO: 144766 - RNA, 1410 nt, Artificial Sequence; identical to SEQ ID NO: 138754
  derived and/or modified sequence opt3 from neuraminidase__InfluenzaA__AFN18138

SEQ ID NO: 144767 - RNA, 1410 nt, Artificial Sequence
  derived and/or modified sequence opt3 from neuraminidase__InfluenzaA__AFN18140
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauauaggauaggauacaucuguucaggcauuuuuggcgauaauccgcggcccaacgacaaaaccgggaguugcggaccuguguccagcaauggugcgaacggcguaaagggguucucuuuuaaguauggaaacggcaucuggaucggucgcacaaaaucaauuaguagccgaaauggguucgagaugauaugggauccaaacggcuggaccggaacggacaauaacuuuuccaucaagcaggacauugugggcaucaaugaauggucuggguacucggggagcuucguccaacaucccgagcugacuggucuggauuguauuagaccuugcuucuggguggaacucaucaggggccggccaaaagagaacacaauauggaccuccgggucaaguaucucuuuuuguggaguuaauagcgacacugugggcugguccuggcccgauggugcagaguuaccguucacaauugacaaguga

SEQ ID NO: 144768 - RNA, 1410 nt, Artificial Sequence; identical to SEQ ID NO: 138754
  derived and/or modified sequence opt3 from neuraminidase__InfluenzaA__AFN18144

SEQ ID NO: 144769 - RNA, 1410 nt, Artificial Sequence; identical to SEQ ID NO: 138754
  derived and/or modified sequence opt3 from neuraminidase__InfluenzaA__AFN18150

SEQ ID NO: 144770 - RNA, 1410 nt, Artificial Sequence; identical to SEQ ID NO: 138754
  derived and/or modified sequence opt3 from neuraminidase__InfluenzaA__AFN18156

SEQ ID NO: 144771 - RNA, 1410 nt, Artificial Sequence; identical to SEQ ID NO: 138754
  derived and/or modified sequence opt3 from neuraminidase__InfluenzaA__AFN18158

SEQ ID NO: 144772 - RNA, 1410 nt, Artificial Sequence; identical to SEQ ID NO: 140568
  derived and/or modified sequence opt3 from neuraminidase__InfluenzaA__AFN18160

SEQ ID NO: 144773 - RNA, 1410 nt, Artificial Sequence
  derived and/or modified sequence opt3 from neuraminidase__InfluenzaA__AFN18166
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaaaaccuggguuaaccagacauaugugaauaucagcaacgcuaauuucgcagccggccaguccguagugucugucaagcuggcggggaacucgucauugugcccugugagcggaugggcuauauacaguaaagacaauuccauuagaaucggcucuaagggugauguuuuugugauuagggagccauucaucagcuguuccccguuagaaugccggaccuuuuuccugacucagggggcccuacucaacgacaaacauucaaauggaacaaucaaggaucgcagucccuaucgaacccugaugagcuguccuauuggcgaggucccaucucccuacaacuccaaguuugaaucaguggcauggagcgccagugcuugccacgacggcauaaacuggcuuacuaucgggauuucuggaccugauaauggugcaguagccguucugaaauauaacggcaucauaacagacaccauuaaguccuggcguaauaacaucuugagaacgcaagagagcgagugugcuugcgugaaugggucguguuucacugucaugaccgauggaccaucugacggccaggccuccuacaaaaucuuuaggauugaaaaggguaaaaucgugaagucaguggagaugaacgcgcccaauuaucauuacgaagagugcaguuguuacccugauagcuccgagauuacaugcgucugccgggacaacuggcacgggucuaaucgcccauggguuagcuucaaccagaaucucgaauaucagauaggauacaucuguucaggcauuuuuggcgauaacccgagacccaaugacaagacugggaguugcggaccuguguccagcaacggugcaaauggcguaaaaggguucucuuuuaaguauggaaacggcguguggaucgguaggaccaaaucaaucaguagccggaacggguucgagaugauuugggauccaaauggcuggacaggaaccgacaacaauuuuuccauaaagcaagacaucgucggcauuaacgaauggucuggguacucggguagcuucgugcagcaucccgagcugacgggacuggauuguauccgcccuugcuucuggguugaacucauucgaggcagaccaaaagagaauacuaucuggacauccgggucaaguauaucuuuuuguggagugaacagcgacaccgucggcugguccuggcccgauggugccgaguuaccguucacuaucgacaaguga

SEQ ID NO: 144774 - RNA, 1410 nt, Artificial Sequence; identical to SEQ ID NO: 138754
  derived and/or modified sequence opt3 from neuraminidase__InfluenzaA__AFN18172

SEQ ID NO: 144775 - RNA, 1410 nt, Artificial Sequence; identical to SEQ ID NO: 139772
  derived and/or modified sequence opt3 from neuraminidase__InfluenzaA__AFN18178

SEQ ID NO: 144776 - RNA, 1410 nt, Artificial Sequence
  derived and/or modified sequence opt3 from neuraminidase__InfluenzaA__AFN18184
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccaugguaucugugaaacuggccggaaauucgucauugugcccugucagcggaugggcgauauacaguaaggacaacuccauuagaaucggcucuaaaggugauguguuuguuauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggugccaucucccuacaacucccguuuugaaucagucgccuggagcgcaagugccugccacgacggcauaaauuggcuuacaaucgggauuucuggaccugauaacggugcuguggcaguacugaaguauaauggcaucauaaccgacacgauuaaguccuggagaaacaauaucuugaggacucaagagagcgagugugccugcguuaacgggucguguuucaccgugaugacagauggaccaucugacggccaggcuuccuacaaaaucuuucggauugaaaaggguaaaaucgucaagucaguggagaugaaugcccccaacuaucauuacgaagagugcaguuguuacccugauagcuccgagauuacuugcgugugccgcgacaauuggcacgggucuaacagaccaugggucagcuucaaucagaaccucgaauaucagauaggauacaucuguucaggcauuuuuggcgauaauccgaggcccaacgacaaaaccgggaguugcggaccuguuuccagcaauggugcgaacggcgugaagggguucucuuuuaaguauggaaacggcguauggaucggucggacaaaaucaaucaguagccgcaauggguucgagaugauuugggauccaaacggcuggaccggaacggacaauaacuuuuccauaaagcaagacaucgugggcauuaaugaauggucuggguacucggggagcuucguccagcaucccgagcugacuggucuggauuguauccgaccuugcuucuggguggaacucauuagaggcaggccaaaagagaacacaaucuggaccuccgggucaaguauaucuuuuuguggaguuaauagcgacacugugggcugguccuggcccgauggugcagaguuaccguucacaaucgacaaguga

SEQ ID NO: 144777 - RNA, 1410 nt, Artificial Sequence; identical to SEQ ID NO: 141746
  derived and/or modified sequence opt3 from neuraminidase__InfluenzaA__AFN18190

SEQ ID NO: 144778 - RNA, 1410 nt, Artificial Sequence; identical to SEQ ID NO: 142767
  derived and/or modified sequence opt3 from neuraminidase__InfluenzaA__AFN18196

SEQ ID NO: 144779 - RNA, 1410 nt, Artificial Sequence
  derived and/or modified sequence opt3 from neuraminidase__InfluenzaA__AFN18202
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggcagauccguagugucugucaaacuggccggaaauucgucauugugcccugugagcggaugggcgauauacaguaaggacaacuccauuaggaucggcucuaaaggugauguuuuugugauucgggagccauucaucagcuguuccccguuagaaugccgcaccuuuuuccugacacagggggcucuacucaaugacaagcauucaaacggaaccaucaaagaucgaagucccuaucguacucugaugagcuguccuauuggcgaggucccaucucccuacaacuccagauuugaaucaguggccuggagcgcaagugccugccacgacggcauaaauuggcuuacaaucgggauuucuggaccugauaacggugcuguagcaguucugaaguauaauggcaucauaaccgacacgauuaaguccuggaggaacaauaucuugcggacucaggagagcgagugugccugcgugaacgggucguguuucaccgucaugacagauggaccaucugacggccaggcuuccuacaaaaucuuucgcauugaaaaggguaaaaucgugaagucaguggagaugaaugcccccaacuaucauuacgaagagugcaguuguuacccugauagcuccgagauuacuugcgucugcagagacaauuggcacgggucuaacaggccauggguuagcuucaaucaaaaccucgaauaucagauaggauacaucuguucaggcauuuuuggcgauaauccgcggcccaacgacaaaaccgggaguugcggaccuguguccagcaauggugcgaacggcguaaagggguucucuuuuaaguauggaaacggcguguggaucggucgcacaaaaucaaucaguagccgaaauggguucgagaugauuugggauccaaacggcuggaccggaacggacaauaacuuuuccauaaagcaggacaucgucggcauuaaugaauggucuggguacucggggagcuucgugcaacaucccgagcugacuggucuggauuguaucagaccuugcuucuggguugaacucauuaggggccggccaaaagagaacacaaucuggaccuccgggucaaguauaucuuuuuguggagugaauagcgacacugucggcugguccuggcccgauggugcagaguuaccguucacaaucgacaaguga

SEQ ID NO: 144780 - RNA, 1410 nt, Artificial Sequence; identical to SEQ ID NO: 138754
  derived and/or modified sequence opt3 from neuraminidase__InfluenzaA__AFN18208

SEQ ID NO: 144781 - RNA, 1410 nt, Artificial Sequence
  derived and/or modified sequence opt3 from neuraminidase__InfluenzaA__AFN18210
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccgggccuuuuuccugacccagggggcucuacucaaugacaagcauucaaacggaacaaucaaagaucgcagucccuaucgaacccugaugagcuguccuauuggcgaggucccaucucccuacaacucccguuuugaaucaguggcauggagcgccagugcuugccacgacggcauaaauuggcuuacuaucgggauuucuggaccugauaacggugcaguagccguucugaaguauaauggcaucauaacagacaccauuaaguccuggagaaacaauaucuugaggacgcaagagagcgagugugcuugcgugaacgggucguguuucacugucaugaccgauggaccaucugacggccaggccuccuacaaaaucuuucggauugaaaaggguaaaaucgugaagucaguggagaugaaugcgcccaacuaucauuacgaagagugcaguuguuacccugauagcuccgagauuacaugcgucugccgcgacaauuggcacgggucuaacagaccauggguuagcuucaaucagaaccucgaauauaggauaggauacaucuguucaggcauuuuuggcgauaauccgcggcccaacgacaaaacugggaguugcggaccuguguccagcaauggugcaaacggcguaaagggguucucuuuuaaguauggaaacggcguguggaucggucgcaccaaaucaaucaguagccgaaauggguucgagaugauuugggauccaaacggcuggacaggaaccgacaauaacuuuuccauaaagcaggacaucgucggcauuaaugaauggucuggguacucggggagcuucgugcaacaucccgagcugacgggucuggauuguaucagaccuugcuucuggguugaacucauuaggggccgguuaaaagagaacacuaucuggacauccgggucaaguauaucuuuuuguggagugaauagcgacaccgucggcugguccuggccagauggugccgagcugcccuucacuaucgacaaguga

SEQ ID NO: 144782 - RNA, 1410 nt, Artificial Sequence; identical to SEQ ID NO: 139337
  derived and/or modified sequence opt3 from neuraminidase__InfluenzaA__AFN18216

SEQ ID NO: 144783 - RNA, 1410 nt, Artificial Sequence; identical to SEQ ID NO: 141083
  derived and/or modified sequence opt3 from neuraminidase__InfluenzaA__AFN18226

SEQ ID NO: 144784 - RNA, 1410 nt, Artificial Sequence; identical to SEQ ID NO: 138754
  derived and/or modified sequence opt3 from neuraminidase__InfluenzaA__AFN18232

SEQ ID NO: 144785 - RNA, 1410 nt, Artificial Sequence; identical to SEQ ID NO: 138754
  derived and/or modified sequence opt3 from neuraminidase__InfluenzaA__AFN18234

SEQ ID NO: 144786 - RNA, 1410 nt, Artificial Sequence; identical to SEQ ID NO: 138754
  derived and/or modified sequence opt3 from neuraminidase__InfluenzaA__AFN18244

SEQ ID NO: 144787 - RNA, 1410 nt, Artificial Sequence; identical to SEQ ID NO: 138754
  derived and/or modified sequence opt3 from neuraminidase__InfluenzaA__AFN18246

SEQ ID NO: 144788 - RNA, 1410 nt, Artificial Sequence; identical to SEQ ID NO: 141083
  derived and/or modified sequence opt3 from neuraminidase__InfluenzaA__AFN18256

SEQ ID NO: 144789 - RNA, 1410 nt, Artificial Sequence; identical to SEQ ID NO: 138754
  derived and/or modified sequence opt3 from neuraminidase__InfluenzaA__AFN18262

SEQ ID NO: 144790 - RNA, 1410 nt, Artificial Sequence; identical to SEQ ID NO: 138754
  derived and/or modified sequence opt3 from neuraminidase__InfluenzaA__AFN18268

SEQ ID NO: 144791 - RNA, 1410 nt, Artificial Sequence; identical to SEQ ID NO: 138754
  derived and/or modified sequence opt3 from neuraminidase__InfluenzaA__AFN18270

SEQ ID NO: 144792 - RNA, 1410 nt, Artificial Sequence; identical to SEQ ID NO: 141743
  derived and/or modified sequence opt3 from neuraminidase__InfluenzaA__AFN18272

SEQ ID NO: 144793 - RNA, 1410 nt, Artificial Sequence; identical to SEQ ID NO: 138754
  derived and/or modified sequence opt3 from neuraminidase__InfluenzaA__AFN18274

SEQ ID NO: 144794 - RNA, 1410 nt, Artificial Sequence; identical to SEQ ID NO: 138754
  derived and/or modified sequence opt3 from neuraminidase__InfluenzaA__AFN18282

SEQ ID NO: 144795 - RNA, 1410 nt, Artificial Sequence; identical to SEQ ID NO: 138754
  derived and/or modified sequence opt3 from neuraminidase__InfluenzaA__AFN18304

SEQ ID NO: 144796 - RNA, 1410 nt, Artificial Sequence
  derived and/or modified sequence opt3 from neuraminidase__InfluenzaA__AFN18306
augaaccccaaucagaagaucauuaccauaggcagcgugugcaugacaaucgggauugccaaccugauccuccaaauuggaaauaucauauccaucuggauuucucacucaauccagcuugguaaccagaaucagauugagacuuguaaccaaagugucaucacguacgaaaauaacaccuggguuaaucagacauaugugaacauaagcaauacuaacuucgcugcaggccaguccguagugucugucaaacuggccggaaauucgucauugugcccugugagcggaugggcgauuuacaguaaggacaacuccaucagaauuggcucuaaaggugauguuuuugugaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggucccaucucccuacaacucccguuuugaaucaguggccuggagcgcaagugccugccacgacggcaucaauuggcuuacaauugggaucucuggaccugauaacggugcuguagcaguucugaaguauaauggcauaauuaccgacacgaucaaguccuggagaaacaauaucuugaggacucaagagagcgagugugccugcgugaacgggucguguuucaccgucaugacagauggaccaucugacggccaggcuuccuacaaaauuuuucggaucgaaaaggguaaaauugugaagucaguggagaugaaugcccccaacuaucauuacgaagagugcaguuguuacccugauagcuccgagauaacuugcgucugccgcgacaauuggcacgggucuaacagaccauggguuagcuucaaucagaaccucgaauaucagaucggauacauuuguucaggcaucuuuggcgauaauccgaggcccaacgacaaaaccgggaguugcggaccuguguccagcaauggugcgaacggcguaaagggguucucuuuuaaguauggaaacggcguguggaucggucggacaaaaucaauuaguagccgcaauggguucgagaugauaugggauccaaacggcuggaccggaacggacaauaacuuuuccaucaagcaagacauugucggcaucaaugaauggucuggguacucggggagcuucgugcagcaucccgagcugacuggucuggauuguauucgaccuugcuucuggguugaacucaucagaggcaggccaaaagagaacacaauauggaccuccgggucaaguaucucuuuuuguggagugaauagcgacacugucggcugguccuggcccgauggugcagaguuaccguucacaauugacaaguga

SEQ ID NO: 144797 - RNA, 1410 nt, Artificial Sequence
  derived and/or modified sequence opt3 from neuraminidase__InfluenzaA__AFN18308
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaagggugcgaauggcguaaagggguucucuuuuaaauauggaaacggcguguggaucggucggacaaagucaaucaguagccgcaacggguucgagaugauuugggauccaaauggcuggaccggaacggacaacaauuuuuccauaaaacaagacaucgucggcauuaacgaauggucuggguacucggggagcuucgugcagcaucccgagcugacuggucuggauuguauccgaccuugcuucuggguugaacucauuagaggcaggccaaaggagaauacaaucuggaccuccgggucaaguauaucuuuuuguggagugaacagcgacacugucggcugguccuggcccgauggugcagaguuaccguucacaaucgacaaauga

SEQ ID NO: 144798 - RNA, 1410 nt, Artificial Sequence
  derived and/or modified sequence opt3 from neuraminidase__InfluenzaA__AFN18314
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaagacaaucuggaccuccgggucaaguauaucuuuuuguggagugaacagcgacacugucggcugguccuggcccgauggugcagaguuaccguucacaaucgacaaauga

SEQ ID NO: 144799 - RNA, 1410 nt, Artificial Sequence; identical to SEQ ID NO: 138754
  derived and/or modified sequence opt3 from neuraminidase__InfluenzaA__AFN18320

SEQ ID NO: 144800 - RNA, 1410 nt, Artificial Sequence
  derived and/or modified sequence opt3 from neuraminidase__InfluenzaA__AFN18326
augaaccccaaucagaagaucauuaccauaggcagcgugugcaugacaaucgggauggccaaccugcuccuucaaauuggaaauaucauuuccaucuggauaucucacucaauccagcuggguaaccagaaucagauugagacuuguaaccaaagugucaucacguacgaaaauaacaccuggguuaaucagacauaugugaacauuagcaauacuaacuucgcugcaggccaguccguagugucugucaaauuggccggaaauucgucauuaugcccugugagcggaugggcgaucuacaguaaggacaacuccauaagaauuggcucuaaaggugauguuuuugugaucagggagccauucauuagcuguuccccgcuggaaugccggaccuuuuuccuaacacagggggcucuccugaaugacaagcauucaaacggaaccaucaaagaucgcagucccuaucgaacucuuaugagcuguccuaucggcgaggucccaucucccuacaacucccguuuugaaucaguggccuggagcgcaagugccugccacgacggcauuaauuggcugacaauagggaucucuggaccugauaacggugcuguagcaguuuugaaguauaauggcauuaucaccgacacgauaaaguccuggagaaacaauauucucaggacucaagagagcgagugugccugcgugaacgggucguguuucaccgucaugacagauggaccaucugacggccaggcuuccuacaaaaucuuucggaucgaaaaggguaaaauugugaagucaguggagaugaaugcccccaacuaucauuacgaagagugcaguuguuacccugauagcuccgagaucacuugcgucugccgcgacaauuggcacgggucuaacagaccauggguuagcuucaaucagaaccuggaauaucagauuggauacauauguucaggcaucuuuggcgauaauccgaggcccaacgacaaaaccgggaguugcggaccuguguccagcaauggugcgaacggcguaaagggguucucuuuuaaguauggaaacggcguguggauuggucggacaaaaucaaucaguagccgcaauggguucgagaugaucugggauccaaacggcuggaccggaacggacaauaacuuuuccauuaagcaagacauagucggcaucaaugaauggucuggguacucggggagcuucgugcagcaucccgagcugacuggucucgauuguauucgaccuugcuucuggguugaauuaaucagaggcaggccaaaagagaacacaauuuggaccuccgggucaaguaucucuuuuuguggagugaauagcgacacugucggcugguccuggcccgauggugcagagcugccguucacaauagacaaguga

SEQ ID NO: 144801 - RNA, 1410 nt, Artificial Sequence; identical to SEQ ID NO: 138754
  derived and/or modified sequence opt3 from neuraminidase__InfluenzaA__AFN18336

SEQ ID NO: 144802 - RNA, 1410 nt, Artificial Sequence; identical to SEQ ID NO: 138754
  derived and/or modified sequence opt3 from neuraminidase__InfluenzaA__AFN18346

SEQ ID NO: 144803 - RNA, 1410 nt, Artificial Sequence; identical to SEQ ID NO: 144387
  derived and/or modified sequence opt3 from neuraminidase__InfluenzaA__AFN18356

SEQ ID NO: 144804 - RNA, 1410 nt, Artificial Sequence
  derived and/or modified sequence opt3 from neuraminidase__InfluenzaA__AFN18366
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcagagcaguccguagugucugucaaacuggccggcaauucgucauugugcccugugagcgggugggcgauauacaguaaggacaacuccauuagaaucggaucuaaaggcgauguuuuugugauuagggaaccauucaucagcuguuccccguuagagugccggaccuuuuuccugacacagggugcucuacucaaugacaagcauucaaacgggaccaucaaagaucgcagucccuaucgaacucugaugagcuguccuauuggagaagucccaucucccuacaacucccguuuugagucaguggccuggagcgcaagugccugccacgacggcauaaauuggcuuacaaucggcauuucugggccugauaacggagcuguagcaguucugaaguauaaugguaucauaaccgacacgauuaaguccuggagaaacaauaucuugaggacucaagagagcgaaugugccugcgugaacggcucguguuucaccgucaugacagaugggccaucugacggacaggcuuccuacaaaaucuuucggauugagaagggcaaaaucgugaagucaguggaaaugaaugcccccaacuaucauuacgaggagugcaguuguuacccugauagcuccgaagucacuugcguuugccgcgacaauuggcacgguucuaacagaccaugggugagcuucaaucagaaccucgaguaucagauuggguacauauguucaggaaucuuuggcgauaauccgaggcccaacgacaaaaccggcaguugcgggccuguauccagcaauggagcgaacggugugaagggcuucucuuuuaaguaugggaacggagucuggauuggccggacaaaaucaaucaguagccgcaaugguuucgaaaugaucugggauccaaacggguggaccggcacggacaauaacuuuuccauuaagcaagacauagugggaaucaaugaguggucuggcuacucggggagcuucguucagcaucccgaacugacuggacuggauuguauucgaccuugcuucuggguggagcucaucagagguaggccaaaagagaacacaauuuggaccuccggcucaaguaucucuuuuuguggggucaauagcgacacugugggaugguccuggcccgauggcgcagaauuaccguucacaauagacaaguga

SEQ ID NO: 144805 - RNA, 1410 nt, Artificial Sequence; identical to SEQ ID NO: 144387
  derived and/or modified sequence opt3 from neuraminidase__InfluenzaA__AFN18376

SEQ ID NO: 144806 - RNA, 1410 nt, Artificial Sequence; identical to SEQ ID NO: 138754
  derived and/or modified sequence opt3 from neuraminidase__InfluenzaA__AFN18382

SEQ ID NO: 144807 - RNA, 1410 nt, Artificial Sequence; identical to SEQ ID NO: 138754
  derived and/or modified sequence opt3 from neuraminidase__InfluenzaA__AFN18392

SEQ ID NO: 144808 - RNA, 1410 nt, Artificial Sequence; identical to SEQ ID NO: 138754
  derived and/or modified sequence opt3 from neuraminidase__InfluenzaA__AFN18402

SEQ ID NO: 144809 - RNA, 1410 nt, Artificial Sequence; identical to SEQ ID NO: 138754
  derived and/or modified sequence opt3 from neuraminidase__InfluenzaA__AFN18412

SEQ ID NO: 144810 - RNA, 1410 nt, Artificial Sequence; identical to SEQ ID NO: 138754
  derived and/or modified sequence opt3 from neuraminidase__InfluenzaA__AFN18422

SEQ ID NO: 144811 - RNA, 1410 nt, Artificial Sequence; identical to SEQ ID NO: 138754
  derived and/or modified sequence opt3 from neuraminidase__InfluenzaA__AFN18432

SEQ ID NO: 144812 - RNA, 1410 nt, Artificial Sequence; identical to SEQ ID NO: 138754
  derived and/or modified sequence opt3 from neuraminidase__InfluenzaA__AFN18442

SEQ ID NO: 144813 - RNA, 1410 nt, Artificial Sequence; identical to SEQ ID NO: 138754
  derived and/or modified sequence opt3 from neuraminidase__InfluenzaA__AFN18452

SEQ ID NO: 144814 - RNA, 1410 nt, Artificial Sequence; identical to SEQ ID NO: 138754
  derived and/or modified sequence opt3 from neuraminidase__InfluenzaA__AFN18462

SEQ ID NO: 144815 - RNA, 1410 nt, Artificial Sequence
  derived and/or modified sequence opt3 from neuraminidase__InfluenzaA__AFN18472
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaagggcguaaagggguucucuuuuaaauauggaaacggcguguggaucggucggacaaagucaaucaguagccgcaacggguucgagaugauuugggauccaaauggcuggaccggaacggacaacaauuuuuccauaaaacaagacaucgucggcauuaacgaauggucuggguacucggggagcuucgugcagcaucccgagcugacuggucuggauuguauccgaccuugcuucuggguugaacucauuagaggcaggccaaaggagaauacaaucuggaccuccgggucaaguauaucuuuuuguggagugaacagcgacacugucggcugguccuggcccgauggugcagaguuaccguucacaaucgacaaauga

SEQ ID NO: 144816 - RNA, 1410 nt, Artificial Sequence; identical to SEQ ID NO: 138754
  derived and/or modified sequence opt3 from neuraminidase__InfluenzaA__AFN18482

SEQ ID NO: 144817 - RNA, 1410 nt, Artificial Sequence; identical to SEQ ID NO: 138754
  derived and/or modified sequence opt3 from neuraminidase__InfluenzaA__AFN18492

SEQ ID NO: 144818 - RNA, 1410 nt, Artificial Sequence
  derived and/or modified sequence opt3 from neuraminidase__InfluenzaA__AFN18514
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggugggaaauucgucauugugcccuguuagcggaugggccauauacaguaaggacaacuccauuagaaucggcucuaaaggugauguguuugucauuagggagccauucaucagcuguuccccguuagaaugccggaccuuuuuccugacacagggggcgcuacucaaugacaagcauucaaacggaaccaucaaagaucgcagucccuaucgaacucugaugagcuguccuauuggcgaggugccaucucccuacaacucccguuuugaaucaguagcuuggagcgccagugcaugccacgacggcauaaauuggcuuacaaucgggauuucuggaccugauaacggugccguugcugugcugaaguauaauggcaucauaaccgacacgauuaaguccuggagaaacaauaucuugaggacucaagagagcgagugugcaugcgucaacgggucguguuucaccgugaugacagauggaccaucugacggccaggccuccuacaaaaucuuucggauugaaaaggguaaaaucgugaagucagucgagaugaaugcucccaacuaucauuacgaagagugcaguuguuacccugauagcuccgagauuacuugcguuugccgcgacaauuggcacgggucuaacagaccaugggugagcuucaaucagaaccucgaauaucagauaggauacaucuguucaggcauuuuuggcgauaauccgaggcccaacgacaaaaccgggaguugcggaccuguauccagcaauggugccaacggcgugaagggguucucuuuuaaguauggaaacggcgucuggaucggucggacaaaaucaaucaguagccgcaauggguucgagaugauuugggauccaaacggcuggaccggaacggacaauaacuuuuccauaaagcaagacaucgugggcauuaaugaauggucuggguacucggggagcuucguucagcaucccgagcugacuggucuggauuguauccgaccuugcuucuggguggaacucauuagaggcaggccaaaagagaacacaaucuggaccuccgggucaaguauaucuuuuuguggagucaauagcgacacugugggcugguccuggcccgauggugcggaguuaccguucacaaucgacaaguga

SEQ ID NO: 144819 - RNA, 1410 nt, Artificial Sequence
  derived and/or modified sequence opt3 from neuraminidase__InfluenzaA__AFN18520
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcgugaucaccgacacgauaaaguccuggagaaacaauauuuugaggacucaagagagcgagugugccugcgucaacgggucguguuucacccucaugacagauggaccaucugacggccaggcuuccuacaaaaucuuucggaucgaaaaggguaaaauugugaagucaguggagaugaaugcccccaacuaucauuacgaagagugcaguuguuacccugauagcuccgagaucacuugcgucugccgcgacaauuggcacgggucuaacagaccauggguuagcuucaaucagaaccuggaauaucagauuggauacauauguucaggcaucuuuggcgauaauccgaggcccaacgacaaaaccgggaguugcggaccuguguccagcaauggugcgaacggcguaaagggguucucuuuuaaguauggaaacggcguguggauuggucggacaaaaucaaucaguagccgcaauggguucgagaugaucugggauccaaacggcuggaccggaacggacaauaacuuuuccauuaagcaagacauagucggcaucaaugaauggucuggguacucggggagcuucgugcagcaucccgagcugacuggucucgauuguauucgaccuugcuucuggguugaauuaaucagaggcaggccaaaagagaacacaauuuggaccuccgggucaaguaucucuuuuuguggagugaauagcgacacugucggcugguccuggcccgauggugcagagcugccguucacaauagacaaguga

SEQ ID NO: 144820 - RNA, 1410 nt, Artificial Sequence; identical to SEQ ID NO: 138754
  derived and/or modified sequence opt3 from neuraminidase__InfluenzaA__AFN18522

SEQ ID NO: 144821 - RNA, 1410 nt, Artificial Sequence; identical to SEQ ID NO: 138754
  derived and/or modified sequence opt3 from neuraminidase__InfluenzaA__AFN18524

SEQ ID NO: 144822 - RNA, 1410 nt, Artificial Sequence; identical to SEQ ID NO: 144387
  derived and/or modified sequence opt3 from neuraminidase__InfluenzaA__AFN18530

SEQ ID NO: 144823 - RNA, 1410 nt, Artificial Sequence; identical to SEQ ID NO: 138754
  derived and/or modified sequence opt3 from neuraminidase__InfluenzaA__AFN18532

SEQ ID NO: 144824 - RNA, 1410 nt, Artificial Sequence; identical to SEQ ID NO: 138754
  derived and/or modified sequence opt3 from neuraminidase__InfluenzaA__AFN18538

SEQ ID NO: 144825 - RNA, 1410 nt, Artificial Sequence; identical to SEQ ID NO: 138754
  derived and/or modified sequence opt3 from neuraminidase__InfluenzaA__AFN18544

SEQ ID NO: 144826 - RNA, 1410 nt, Artificial Sequence; identical to SEQ ID NO: 138754
  derived and/or modified sequence opt3 from neuraminidase__InfluenzaA__AFN18546

SEQ ID NO: 144827 - RNA, 1410 nt, Artificial Sequence; identical to SEQ ID NO: 138754
  derived and/or modified sequence opt3 from neuraminidase__InfluenzaA__AFN18552

SEQ ID NO: 144828 - RNA, 1410 nt, Artificial Sequence; identical to SEQ ID NO: 138754
  derived and/or modified sequence opt3 from neuraminidase__InfluenzaA__AFN18558

SEQ ID NO: 144829 - RNA, 1410 nt, Artificial Sequence; identical to SEQ ID NO: 138754
  derived and/or modified sequence opt3 from neuraminidase__InfluenzaA__AFN18560

SEQ ID NO: 144830 - RNA, 1410 nt, Artificial Sequence; identical to SEQ ID NO: 138754
  derived and/or modified sequence opt3 from neuraminidase__InfluenzaA__AFN18562

SEQ ID NO: 144831 - RNA, 1410 nt, Artificial Sequence; identical to SEQ ID NO: 138754
  derived and/or modified sequence opt3 from neuraminidase__InfluenzaA__AFN18564

SEQ ID NO: 144832 - RNA, 1410 nt, Artificial Sequence; identical to SEQ ID NO: 138754
  derived and/or modified sequence opt3 from neuraminidase__InfluenzaA__AFN18566

SEQ ID NO: 144833 - RNA, 1410 nt, Artificial Sequence; identical to SEQ ID NO: 138754
  derived and/or modified sequence opt3 from neuraminidase__InfluenzaA__AFN18572

SEQ ID NO: 144834 - RNA, 1410 nt, Artificial Sequence; identical to SEQ ID NO: 138754
  derived and/or modified sequence opt3 from neuraminidase__InfluenzaA__AFN18582

SEQ ID NO: 144835 - RNA, 1410 nt, Artificial Sequence; identical to SEQ ID NO: 138754
  derived and/or modified sequence opt3 from neuraminidase__InfluenzaA__AFN18592

SEQ ID NO: 144836 - RNA, 1410 nt, Artificial Sequence; identical to SEQ ID NO: 144387
  derived and/or modified sequence opt3 from neuraminidase__InfluenzaA__AFN18602

SEQ ID NO: 144837 - RNA, 1410 nt, Artificial Sequence
  derived and/or modified sequence opt3 from neuraminidase__InfluenzaA__AFN18612
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucauuaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcaauggguucgagaugauaugggauccaaacggcuggaccggaacggacaauaacuuuuccaucaagcaagacauugugggcaucaaugaauggucuggguacucggggagcuucguccagcaucccgagcugacuggucuggauuguauucgaccuugcuucuggguggaacucaucagaggcaggccaaaagagaacacaauauggaccuccgggucaaguaucucuuuuuguggaguuaauagcgacacugugggcugguccuggcccgauggugcagaguuaccguucacaauugacaaguga

SEQ ID NO: 144838 - RNA, 1410 nt, Artificial Sequence; identical to SEQ ID NO: 138754
  derived and/or modified sequence opt3 from neuraminidase__InfluenzaA__AFN18618

SEQ ID NO: 144839 - RNA, 1410 nt, Artificial Sequence; identical to SEQ ID NO: 139580
  derived and/or modified sequence opt3 from neuraminidase__InfluenzaA__AFN18624

SEQ ID NO: 144840 - RNA, 1410 nt, Artificial Sequence
  derived and/or modified sequence opt3 from neuraminidase__InfluenzaA__AFN18630
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucugggcuguauccgaccuugcuucuggguugaacucauuagagggaggccaaaagagaacacaaucuggaccuccggaucaaguauaucuuuuuguggcgugaauagcgauacugucgguugguccuggcccgacggggcagaguuaccguucacaaucgauaaguga

SEQ ID NO: 144841 - RNA, 1410 nt, Artificial Sequence
  derived and/or modified sequence opt3 from neuraminidase__InfluenzaA__AFN18636
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauauaggauaggauacaucuguucaggcauuuuuggcgauaauccgcggcccaacgacaaaaccgggaguugcggaccuguguccagcaauggugcgaacggcguaaagggguucucuuuuaaguauggaaacggcguguggaucggucgcacaaaaucaaucaguagccgaaauggguucgagaugauuugggauccaaacggcuggaccggaacggacaauaacuuuuccauaaagcaggacaucgucggcauuaaugaauggucuggguacucggggagcuucgugcaacaucccgagcugacuggucuggauuguaucagaccuugcuucuggguugaacucauuaggggccgguccaaagagaacacaaucuggaccucagggaguucuauauccuuuuguggagugaauagcgacacugucggcuggucauggccagauggugcagaguuacccuucacaaucgacaaguga

SEQ ID NO: 144842 - RNA, 1410 nt, Artificial Sequence; identical to SEQ ID NO: 138754
  derived and/or modified sequence opt3 from neuraminidase__InfluenzaA__AFN18646

SEQ ID NO: 144843 - RNA, 1410 nt, Artificial Sequence; identical to SEQ ID NO: 138754
  derived and/or modified sequence opt3 from neuraminidase__InfluenzaA__AFN18656

SEQ ID NO: 144844 - RNA, 1410 nt, Artificial Sequence
  derived and/or modified sequence opt3 from neuraminidase__InfluenzaA__AFN18666
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucaucauugacaaguga

SEQ ID NO: 144845 - RNA, 1410 nt, Artificial Sequence
  derived and/or modified sequence opt3 from neuraminidase__InfluenzaA__AFN18676
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauauaggauaggauacaucuguucaggcauuuuuggcgauaauccgcggcccaacgacaaaaccgggaguugcggaccuguguccagcaauggugcgaacggcguaaagggguucucuuuuaaguauggaaacggcguguggaucggucgcacaaaaucaaucaguagccgaaauggguucgagaugauuugggauccaaacggcuggaccgaaacggacaauaacuuuuccauaaagcaggacaucgucggaauuaaugaguggucuggcuacucggggagcuucgugcaacaucccgaacugacuggacuggauuguaucagaccuugcuucuggguugagcucauuaggggucggccaaaagagaacacaaucuggaccuccggcucaaguauaucuuuuuguggggugaauagcgacacugucggaugguccuggcccgauggcgcagaauuaccguucacaaucgacaaguga

SEQ ID NO: 144846 - RNA, 1410 nt, Artificial Sequence
  derived and/or modified sequence opt3 from neuraminidase__InfluenzaA__AFN18686
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcuccacuaauuucgcugcaggccagucuguagugucggucaaacuggccgggaacagcagcuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucacccucaugacagauggaccauccgacggccaggcuucauacaaaaucuuucggauugaaaaggguaaaaucgucaagaguguggagaugaacgcccccaauuaucauuacgaagagugcagcuguuacccugauuccucugagauuacuugcgugugccgcgacaacuggcacgggagcaauagaccaugggucucauucaaccagaaucuggaauaucagauaggauacaucuguaguggcauuuuuggcgauaacccgaggcccaaugacaaaaccggguccugcggaccuguuagcucuaacggugcgaauggcgugaagggguucucauuuaaguauggaaacggcguauggaucggucggacaaaaaguaucagcucccgcaacggguucgagaugauuugggauccaaauggcuggaccggaacggacaacaauuuuucuauaaagcaagacaucgugggcauuaacgaauggucgggguacagcggauccuucguccagcaucccgagcugacuggucucgauuguauccgaccuugcuucuggguggaauuaauuagaggcaggccaaaagagaauacaaucuggaccucagggaguucuauaucauuuuguggaguuaacuccgacacugugggcuggucauggcccgauggugcagagcugccguucacaaucgacaaguga

SEQ ID NO: 144847 - RNA, 1410 nt, Artificial Sequence; identical to SEQ ID NO: 138754
  derived and/or modified sequence opt3 from neuraminidase__InfluenzaA__AFN18696

SEQ ID NO: 144848 - RNA, 1410 nt, Artificial Sequence; identical to SEQ ID NO: 141341
  derived and/or modified sequence opt3 from neuraminidase__InfluenzaA__AFN18706

SEQ ID NO: 144849 - RNA, 1410 nt, Artificial Sequence; identical to SEQ ID NO: 138754
  derived and/or modified sequence opt3 from neuraminidase__InfluenzaA__AFN18716

SEQ ID NO: 144850 - RNA, 1410 nt, Artificial Sequence; identical to SEQ ID NO: 138754
  derived and/or modified sequence opt3 from neuraminidase__InfluenzaA__AFN18727

SEQ ID NO: 144851 - RNA, 1410 nt, Artificial Sequence
  derived and/or modified sequence opt3 from neuraminidase__InfluenzaA__AFN18737
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagauggucugggauccaaacggcuggaccggaacggacaauaacuuuuccauuaagcaagacauagugggcaucaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcagaguuaccguucacaauagacaaguga

SEQ ID NO: 144852 - RNA, 1410 nt, Artificial Sequence; identical to SEQ ID NO: 138754
  derived and/or modified sequence opt3 from neuraminidase__InfluenzaA__AFN18743

SEQ ID NO: 144853 - RNA, 1410 nt, Artificial Sequence; identical to SEQ ID NO: 138754
  derived and/or modified sequence opt3 from neuraminidase__InfluenzaA__AFN18749

SEQ ID NO: 144854 - RNA, 1410 nt, Artificial Sequence; identical to SEQ ID NO: 138754
  derived and/or modified sequence opt3 from neuraminidase__InfluenzaA__AFN18759

SEQ ID NO: 144855 - RNA, 1410 nt, Artificial Sequence
  derived and/or modified sequence opt3 from neuraminidase__InfluenzaA__AFN18769
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucacccucaugacagauggaccaucugacggccaggcuuccuacaaaaucuuucggauugaaaaggguaaaaucgucaagucaguggagaugaaugcccccaacuaucauuacgaagagugcaguuguuacccugauagcaaugagauuacuugcgugugccgcgacaacuggcacggguccaauagaccaugggucucuuucaaccagaaucuggaauaucagauaggauacaucuguagcggcauuuuuggcgauaacccgaggcccaaugacaaaaccgggucaugcggaccuguuaguuccaacggugcgaacggcgugaagggguucagcuuuaaguauggaaauggcguauggaucggucggacaaaaucuaucucaagucgcaacggguucgagaugauuugggauccaaauggcuggaccggaacggacaacaauuuuagcauaaagcaagacaucgugggcauuaacgaaugguccggguacucuggaucguucguccagcaucccgagcugacuggucucgauuguauccgaccuugcuucuggguggaauuaauuagaggcaggccaaaagagaauacaaucuggaccagcggguccucaauaaguuuuuguggaguuaacucugacacugugggcuggagcuggcccgauggugcagagcugccguucacaaucgacaaguga

SEQ ID NO: 144856 - RNA, 1410 nt, Artificial Sequence; identical to SEQ ID NO: 140656
  derived and/or modified sequence opt3 from neuraminidase__InfluenzaA__AFN18775

SEQ ID NO: 144857 - RNA, 1410 nt, Artificial Sequence; identical to SEQ ID NO: 138754
  derived and/or modified sequence opt3 from neuraminidase__InfluenzaA__AFN18777

SEQ ID NO: 144858 - RNA, 1410 nt, Artificial Sequence; identical to SEQ ID NO: 138754
  derived and/or modified sequence opt3 from neuraminidase__InfluenzaA__AFN18779

SEQ ID NO: 144859 - RNA, 1410 nt, Artificial Sequence
  derived and/or modified sequence opt3 from neuraminidase__InfluenzaA__AFN18785
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauacgacaagacaucgucggcauuaaugaauggucuggguacucggggagcuucgugcagcaucccgagcugacuggucuggauuguaucagaccuugcuucuggguugaacucauuaggggccggccaaaggagaacacaaucuggaccuccgggucaaguauaucuuuuuguggagugaauagcgacacugucggcugguccuggcccgauggugcagaguuaccguucacaaucgacaaauga

SEQ ID NO: 144860 - RNA, 1410 nt, Artificial Sequence
  derived and/or modified sequence opt3 from neuraminidase__InfluenzaA__AFN18791
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugagagcuccgaaauuacuugcgucugccgcgauaauuggcacgggucuaacagaccauggguuagcuucaaucagaaccucgaguaucagauaggauacaucuguucaggcauuuuuggcgacaauccgaggcccaacgauaaaaccgggaguugcggaccuguguccagcaauggugcgaacggcguaaagggguucucuuuuaaguauggaaacggcguguggaucggucggacaaaaucaaucaguagccgcaauggguucgaaaugauuugggacccaaacggcuggaccggaacggauaauaacuuuuccauaaagcaagacaucgucggcauuaaugaguggucuggguacucggggagcuucgugcagcaucccgaacugacuggucuggacuguauccgaccuugcuucuggguugagcucauuagaggcaggccaaaagagaacacaaucuggaccuccgggucaaguauaucuuuuuguggagugaauagcgauacugucggcugguccuggcccgacggugcagaauuaccguucacaaucgauaaguga

SEQ ID NO: 144861 - RNA, 1410 nt, Artificial Sequence; identical to SEQ ID NO: 138754
  derived and/or modified sequence opt3 from neuraminidase__InfluenzaA__AFN18801

SEQ ID NO: 144862 - RNA, 1410 nt, Artificial Sequence; identical to SEQ ID NO: 141173
  derived and/or modified sequence opt3 from neuraminidase__InfluenzaA__AFN18811

SEQ ID NO: 144863 - RNA, 1410 nt, Artificial Sequence; identical to SEQ ID NO: 138754
  derived and/or modified sequence opt3 from neuraminidase__InfluenzaA__AFN18817

SEQ ID NO: 144864 - RNA, 1410 nt, Artificial Sequence; identical to SEQ ID NO: 138754
  derived and/or modified sequence opt3 from neuraminidase__InfluenzaA__AFN18819

SEQ ID NO: 144865 - RNA, 1410 nt, Artificial Sequence; identical to SEQ ID NO: 141746
  derived and/or modified sequence opt3 from neuraminidase__InfluenzaA__AFN18821

SEQ ID NO: 144866 - RNA, 1410 nt, Artificial Sequence; identical to SEQ ID NO: 138754
  derived and/or modified sequence opt3 from neuraminidase__InfluenzaA__AFN18823

SEQ ID NO: 144867 - RNA, 1410 nt, Artificial Sequence; identical to SEQ ID NO: 138754
  derived and/or modified sequence opt3 from neuraminidase__InfluenzaA__AFN18825

SEQ ID NO: 144868 - RNA, 1410 nt, Artificial Sequence; identical to SEQ ID NO: 138754
  derived and/or modified sequence opt3 from neuraminidase__InfluenzaA__AFN18827

SEQ ID NO: 144869 - RNA, 1410 nt, Artificial Sequence; identical to SEQ ID NO: 138754
  derived and/or modified sequence opt3 from neuraminidase__InfluenzaA__AFN18829

SEQ ID NO: 144870 - RNA, 1410 nt, Artificial Sequence; identical to SEQ ID NO: 138754
  derived and/or modified sequence opt3 from neuraminidase__InfluenzaA__AFN18831

SEQ ID NO: 144871 - RNA, 1410 nt, Artificial Sequence; identical to SEQ ID NO: 139891
  derived and/or modified sequence opt3 from neuraminidase__InfluenzaA__AFN18833

SEQ ID NO: 144872 - RNA, 1410 nt, Artificial Sequence; identical to SEQ ID NO: 139929
  derived and/or modified sequence opt3 from neuraminidase__InfluenzaA__AFN18835

SEQ ID NO: 144873 - RNA, 1410 nt, Artificial Sequence; identical to SEQ ID NO: 138754
  derived and/or modified sequence opt3 from neuraminidase__InfluenzaA__AFN18841

SEQ ID NO: 144874 - RNA, 1410 nt, Artificial Sequence
  derived and/or modified sequence opt3 from neuraminidase__InfluenzaA__AFN18851
augaaccccaaucagaagaucauuaccauaggcagcgugugcaugacaaucgggauggccaaccugauucuccaaaucggaaauaugauuuccaucuggauaucucacucaauccagcuugguaaccagaaucagauugagacuuguaaccaaagugucaucacguacgaaaauaacaccuggguuaaucagacauaugugaacauuagcaauacuaacuucgcugcaggccaguccguagugucugucaaacuggccggaaauucgucauugugcccugugagcggaugggcgaucuacaguaaggacaacuccauaagaauuggcucuaaaggugauguuuuugugaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggucccaucucccuacaacucccguuuugaaucaguggccuggagcgcaagugccugccacgacggcauuaauuggcuuacaauagggaucucuggaccugauaacggugcuguagcaguucugaaguauaauggcauuaucaccgacacgauaaaguccuggagaaacaauauuuugaggacucaagagagcgagugugccugcgugaacgggucguguuucaccgucaugacagauggaccaucugacggccaggcuuccuacaaaaucuuucggaucgaaaaggguaaaauugugaagucaguggagaugaaugcccccaacuaucauuacgaagagugcaguuguuacccugauagcuccgagaucacuugcgucugccgcgacaauuggcacgggucuaacagaccauggguuagcuucaaucagaaccucgaauaucagauuggauacauauguucaggcaucuuuggcgauaauccgaggcccaacgacaaaaccgggaguugcggaccuguguccagcaauggugcgaacggcguaaagggguucucuuuuaaguauggaaacggcguguggauuggucggacaaaaucaaucaguagccgcaauggguucgagaugaucugggauccaaacggcuggaccggaacggacaauaacuuuuccauuaagcaagacauagucggcaucaaugaauggucuggguacucggggagcuucgugcagcaucccgagcugacuggucuggauuguauucgaccuugcuucuggguugaacucaucagaggcaggccaaaagagaacacaauuuggaccuccgggucaaguaucucuuuuuguggagugaauagcgacacugucggcugguccuggcccgauggugcagaguuaccguucacaauagacaaguga

SEQ ID NO: 144875 - RNA, 1410 nt, Artificial Sequence; identical to SEQ ID NO: 138754
  derived and/or modified sequence opt3 from neuraminidase__InfluenzaA__AFN18857

SEQ ID NO: 144876 - RNA, 1410 nt, Artificial Sequence
  derived and/or modified sequence opt3 from neuraminidase__InfluenzaA__AFN18859
augaaccccaaucagaagaucauuaccauaggcagcgugugcaugacaaucgggcuggccaaccucauucuucaaaucggaaauauuaucuccauauggaucucucacucaauucagcuggguaaccagaaucagaucgagacuuguaaccaaagugucauuacguacgaaaauaacaccuggguuaaucagacauaugugaacaucagcaauacuaacuucgcugcaggccaguccguagugucugucaaauuggccggaaauucgucauuaugcccugugagcggaugggcgauauacaguaaggacaacuccauuagaaucggcucuaaaggugauguuuuugugauuagggagccauucaucagcuguuccccgcuggaaugccggaccuuuuuccuaacacagggggcucuccugaaugacaagcauucaaacggaaccaucaaagaucgcagucccuaucgaacucuuaugagcuguccuauuggcgaggucccaucucccuacaacucccguuuugaaucaguggccuggagcgcaagugccugccacgacggcauaaauuggcugacaaucgggauuucuggaccugauaacggugcuguagcaguuuugaaguauaauggcaucauaaccgacacgauuaaguccuggagaaacaauauccucaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccuggaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucucgauuguauccgaccuugcuucuggguugaauuaauuagaggcaggccaaaagagaacacaaucuggaccuccgggucaaguauaucuuuuuguggagugaauagcgacacugucggcugguccuggcccgauggugcagagcugccguucacaaucgacaaguga

SEQ ID NO: 144877 - RNA, 1410 nt, Artificial Sequence
  derived and/or modified sequence opt3 from neuraminidase__InfluenzaA__AFN18861
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcagcgugaguggaugggcgauauacuccaaggacaacucuauuagaaucggcagcaaaggugauguuuuugugauuagggagccuuucaucuccuguucaccauuagaaugccggaccuuuuuccugacacagggggcucuacucaaugacaagcauaguaacggaaccaucaaagaucgcagcccguaucgaacucugaugucuugucccauuggcgaggucccuuccccauacaacucacguuuugaaagcguggccuggagugcaucugccugccacgacggcauaaauuggcuuacaaucgggauuuccggacccgauaacggugcuguagcaguucugaaguauaauggcaucauaaccgacacgauuaagagcuggagaaacaauaucuugaggacucaagagucggagugugccugcgugaacgggucuuguuucaccgucaugacagauggaccuuccgacggccaggcuucauacaaaaucuuucggauugaaaaggguaaaaucgugaagaguguggagaugaaugccccaaacuaucauuacgaagagugcagcuguuaccccgauuccucugagauuacuugcgucugccgcgacaauuggcacgggagcaacagaccuuggguuucauucaaucagaaccucgaauaucagauaggauacaucuguaguggcauuuuuggcgauaauccaaggccgaacgacaaaaccggguccugcggacccgugagcucuaauggugcgaacggcguaaagggguucucauuuaaguauggaaacggcguguggaucggucggacaaaaaguaucagcucccgcaauggguucgagaugauuugggauccuaacggcuggaccggaacggacaauaacuuuucuauaaagcaagacaucgucggcauuaaugaauggucgggguacagcggauccuucgugcagcauccagagcugacuggucuggauuguauccgacccugcuucuggguugaacucauuagaggcaggccuaaagagaacacaaucuggaccucagggaguucuauaucguuuuguggagucaauuccgacacugugggcuggucauggccagauggugcagaguuacccuucacaaucgacaaguga

SEQ ID NO: 144878 - RNA, 1410 nt, Artificial Sequence; identical to SEQ ID NO: 138754
  derived and/or modified sequence opt3 from neuraminidase__InfluenzaA__AFN18867

SEQ ID NO: 144879 - RNA, 1410 nt, Artificial Sequence; identical to SEQ ID NO: 140568
  derived and/or modified sequence opt3 from neuraminidase__InfluenzaA__AFN18877

SEQ ID NO: 144880 - RNA, 1410 nt, Artificial Sequence; identical to SEQ ID NO: 138754
  derived and/or modified sequence opt3 from neuraminidase__InfluenzaA__AFN18887

SEQ ID NO: 144881 - RNA, 1410 nt, Artificial Sequence; identical to SEQ ID NO: 139772
  derived and/or modified sequence opt3 from neuraminidase__InfluenzaA__AFN18893

SEQ ID NO: 144882 - RNA, 1410 nt, Artificial Sequence
  derived and/or modified sequence opt3 from neuraminidase__InfluenzaA__AFN18895
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauauaggauaggauacaucuguucaggcauuuuuggcgauaauccgcggcccaacgacaaaaccgggaguugcggaccuguguccagcaauggugcgaacggcguaaagggguucucuuuuaaguauggaaacggcguguggaucggucgcacaaaaucaaucaguagccgaaauggguucgagaugauuugggauccaaacggcuggaccggaacggacaauaacuuuuccauaaagcaggacaucgucggcauuaaugaauggucuggguacucggggagcuucgugcaacaucccgagcugacuggucuggauuguaucagaccuugcuucuggguugaacucauuaaaggcaggccaaaggagaacacaaucuggaccuccgggucaaguauaucuuuuuguggagugaauagcgacacugucggcugguccuggcccgauggugcagaguuaccguucacaaucgacaaauga

SEQ ID NO: 144883 - RNA, 1410 nt, Artificial Sequence; identical to SEQ ID NO: 140656
  derived and/or modified sequence opt3 from neuraminidase__InfluenzaA__AFN18905

SEQ ID NO: 144884 - RNA, 1410 nt, Artificial Sequence; identical to SEQ ID NO: 140568
  derived and/or modified sequence opt3 from neuraminidase__InfluenzaA__AFN18913

SEQ ID NO: 144885 - RNA, 1410 nt, Artificial Sequence
  derived and/or modified sequence opt3 from neuraminidase__InfluenzaA__AFN18919
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugagaacggcguaaagggguucucuuuuaaguauggaaacggcguguggaucggucggacaaaaucaaucaguagccgcaauggguucgaaaugauuugggauccaaacggcuggaccggaacggacaauaacuuuuccauaaagcaagacaucgucggcauuaaugaguggucuggguacucggggagcuucgugcagcaucccgaacugacuggucuggauuguauccgaccuugcuucuggguugagcucauuagaggcaggccaaaagagaacacaaucuggaccuccgggucaaguauaucuuuuuguggagugaauagcgacacugucggcugguccuggcccgauggugcggaauuaccguucacaaucgacaaguga

SEQ ID NO: 144886 - RNA, 1410 nt, Artificial Sequence
  derived and/or modified sequence opt3 from neuraminidase__InfluenzaA__AFN18929
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucacccucaugacagauggaccaucugacggccaggcuuccuacaaaaucuuucggauugaaaaggguaaaaucgucaagucaguggagaugaaugcccccaacuaucauuacgaagagugcaguuguuacccugauagcuccgagauuacuugcgugugccgcgacaauuggcacgggucuaacagaccaugggucagcuucaaucagaaccuggaauaucagauaggauacaucuguucaggcauuuuuggcgauaauccgaggcccaacgacaaaaccgggaguugcggaccuguuuccagcaauggugcgaacggcgugaagggguucucuuuuaaguauggaaacggcguauggaucggucggacaaaaucaaucaguagccgcaauggguucgagaugauuugggauccaaacggcuggaccggaacggacaauaacuuuuccauaaagcaagacaucgugggcauuaaugaauggucuggguacucggggagcuucguccagcaucccgagcugacuggucucgauuguauccgaccuugcuucuggguggaauuaauuagaggcaggccaaaagagaacacaaucuggaccuccgggucaaguauaucuuuuuguggaguuaauagcgacacugugggcugguccuggucagauggugcagagcugcccuucacaaucgacaaguga

SEQ ID NO: 144887 - RNA, 1410 nt, Artificial Sequence; identical to SEQ ID NO: 138754
  derived and/or modified sequence opt3 from neuraminidase__InfluenzaA__AFN18939

SEQ ID NO: 144888 - RNA, 1410 nt, Artificial Sequence; identical to SEQ ID NO: 138754
  derived and/or modified sequence opt3 from neuraminidase__InfluenzaA__AFN18953

SEQ ID NO: 144889 - RNA, 1410 nt, Artificial Sequence; identical to SEQ ID NO: 138754
  derived and/or modified sequence opt3 from neuraminidase__InfluenzaA__AFN18959

SEQ ID NO: 144890 - RNA, 1410 nt, Artificial Sequence; identical to SEQ ID NO: 138754
  derived and/or modified sequence opt3 from neuraminidase__InfluenzaA__AFN18965

SEQ ID NO: 144891 - RNA, 1410 nt, Artificial Sequence; identical to SEQ ID NO: 142824
  derived and/or modified sequence opt3 from neuraminidase__InfluenzaA__AFN18975

SEQ ID NO: 144892 - RNA, 1410 nt, Artificial Sequence; identical to SEQ ID NO: 138754
  derived and/or modified sequence opt3 from neuraminidase__InfluenzaA__AFN18981

SEQ ID NO: 144893 - RNA, 1410 nt, Artificial Sequence
  derived and/or modified sequence opt3 from neuraminidase__InfluenzaA__AFN18983
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugccaguaacuaucauuacgaagagugcagcuguuaccccgauuccucugagauuacuugcgucugccgcgacaauuggcacgggagcaacagaccuuggguuucauucaaucagaaccucgaauaucagauaggauacaucuguaguggcauuuuuggcgauaauccaaggccgaacgacaaaaccggguccugcggacccgugagcucuaauggugcgaacggcguaaagggguucucauuuaaguauggaaacggcguguggaucggucggacaaaaaguaucagcucccgcaauggguucgagaugauuugggauccuaacggcuggaccggaacggacaauaacuuuucuauaaagcaagacaucgucggcauuaaugaauggucgggguacagcggauccuucgugcagcauccagagcugacuggucuggauuguauccgacccugcuucuggguugaacucauuagaggcaggccuaaagagaacacaaucuggaccucagggaguauaaucucuuuuuguggagugaauagcgacacugucggcugguccuggccagauggugcagaguuacccuucacaauugacaaguga

SEQ ID NO: 144894 - RNA, 1410 nt, Artificial Sequence; identical to SEQ ID NO: 138754
  derived and/or modified sequence opt3 from neuraminidase__InfluenzaA__AFN18985

SEQ ID NO: 144895 - RNA, 1410 nt, Artificial Sequence
  derived and/or modified sequence opt3 from neuraminidase__InfluenzaA__AFN18987
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaucgacaaaaccgggaguugcggaccuguguccagcaacggugcgaauggcguaaagggguucucuuuuaaguauggaaacggcguguggaucggucggacaaaaucaauuaguagccgcaacggguucgagaugauaugggauccaaauggcuggaccggaacggacaacaauuuuuccaucaagcaagacauugucggcaucaacgaauggucuggguacucggggagcuucgugcagcaucccgagcugacuggucuggauuguauucgaccuugcuucuggguugaacucaucagaggcaggccaaaagagaauacaauauggaccuccgggucaaguaucucuuuuuguggagugaacagcgacacugucggcugguccuggcccgauggugcagaguuaccguucacaauugacaaguga

SEQ ID NO: 144896 - RNA, 1410 nt, Artificial Sequence; identical to SEQ ID NO: 138754
  derived and/or modified sequence opt3 from neuraminidase__InfluenzaA__AFN18989

SEQ ID NO: 144897 - RNA, 1410 nt, Artificial Sequence; identical to SEQ ID NO: 138754
  derived and/or modified sequence opt3 from neuraminidase__InfluenzaA__AFN18995

SEQ ID NO: 144898 - RNA, 1410 nt, Artificial Sequence; identical to SEQ ID NO: 144876
  derived and/or modified sequence opt3 from neuraminidase__InfluenzaA__AFN19001

SEQ ID NO: 144899 - RNA, 1410 nt, Artificial Sequence; identical to SEQ ID NO: 138754
  derived and/or modified sequence opt3 from neuraminidase__InfluenzaA__AFN19007

SEQ ID NO: 144900 - RNA, 1410 nt, Artificial Sequence; identical to SEQ ID NO: 138754
  derived and/or modified sequence opt3 from neuraminidase__InfluenzaA__AFN19024

SEQ ID NO: 144901 - RNA, 1410 nt, Artificial Sequence
  derived and/or modified sequence opt3 from neuraminidase__InfluenzaA__AFN19025
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaaaaucuugaggacucaagagagcgagugugccugcgugaaugggucguguuucaccgucaugacagauggaccaucugacggccaggcuuccuacaagaucuuucggauugaaaaagguaagaucgugaaaucaguggagaugaacgcccccaauuaucauuacgaagagugcaguuguuacccugauagcuccgagauuacuugcgucugccgcgacaacuggcacgggucuaauagaccauggguuagcuucaaccagaaucucgaauaucagauaggauacaucuguucaggcauuuuuggcgauaacccgaggcccaaugacaagaccgggaguugcggaccuguguccagcaacggugcgaauggcguaaagggguucucuuuuaaauauggaaacggcguguggaucggucggacaaagucaaucaguagccgcaacggguucgagaugauuugggauccaaauggcuggaccggaacggacaacaauuuuuccauaaaacaagacaucgucggcauuaacgaauggucuggguacucggggagcuucgugcagcaucccgagcugacuggucuggauuguauccgaccuugcuucuggguugaacucauuagaggcaggccaaaggagaauacaaucuggaccuccgggucaaguauaucuuuuuguggagugaacagcgacacugucggcugguccuggcccgauggugcagaguuaccguucacaaucgacaaauga

SEQ ID NO: 144902 - RNA, 1410 nt, Artificial Sequence; identical to SEQ ID NO: 138754
  derived and/or modified sequence opt3 from neuraminidase__InfluenzaA__AFN19027

SEQ ID NO: 144903 - RNA, 1410 nt, Artificial Sequence; identical to SEQ ID NO: 138754
  derived and/or modified sequence opt3 from neuraminidase__InfluenzaA__AFN19032

SEQ ID NO: 144904 - RNA, 1410 nt, Artificial Sequence; identical to SEQ ID NO: 138754
  derived and/or modified sequence opt3 from neuraminidase__InfluenzaA__AFN19038

SEQ ID NO: 144905 - RNA, 1410 nt, Artificial Sequence; identical to SEQ ID NO: 144387
  derived and/or modified sequence opt3 from neuraminidase__InfluenzaA__AFN19049

SEQ ID NO: 144906 - RNA, 1410 nt, Artificial Sequence; identical to SEQ ID NO: 138754
  derived and/or modified sequence opt3 from neuraminidase__InfluenzaA__AFN19055

SEQ ID NO: 144907 - RNA, 1410 nt, Artificial Sequence; identical to SEQ ID NO: 138754
  derived and/or modified sequence opt3 from neuraminidase__InfluenzaA__AFN19065

SEQ ID NO: 144908 - RNA, 1410 nt, Artificial Sequence; identical to SEQ ID NO: 138754
  derived and/or modified sequence opt3 from neuraminidase__InfluenzaA__AFN19071

SEQ ID NO: 144909 - RNA, 1410 nt, Artificial Sequence; identical to SEQ ID NO: 138754
  derived and/or modified sequence opt3 from neuraminidase__InfluenzaA__AFN19077

SEQ ID NO: 144910 - RNA, 1410 nt, Artificial Sequence; identical to SEQ ID NO: 138754
  derived and/or modified sequence opt3 from neuraminidase__InfluenzaA__AFN19083

SEQ ID NO: 144911 - RNA, 1410 nt, Artificial Sequence; identical to SEQ ID NO: 138754
  derived and/or modified sequence opt3 from neuraminidase__InfluenzaA__AFN19089

SEQ ID NO: 144912 - RNA, 1410 nt, Artificial Sequence; identical to SEQ ID NO: 138754
  derived and/or modified sequence opt3 from neuraminidase__InfluenzaA__AFN19099

SEQ ID NO: 144913 - RNA, 1410 nt, Artificial Sequence; identical to SEQ ID NO: 138754
  derived and/or modified sequence opt3 from neuraminidase__InfluenzaA__AFN19105

SEQ ID NO: 144914 - RNA, 1410 nt, Artificial Sequence; identical to SEQ ID NO: 138754
  derived and/or modified sequence opt3 from neuraminidase__InfluenzaA__AFN19114

SEQ ID NO: 144915 - RNA, 1410 nt, Artificial Sequence; identical to SEQ ID NO: 138754
  derived and/or modified sequence opt3 from neuraminidase__InfluenzaA__AFN19126

SEQ ID NO: 144916 - RNA, 1410 nt, Artificial Sequence; identical to SEQ ID NO: 138754
  derived and/or modified sequence opt3 from neuraminidase__InfluenzaA__AFN19136

SEQ ID NO: 144917 - RNA, 1410 nt, Artificial Sequence; identical to SEQ ID NO: 138754
  derived and/or modified sequence opt3 from neuraminidase__InfluenzaA__AFN19146

SEQ ID NO: 144918 - RNA, 1410 nt, Artificial Sequence; identical to SEQ ID NO: 138754
  derived and/or modified sequence opt3 from neuraminidase__InfluenzaA__AFN19156

SEQ ID NO: 144919 - RNA, 1410 nt, Artificial Sequence; identical to SEQ ID NO: 138754
  derived and/or modified sequence opt3 from neuraminidase__InfluenzaA__AFN19166

SEQ ID NO: 144920 - RNA, 1410 nt, Artificial Sequence; identical to SEQ ID NO: 138754
  derived and/or modified sequence opt3 from neuraminidase__InfluenzaA__AFN19186

SEQ ID NO: 144921 - RNA, 1410 nt, Artificial Sequence; identical to SEQ ID NO: 144387
  derived and/or modified sequence opt3 from neuraminidase__InfluenzaA__AFN19196

SEQ ID NO: 144922 - RNA, 1410 nt, Artificial Sequence; identical to SEQ ID NO: 138754
  derived and/or modified sequence opt3 from neuraminidase__InfluenzaA__AFN19205

SEQ ID NO: 144923 - RNA, 1410 nt, Artificial Sequence; identical to SEQ ID NO: 138754
  derived and/or modified sequence opt3 from neuraminidase__InfluenzaA__AFN19215

SEQ ID NO: 144924 - RNA, 1410 nt, Artificial Sequence; identical to SEQ ID NO: 138754
  derived and/or modified sequence opt3 from neuraminidase__InfluenzaA__AFN19225

SEQ ID NO: 144925 - RNA, 1410 nt, Artificial Sequence; identical to SEQ ID NO: 138754
  derived and/or modified sequence opt3 from neuraminidase__InfluenzaA__AFN19235

SEQ ID NO: 144926 - RNA, 1410 nt, Artificial Sequence; identical to SEQ ID NO: 138754
  derived and/or modified sequence opt3 from neuraminidase__InfluenzaA__AFN19245

SEQ ID NO: 144927 - RNA, 1410 nt, Artificial Sequence; identical to SEQ ID NO: 138754
  derived and/or modified sequence opt3 from neuraminidase__InfluenzaA__AFN19251

SEQ ID NO: 144928 - RNA, 1410 nt, Artificial Sequence; identical to SEQ ID NO: 138754
  derived and/or modified sequence opt3 from neuraminidase__InfluenzaA__AFN19261

SEQ ID NO: 144929 - RNA, 1410 nt, Artificial Sequence; identical to SEQ ID NO: 144387
  derived and/or modified sequence opt3 from neuraminidase__InfluenzaA__AFN19271

SEQ ID NO: 144930 - RNA, 1410 nt, Artificial Sequence; identical to SEQ ID NO: 140485
  derived and/or modified sequence opt3 from neuraminidase__InfluenzaA__AFN19281

SEQ ID NO: 144931 - RNA, 1410 nt, Artificial Sequence
  derived and/or modified sequence opt3 from neuraminidase__InfluenzaA__AFN19287
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucucagacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccgucaugacagauggaccauccgacggccaggcuucauacaaaaucuuucggauugaaaaggguaaaaucgugaagaguguggagaugaacgcccccaauuaucauuacgaagagugcagcuguuacccugauuccucugagauuacuugcgucugccgcgacaacuggcacgggagcaauagaccauggguuucauucaaccagaaucucgaauaucagauaggauacaucuguaguggcauuuuuggcgauaacccgaggcccaaugacaaaaccggguccugcggaccugugagcucuaacggugcgaauggcguaaagggguucucauuuaaguauggaaacggcguguggaucggucggacaaaaaguaucagcucccgcaacggguucgagaugauuugggauccaaauggcuggaccggaacggacaacaauuuuucuauaaagcaagacaucgucggcauuaacgaauggucgggguacagcggauccuucgugcagcaucccgagcugacuggucuggauuguauccgaccuugcuucuggguugaacucauuagaggcaggccaaaagagaauacaaucuggaccucagggaguucuauaucguuuuguggagugaacuccgacacugucggcuggucauggcccgauggugcagaguuaccguucacaaucgacaaguga

SEQ ID NO: 144932 - RNA, 1410 nt, Artificial Sequence; identical to SEQ ID NO: 138754
  derived and/or modified sequence opt3 from neuraminidase__InfluenzaA__AFN19297

SEQ ID NO: 144933 - RNA, 1410 nt, Artificial Sequence; identical to SEQ ID NO: 138754
  derived and/or modified sequence opt3 from neuraminidase__InfluenzaA__AFN19307

SEQ ID NO: 144934 - RNA, 1410 nt, Artificial Sequence; identical to SEQ ID NO: 138754
  derived and/or modified sequence opt3 from neuraminidase__InfluenzaA__AFN19317

SEQ ID NO: 144935 - RNA, 1410 nt, Artificial Sequence; identical to SEQ ID NO: 144387
  derived and/or modified sequence opt3 from neuraminidase__InfluenzaA__AFN19327

SEQ ID NO: 144936 - RNA, 1410 nt, Artificial Sequence; identical to SEQ ID NO: 138754
  derived and/or modified sequence opt3 from neuraminidase__InfluenzaA__AFN19346

SEQ ID NO: 144937 - RNA, 1410 nt, Artificial Sequence
  derived and/or modified sequence opt3 from neuraminidase__InfluenzaA__AFN19352
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauaugaccgaaauuguguauuugacaaacaccacuaucgagaaggaaauuugccccaaaccugcugaguacaggaauuggaguaagccacagugugacaucacaggguucgcacccuuuagcaaagauaacuccauacgguuaucugccggaggugacauuuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcaucgcuuggagcaguuccucuugucaugacgguaaggccugguugcacgucugcauuacaggggaugacaagaacgcaaccgccagcuucaucuacaauggaaggcucguggauuccguaguuucauggaguaaagagauccugcggacgcaggaaagcgagugugugugcauuaacggcacuuguacagucgugaugaccgacggcucugcuuccgggaaggcagauacuaaaauacuguuuaucgaggaaggaaagauugugcauacaucaacccucagcgguagugcccaacacgucgaggaaugcucuugcuauccacgcuacccgggcguuagaugugugugcagggacaacuggaagggguccaaucggcccaucguagauauaaacauuaaagaccacagcaucgugucgucuuacgucuguuccggauuagugggcgacacgccucgcaagaaugauucaaguagcuccggucauugccuggacccaaacaaugaggaagggggacacggcguuaaaggcugggcuuucgaugacgggaacgauguguggaugggacgaaccaucaaugagacaucuagacuugguuaugagacuuuuaaggucauugaaggcuggagcaaccccaaaucaaaguugcagaucaauaggcaagugauuguagaccggagugaucguuccggguacagcggaauauucucuguugagggcaaaucauguaucaaccgcugcuuuuauguggaacugauuagagguaggaaggaggaaaccgagguccuauggacaaguaauagcaucguggucuucugugggacuuccggcaccuacggaacaggcucuuggccugacggggccgaucucaaccugaugccaaucuga

SEQ ID NO: 144938 - RNA, 1410 nt, Artificial Sequence
  derived and/or modified sequence opt3 from neuraminidase__InfluenzaA__AFN19354
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccauuaaugagacaagcagacuuggauaugagacuuuuaaggucaucgaagguuggucaaaccccaaaaguaaguugcagauuaauaggcaagugauaguagaccggggcgaucguuccggguacagcggaaucuucucuguugagggcaaaucauguauuaaccgcugcuuuuauguggaacugaucagagguaggaaggaggaaaccgagguccuauggacaaguaauagcaucguggucuucugugggacuuccggcaccuacggaacaggcucuuggccugacggggccgaucucaaccugaugccaauuuga

SEQ ID NO: 144939 - RNA, 1410 nt, Artificial Sequence; identical to SEQ ID NO: 144938
  derived and/or modified sequence opt3 from neuraminidase__InfluenzaA__AFN19356

SEQ ID NO: 144940 - RNA, 1410 nt, Artificial Sequence; identical to SEQ ID NO: 144938
  derived and/or modified sequence opt3 from neuraminidase__InfluenzaA__AFN19358

SEQ ID NO: 144941 - RNA, 1410 nt, Artificial Sequence; identical to SEQ ID NO: 144938
  derived and/or modified sequence opt3 from neuraminidase__InfluenzaA__AFN19360

SEQ ID NO: 144942 - RNA, 1410 nt, Artificial Sequence
  derived and/or modified sequence opt3 from neuraminidase__InfluenzaA__AFN19362
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccauuaaugagacaagcagacuuggauaugagacuuuuaaggucaucgaagguuggucaaaccccaaaaguaaguugcagauuaauaggcaagugauaguagaccggggcgaucguuccggguacagcggaaucuucucuguugagggcaaacgcuguauuaacagaugcuuuuauguggaacugaucaggggucggaaggaggaaaccgagguccuauggacaucaaauaguaucguggucuucugugggacuagcggcaccuacggaacaggcuccuggccugacggggccgaucucaaccugaugccaauuuga

SEQ ID NO: 144943 - RNA, 1410 nt, Artificial Sequence; identical to SEQ ID NO: 144938
  derived and/or modified sequence opt3 from neuraminidase__InfluenzaA__AFN19364

SEQ ID NO: 144944 - RNA, 1410 nt, Artificial Sequence; identical to SEQ ID NO: 141534
  derived and/or modified sequence opt3 from neuraminidase__InfluenzaA__AFN19366

SEQ ID NO: 144945 - RNA, 1410 nt, Artificial Sequence; identical to SEQ ID NO: 144938
  derived and/or modified sequence opt3 from neuraminidase__InfluenzaA__AFN19370

SEQ ID NO: 144946 - RNA, 1410 nt, Artificial Sequence
  derived and/or modified sequence opt3 from neuraminidase__InfluenzaA__AFN19374
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauuaaggaggguaagaucgugcauacaucaacccucagcggcagugcccaacacgucgaagagugcucuugcuauccacgcuacccggggguuagaugugugugcagggauaacuggaaaggauccaaucggcccauaguagacauuaacaucaaggaucacagcaucgugucgucuuacgucuguuccggcuuagugggugacacgccucgcaaaaccgacucaaguagcuccucucauugccuggauccaaauaacgaagaagggggacacggcguuaagggcugggcuuucgacgaugggaaugacguguggaugggacgaacaauuaacgagacuagcagacuugguuaugagaccuuuaaagucaucgagggcuggucaaaucccaagaguaaauugcagauuaacaggcaagugauaguagaucguggggaccgguccggauacagcggcaucuucucuguugaagguaagucauguauuaaucgcugcuuuuauguggagcugaucagagggaggaaggaagagacagaaguccuauggaccaguaacagcaucguggucuucuguggcacuuccggaacauacggcaccgggucuuggccugauggagccgaccucaaucugaugccaauuuga

SEQ ID NO: 144947 - RNA, 1410 nt, Artificial Sequence; identical to SEQ ID NO: 144938
  derived and/or modified sequence opt3 from neuraminidase__InfluenzaA__AFN19376

SEQ ID NO: 144948 - RNA, 1410 nt, Artificial Sequence; identical to SEQ ID NO: 144938
  derived and/or modified sequence opt3 from neuraminidase__InfluenzaA__AFN19378

SEQ ID NO: 144949 - RNA, 1410 nt, Artificial Sequence
  derived and/or modified sequence opt3 from neuraminidase__InfluenzaA__AFN19380
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccuagugaguacaggaauuggagcaagccacagugugacauaacaggguucgcucccuuuuccaaagauaacucuauucgguuaucggcaggaggugacaucuggguaacccgcgagccuuaugugucaugcgauccagacaaguguuaccaauucgcccugggccaggggacgacucuaaauaacguccauagcaauaacaccgugcgagaucguacacccuauagaacucuccugaugaaugaacuuggaguuccuuuucaccugggcaccaaacaggugugcauugcguggaguuccucuagcugucaugacgguaaggcuugguugcacgucugcaucacaggggaugacaagaacgccaccgcauccuucaucuacaauggaaggcucguggauucaguaguuaguuggagcaaagagauucugcggacgcaggaaucugagugugugugcauaaacggcacuuguacagucgugaugaccgacggcuccgccucagggaaggcugauacuaaaauccuguuuauugaggaaggaaagaucgugcauacaagcacccucagugguucugcacaacacgucgaggaaugcuccugcuauccacgcuacccgggcguuagaugugugugcagggacaacuggaaggggagcaaucggcccauaguagauauuaacaucaaagaccacucgaucgugucuuccuacgucuguucaggauuagugggcgacacgccucgcaagaaugauaguagcuccucuagccauugccuggacccaaacaaugaggaaggugggcacggaguuaaaggcugggccuucgaugacggcaacgauguguggauggggcgaaccauuaaugagacaucaagacuuggauaugagacuuuuaaggucaucgaagguuggaguaaccccaaauccaaguugcagauuaauaggcaagugauaguagaccggggcgaucguagcggguacucuggaaucuucucaguugagggcaaaaguuguauuaaccgcugcuuuuauguggaacugaucagagguaggaaggaggaaaccgagguccuauggacaagcaauuccaucguggucuucugugggacuucuggcaccuacggaacaggcucguggccugacggggcugaucucaaccugaugccaauuuga

SEQ ID NO: 144950 - RNA, 1410 nt, Artificial Sequence; identical to SEQ ID NO: 144946
  derived and/or modified sequence opt3 from neuraminidase__InfluenzaA__AFN19382

SEQ ID NO: 144951 - RNA, 1410 nt, Artificial Sequence; identical to SEQ ID NO: 144938
  derived and/or modified sequence opt3 from neuraminidase__InfluenzaA__AFN19384

SEQ ID NO: 144952 - RNA, 1410 nt, Artificial Sequence
  derived and/or modified sequence opt3 from neuraminidase__InfluenzaA__AFN19386
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccauuaaugagacaagcagacuuggauaugagacuuuuaaggucaucgaagguuggucaaaccccaaaaguaaguugcagauuaauaggcagauaaucguggaccggggcgaucguuccggguacagcggaauuuucucuguagagggcaaaucauguaucaaccgcugcuuuuauguugaacugaucagagguaggaaggaggaaaccgaggugcuauggacaaguaauagcauugucguguucugugggacuuccggcaccuacggaacaggcucuuggccugacggggccgaucucaaccugaugccaauauga

SEQ ID NO: 144953 - RNA, 1410 nt, Artificial Sequence; identical to SEQ ID NO: 144938
  derived and/or modified sequence opt3 from neuraminidase__InfluenzaA__AFN19388

SEQ ID NO: 144954 - RNA, 1410 nt, Artificial Sequence; identical to SEQ ID NO: 144938
  derived and/or modified sequence opt3 from neuraminidase__InfluenzaA__AFN19390

SEQ ID NO: 144955 - RNA, 1410 nt, Artificial Sequence
  derived and/or modified sequence opt3 from neuraminidase__InfluenzaA__AFN19392
augaaccccaaucagaagaucauuaccauaggcagcgugucccugacaaucucuacuauuugcuucuuuaugcaaaucgccguccucauuacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaaccugcugaguacaggaauuggaguaagccacagugugacaucacaggguucgcacccuuuagcaaagauaacuccauacgguuaucugccggaggugacauuugggugacccgcgagccuuaugucucgugcgauccagacaaguguuaccaauucgcgcugggccaggggacgacucuaaauaacgugcauucaaauaacaccguucgagaucguacacccuauagaacucuccugaugaaugaacuuggagugccuuuucaccugggcaccaagcaggucugcaucgcuuggagcaguuccucuugucaugacgguaaagccugguugcacgugugcauuacaggggaugacaagaacgcaaccgccagcuucaucuacaauggaaggcucguagauuccguugugucauggaguaaagagauccugcggacgcaggaaagcgagugugucugcauuaacggcacuuguacaguggugaugaccgacggcucugcuuccgggaaggcagauacuaaaauacuguuuaucgaggaaggaaagauuguccauacaucaacccucagcgguagugcccaacacguugaggaaugcucuugcuauccacgcuacccgggcgugagauguguaugcagggacaacuggaagggguccaaucggcccaucguggauauaaacauuaaagaccacagcaucgucucgucuuacguguguuccggauuaguuggcgacacgccucgcaagaaugauucaaguagcuccucucauugccuggacccaaacaaugaggaaggugggcacggagugaaaggcugggcuuucgaugacggcaacgaugucuggauggggcgaaccaucaaugagacaagcagacuuggauaugagacuuuuaaggugauugaagguuggucaaaccccaaaaguaaguugcagaucaauaggcagguaauuguugaccggggcgaucguuccggguacagcggaauauucucuguggagggcaaaucauguaucaaccgcugcuuuuaugucgaacugauuagagguaggaaggaggaaaccgaggugcuauggacaaguaauagcaucgucguguucugugggacuuccggcaccuacggaacaggcucuuggccugacggggccgaucucaaccugaugccaaucuga

SEQ ID NO: 144956 - RNA, 1410 nt, Artificial Sequence; identical to SEQ ID NO: 143803
  derived and/or modified sequence opt3 from neuraminidase__InfluenzaA__AFN19394

SEQ ID NO: 144957 - RNA, 1410 nt, Artificial Sequence
  derived and/or modified sequence opt3 from neuraminidase__InfluenzaA__AFN19396
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagacauucugcggacgcaggagagcgaaugugugugcauaaacggcacuugugcugucgugaugacagauggcucugcauccgggaaggccgacaccaaaauccucuuuauugaggagggaaagaucgugcauacuucaacauuaagcgguagugcucaacacgucgaagagugcucuugcuauccucgcuacccaggcguuagaugugugugcagggauaacuggaagggguccaaucggccgauaguagacauuaacaucaaagaccacagcaucgugucgucuuacgucuguuccggacuggugggcgauacccccaggaagaaugacucaaguagcuccucucauugccuugauccuaacaaugaagagggugggcacggaguuaaaggcugggccuucgacgauggcaacgacguguggauggggcgaacgauuaaugaaaccagcagauugggauaugagacauuuaaggucaucgaggguuggucaaacccaaaaaguaagcugcagauuaaucgccaggugauaguagaucggggcaaccguuccggguacagcggaaucuucucuguugaaggcaaaaauuguauuaaccgcugcuuuuauguggagcuaaucagagguaggaaggaagagacugaaguccucuggaccucaaauaguaucguggucuucugugggacaagcggcacuuacggaaccggcuccuggcccgacggggcggaucugaaccuuaugccuauuuga

SEQ ID NO: 144958 - RNA, 1410 nt, Artificial Sequence
  derived and/or modified sequence opt3 from neuraminidase__InfluenzaA__AFN19398
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggcggggguccaaucgccccauaguagauauuaacaucaaggaccacagcaucgugucgucuuacgucuguuccggauuagugggcgacacgccucggaaaaaugauucaaguagcuccucucauugccuggacccaaacaaugaggaaggugggcacggaguuaagggcugggcuuucgaugacggcaacgauguguggauggggagaaccauuaaugagacaagcaggcuuggauaugagacuuuuaaagucaucgaagguuggucaaaccccaagaguaaauugcagauuaaucgacaggugauaguagaccguggcgaucgcuccggguacagcggaaucuucucuguugagggcaagucauguauuaacagaugcuuuuauguggaacugaucaggggucggaaagaggaaaccgagguccuauggacaaguaauagcaucguggucuucugugggacuuccggcaccuacggaacaggcucuuggccugacggggccgaucucaaccugaugccaauuuga

SEQ ID NO: 144959 - RNA, 1410 nt, Artificial Sequence
  derived and/or modified sequence opt3 from neuraminidase__InfluenzaA__AFN19400
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccuagugaguacaggaauuggagcaagccacagugugacauaacaggguucgcucccuuuuccaaagauaacucuauucgguuaucggacggaggugauaucuggguaacccgcgagccuuaugugucaugcgacccagauaaguguuaccaauucgcacugggccaggggacgacucuaaauaacguccauagcaauaacaccgugcgagaccguacacccuauagaacucuccugaugaaugaacuuggaguuccuuuucaccugggcaccaaacaggugugcauugccuggaguuccucuagcugucaugaugguaaggcgugguugcacgucugcaucacaggggacgauaagaacgcuaccgccuccuucaucuacaauggaaggcucguggacucaguaguuaguuggagcaaagagauucugcggacgcaggaaucugagugugugugcauaaacggcacuuguacagucgugaugaccgauggcuccgcaucagggaaggccgacacuaaaauccuguuuauugaggaaggaaagaucgugcauacaagcacccucagugguucugcucaacacgucgaggaaugcuccugcuauccacgcuacccgggcguuagaugugugugcagggauaacuggaaggggagcaaucggcccauaguagacauuaacaucaaagaccacucgaucgugucuuccuacgucuguucaggauuagugggcgauacgccucgcaagaaugacaguagcuccucuagccauugccuggauccaaacaaugaggaaggugggcacggaguuaaaggcugggcauucgacgauggcaacgacguguggauggggcgaaccauuaaugagacaucaagacuuggauaugagacuuuuaaggucaucgaagguuggaguaaccccaaauccaaguugcagauuaauaggcaagugauaguagaucggggcgaccguagcggguacucuggaaucuucucaguugagggcaaaaguuguauuaaccgcugcuuuuauguggaacugaucagagguaggaaggaggaaaccgagguccuauggacaagcaauuccaucguggucuucugugggacuucuggcaccuacggaacaggcucguggccugauggggccgaccucaaccugaugccaauuuga

SEQ ID NO: 144960 - RNA, 1410 nt, Artificial Sequence; identical to SEQ ID NO: 144938
  derived and/or modified sequence opt3 from neuraminidase__InfluenzaA__AFN19402

SEQ ID NO: 144961 - RNA, 1410 nt, Artificial Sequence; identical to SEQ ID NO: 144938
  derived and/or modified sequence opt3 from neuraminidase__InfluenzaA__AFN19404

SEQ ID NO: 144962 - RNA, 1410 nt, Artificial Sequence; identical to SEQ ID NO: 144938
  derived and/or modified sequence opt3 from neuraminidase__InfluenzaA__AFN19406

SEQ ID NO: 144963 - RNA, 1410 nt, Artificial Sequence; identical to SEQ ID NO: 144938
  derived and/or modified sequence opt3 from neuraminidase__InfluenzaA__AFN19410

SEQ ID NO: 144964 - RNA, 1410 nt, Artificial Sequence; identical to SEQ ID NO: 144938
  derived and/or modified sequence opt3 from neuraminidase__InfluenzaA__AFN19412

SEQ ID NO: 144965 - RNA, 1410 nt, Artificial Sequence; identical to SEQ ID NO: 144938
  derived and/or modified sequence opt3 from neuraminidase__InfluenzaA__AFN19414

SEQ ID NO: 144966 - RNA, 1410 nt, Artificial Sequence; identical to SEQ ID NO: 144938
  derived and/or modified sequence opt3 from neuraminidase__InfluenzaA__AFN19416

SEQ ID NO: 144967 - RNA, 1410 nt, Artificial Sequence
  derived and/or modified sequence opt3 from neuraminidase__InfluenzaA__AFN19418
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggcgcgcagauacuaagauccuguuuauugaggaaggaaaaaucgugcauacaucaacccucagcgguagugcccaacacgucgaggaaugcucuugcuauccaagauacccgggcguuaggugugugugccgggacaacuggaagggguccaaucgccccauaguagauauuaacaucaaggaccacagcaucgugucgucuuacgucuguuccggauuagugggcgacacgccucggaaaaaugauucaaguagcuccucucauugccuggacccaaacaaugaggaaggugggcacggaguuaagggcugggcuuucgaugacggcaacgauguguggauggggagaaccauuaaugagacaagcaggcuuggauaugagacuuuuaaagucaucgaagguuggucaaaccccaagaguaaauugcagauuaaucgacaggugauaguagaccguggcgaucgcuccggguacagcggaaucuucucuguugagggcaagucauguauuaacagaugcuuuuauguggaacugaucaggggucggaaagaggaaaccgagguccuauggacaaguaauagcaucguggucuucugugggacuuccggcaccuacggaacaggcucuuggccugacggggccgaucucaaccugaugccaauuuga

SEQ ID NO: 144968 - RNA, 1410 nt, Artificial Sequence
  derived and/or modified sequence opt3 from neuraminidase__InfluenzaA__AFN19420
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauaugaccgaaauuguguauuugacaaacaccacuaucgagaaggaaauuugccccaaaccugcugaguacaggaauuggaguaagccacagugugacaucacaggguucgcacccuuuagcaaagauaacuccauacgguuaucugccggaggugacauuuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcaucgcuuggagcaguuccucuugucaugacgguaaggccugguugcacgucugcauuacaggggaugacaagaacgcaaccgccagcuucaucuacaauggaaggcucguggauuccguaguuucauggaguaaagagauccugcggacgcaggaaagcgagugugugugcauuaacggcacuuguacagucgugaugaccgacggcucugcuuccgggaaggcagauacuaaaauacuguuuaucgaggaaggaaagauugugcauacaucaacccucagcgguagugcccaacacgucgaggaaugcucuugcuauccacgcuacccgggcguuagaugugugugcagggacaacuggaagggguccaaucggcccaucguagauauaaacauuaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccaucaaugagacaagcagacuuggauaugagacuuuuaaggucauugaagguuggucaaaccccaaaaguaaguugcagaucaauaggcaagugauuguagaccggggcgaucguuccggguacagcggaauauucucuguugagggcaaaucauguaucaaccgcugcuuuuauguggaacugauuagagguaggaaggaggaaaccgagguccuauggacaaguaauagcaucguggucuucugugggacuuccggcaccuacggaacaggcucuuggccugacggggccgaucucaaccugaugccaaucuga

SEQ ID NO: 144969 - RNA, 1410 nt, Artificial Sequence
  derived and/or modified sequence opt3 from neuraminidase__InfluenzaA__AFN19422
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggaaacgacaagaaugcaaccgccagcuucaucuacaacggcaggcucguggauuccguaguuucauggaguaaagaggugcugcggacgcaggaaagcgagugugucugcauuaacggcacuuguacaguggugaugaccgacgggucugcuuccggaaaggcagauacuaaaauacuguuuaucgaggaagguaagauuguccauacaucaacccucagcggcagugcccaacacguugaggaaugcucuugcuauccacgcuacccgggggugagauguguaugcagggacaauuggaagggauccaaccggcccaucguggauauaaauauuaaagaccacagcaucgucucgucuuacguguguuccggcuuaguuggugauacgccucgcaagaacgacucaaguagcuccucucauugccuggacccaaauaacgaggaagggggacacggcgugaaaggcugggcuuucgaugacgggaaugaugucuggaugggacgaaccaucaacgagacaagcagacuugguuaugagacuuuuaaggugauugaaggcuggucaaaucccaaaaguaaguugcagaucaacaggcagguaauuguugaccguggggaucgguccggauacagcggcauauucucuguggaggguaaaucauguaucaaucgcugcuuuuaugucgaacugauuagagggaggaaggaggaaaccgaggugcuauggacaaguaacagcaucgucguguucuguggcacuuccggaaccuacggcacagggucuuggccugacggagccgaucucaaucugaugccaaucuga

SEQ ID NO: 144970 - RNA, 1410 nt, Artificial Sequence
  derived and/or modified sequence opt3 from neuraminidase__InfluenzaA__AFN19426
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacgagaacgcaaccgccagcuucaucuacaauggaaggcucguggauuccguaguuucauggaguaaggaaauucugcggacgcaggagagcgagugugugugcauaaacggcacuuguacagucgugaugaccgacggcucugcuuccgggaaagcagauacuaagauccuguuuauugaagagggaaaaaucgugcauacaucaacccucagcgguagugcccaacacgucgaagagugcucuugcuauccacgcuacccgggcguuagaugugugugcagggacaacuggaagggguccaaucggcccauaguagauauuaacaucaaggaccacagcaucgugucgucuuacgucuguuccggauuagugggcgacacgccucgcaaaaaugauucaaguagcuccucucauugccuggacccaaacaaugaagagggugggcacggaguuaagggcugggcuuucgaugacggcaacgauguguggauggggcgaaccauuaaugagacaagcagacuuggauaugaaacuuuuaaagucaucgaggguuggucaaaccccaagaguaaauugcagauuaauaggcaagugauaguagaccggggcgaucguuccggguacagcggaaucuucucuguugaaggcaagucauguauuaaccgcugcuuuuauguggagcugaucagagguaggaaagaagagaccgagguccuauggacaaguaauagcaucguggucuucugugggacuuccggcaccuacggaacaggcucuuggccugacggggccgaucucaaccugaugccaauuuga

SEQ ID NO: 144971 - RNA, 1410 nt, Artificial Sequence; identical to SEQ ID NO: 144938
  derived and/or modified sequence opt3 from neuraminidase__InfluenzaA__AFN19428

SEQ ID NO: 144972 - RNA, 1410 nt, Artificial Sequence
  derived and/or modified sequence opt3 from neuraminidase__InfluenzaA__AFN19430
augaaccccaaucagaagaucauuaccauaggcagcgugucccugacaaucucuacuauuugcuucuuuaugcagaucgccauucucaucauaacggucacccuucacuucaaacaguacgaguuuaacucaccuccaaauaaccagguuaugcugugugaaccgacaaucauugagagaaauaugacugaaaucguguauuugaccaacacaaccauugagaaggaaaucugccccaaaccugcugaguacaggaauuggaguaagccacagugugacauaacuggguucgcacccuuuagcaaagauaacuccauucgguuaucugccggaggugacaucuggguaacacgcgagccuuaugugucgugcgauccagacaaguguuaccaauucgcgcugggccaggggaccacgcuaaauaacguccauucaaauaacacugugcgagaucguacccccuauagaacacuccugaugaaugaacuuggaguuccuuuucaccugggcacuaaacaggugugcauugcuuggagcaguuccucuugucaugacgguaaggccugguugcacgucugcaucaccggggaugacaagaacgcaacagccagcuucaucuacaauggaaggcucguggauuccguaguuucauggaguaaagagauucugcggacccaggaaagcgagugugugugcauaaacggcacguguacugucgugaugacagacggcucugcuuccgggaaggcagauaccaaaauccuguuuauugaggaaggaaagaucgugcauacuucaacacucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacaccccucgcaagaaugauucaaguagcuccucucauugccuggacccaaacaaugaggaaggugggcacggaguuaaaggcugggcuuucgaugacggcaacgauguguggauggggcgaacgauuaaugagaccagcagacuuggauaugagacauuuaaggucaucgaagguuggucaaaccccaaaaguaaguugcagauuaauaggcaagugauaguagaccgguccgaucguagcggcuacucugggaucuucucaguugagggaaaaaguuguauuaaccgcugcuuuuauguggaacugaucagaggcaggaaggaggaaacugagguccuauggaccagcaauuccaucguggucuucugugguacaucugggacuuacggcaccggaucguggccugacggcgccgaucucaaccugaugccaauuuga

SEQ ID NO: 144973 - RNA, 1410 nt, Artificial Sequence
  derived and/or modified sequence opt3 from neuraminidase__InfluenzaA__AFN19432
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacaccccacagaacucuccugaugaaugaacuuggaguuccuuuucaucugggcaccaaacaggugugcauugcuuggagcaguuccucuugucacgacgguaaggccugguugcaugucugcaucacaggggaugacaagaacgcaaccgccagcuucaucuauaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcacacaucaacccucagcgguagugcccaacacgucgaggaaugcucuugcuacccacgcuauccgggcguuagaugugugugcagggacaacuggaagggguccaaucggcccauaguagauauuaacaucaaagaccauagcaucgugucgucuuacgucuguuccggauuagugggcgacacgccucgcaagaaugauucaaguagcuccucucacugccuggacccaaacaaugaggaaggugggcauggaguuaaaggcugggcuuucgaugacggcaacgauguguggauggggcgaaccauuaaugagacaagcagacuuggauacgagacuuuuaaggucaucgaagguuggucaaaccccaaaaguaaguugcagauuaauaggcaagugauaguagaccggggcgaucguuccggguauagcggaaucuucucuguugagggcaaaucauguauuaaccgcugcuuuuacguggaacugaucagagguaggaaggaggaaaccgagguccuauggacaaguaauagcaucguggucuucugugggacuuccggcaccuauggaacaggcucuuggccugacggggccgaucucaaccugaugccaauuuga

SEQ ID NO: 144974 - RNA, 1410 nt, Artificial Sequence
  derived and/or modified sequence opt3 from neuraminidase__InfluenzaA__AFN19434
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauaugaccgaaauuguguauuugacaaacaccacuaucgagaaggaaauuugccccaaaccugcugaguacaggaauuggaguaagccacagugugacaucacaggguucgcacccuuuagcaaagauaacuccauacgguuaucugccggaggugacauuuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcaucgcuuggagcaguuccucuugucaugacgguaaggccugguugcacgucugcauuacaggggaugacaagaacgcaaccgccagcuucaucuacaauggaaggcucguggauuccguaguuucauggaguaaagagauccugcggacgcaggaaagcgagugugugugcauuaacggcacuuguacagucgugaugaccgacggcucugcuuccgggaaggcagauacuaaaauacuguuuaucgaggaaggaaagauugugcauacaucaacccucagcgguagugcccaacacgucgaggaaugcucuugcuauccacgcuacccgggcguuagaugugugugcagggacaacuggaagggguccaaucggcccaucguagauauaaacauuaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccaucaaugagacaagcagacuuggauaugagacuuuuaaggucauugaagguuggucaaaccccaaaaguaaguugcagaucaauaggcaagugauuguagaccgguccgaucguagcggcuacucugggauauucucaguugagggaaaaaguuguaucaaccgcugcuuuuauguggaacugauuagaggcaggaaggaggaaaccgagguccuauggacaagcaauuccaucguggucuucugugguacuucugggaccuacggcacaggaucguggccugacggcgccgaucucaaccugaugccaaucuga

SEQ ID NO: 144975 - RNA, 1410 nt, Artificial Sequence; identical to SEQ ID NO: 144162
  derived and/or modified sequence opt3 from neuraminidase__InfluenzaA__AFN19436

SEQ ID NO: 144976 - RNA, 1410 nt, Artificial Sequence
  derived and/or modified sequence opt3 from neuraminidase__InfluenzaA__AFN19438
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauaugaccgaaauuguguauuugacaaacaccacuaucgagaaggaaauuugccccaaaccugcugaguacaggaauuggaguaagccacagugugacaucacaggguucgcacccuuuagcaaagauaacuccauacgguuaucugccggaggugacauuuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcaucgcuuggagcaguuccucuugucaugacgguaaggccugguugcacgucugcauuacaggggaugacaagaacgcaaccgccagcuucaucuacaauggaaggcucguggauuccguaguuucauggaguaaagagauccugcggacgcaggaaagcgagugugugugcauuaacggcacuuguacagucgugaugaccgacggcucugcuuccgggaaggcagauacuaaaauacuguuuaucgaggaaggaaagauugugcauacaucaacccucagcgguagugcccaacacgucgaggaaugcucuugcuauccacgcuacccgggcguuagaugugugugcagggacaacuggaagggguccaaucggcccaucguagauauaaacauuaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccaucaaugagacaagcagacuuggauaugagacuuuuaaggucauugaagguuggucaaaccccaaaaguaaguugcagaucaauaggcaagugauuguagaccgguccgaucguagcggcuacucugggauauucucaguugagggaaaaaguuguaucaaccgcugcuuuuauguggaacugauuagaggcaggaaggaggaaaccgagguccuauggacaagcaauuccaucguggucuucugugguacuucugggaccuacggcacaggaucguggccugacggcgccgaucucaaccugaugagcaucuga

SEQ ID NO: 144977 - RNA, 1410 nt, Artificial Sequence
  derived and/or modified sequence opt3 from neuraminidase__InfluenzaA__AFN19442
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccauuaucgagaaggaaauaugccccaaaccuacugaguacaggaauuggaguaagccacagugugacauuacaggguucgcucccuuuagcaaagauaacuccauccgguuaucugcaggaggugacauuuggguaacccgcgagccuuaugugucgugcgauccagacaaguguuaccaauucgcccugggccaggggacgacucuaaauaacguccauucaaauaacaccgugcgagaucguacacccuauagaacucuccugaugaaugaacuuggaguuccuuuucaccugggcaccaaacaggugugcaucgcguggagcaguuccucuugucaugacgguaaggcuugguugcacgucugcaucacaggggaugacaagaacgccaccgccagcuucauuuacaauggaaggcucguggauuccguaguuucauggaguaaagagauacugcggacgcaggaaagcgagugugugugcaucaacggcacuuguacagucgugaugaccgacggcucugcauccgggaaggcugauacuaaaauucuguuuaucgaggaaggaaagauagugcauacaucaacccucagcgguagugcacaacacgucgaggaaugcucuugcuauccacgcuacccgggcguuagaugugugugcagggacaacuggaagggguccaaucggcccauuguagauaucaacaucaaagaccacagcauugugucgucuuacgucuguuccggauuagugggcgacacgccucgcaagaaugauucaaguagcuccucucauugccuggacccaaacaaugaggaaggugggcacggaguuaaaggcugggccuucgaugacggcaacgauguguggauggggcgaaccaucaaugagacaagcagacuuggauaugagacuuuuaaggucauugaagguuggucaaaccccaaaaguaaguugcagauaaauaggcaagugaucguagaccggggcgaucguuccggguacagcggaauuuucucuguugagggcaaaucauguaucaaccgcugcuuuuauguggaacugaucagagguaggaaggaggaaaccgagguccuauggacaaguaauagcauuguggucuucugugggacuuccggcaccuacggaacaggcucuuggccugacggggcugaucucaaccugaugcauauauga

SEQ ID NO: 144978 - RNA, 1410 nt, Artificial Sequence; identical to SEQ ID NO: 144162
  derived and/or modified sequence opt3 from neuraminidase__InfluenzaA__AFN19446

SEQ ID NO: 144979 - RNA, 1410 nt, Artificial Sequence; identical to SEQ ID NO: 144162
  derived and/or modified sequence opt3 from neuraminidase__InfluenzaA__AFN19448

SEQ ID NO: 144980 - RNA, 1410 nt, Artificial Sequence; identical to SEQ ID NO: 144938
  derived and/or modified sequence opt3 from neuraminidase__InfluenzaA__AFN19458

SEQ ID NO: 144981 - RNA, 1410 nt, Artificial Sequence
  derived and/or modified sequence opt3 from neuraminidase__InfluenzaA__AFN19460
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacaugcauucaaauaacaccguccgagaccguacacccuauagaacucuccugaugaaugaacuuggcgugccuuuucaccuggguaccaagcagguuugcauugcuuggagcaguuccucuugucaugaugggaaagccugguugcacgugugcaucacaggagacgauaagaacgcaaccgccagcuucaucuacaauggcaggcucgucgacuccgugguaucauggaguaacgagauucugcggacgcaggaaagcgaguguguuugcauaaacggcacuuguacaguggucaugaccgaugggucugcuuccggaaaagcagacacuaagauccuguuuauugaggaagguaaaaucgugcauacaucaacccucagcggcagugcccaacacguggaggaaugcucuugcuauccacgcuacccgggggucagauguguuugcagggauaauuggaagggauccaaccggcccauaguggacauuaauaucaaggaucacagcaucguaucgucuuacguguguuccggcuuagucggugacacgccucgcaaaaacgacucaaguagcuccucucauugccuggauccaaauaacgaggaagggggacacggcgugaagggcugggcuuucgacgaugggaaugacguuuggaugggacgaaccauuaacgagacaagcagacuugguuaugagacuuuuaaagugaucgaaggcuggucaaaucccaagaguaaauugcagauuaacaggcaggucauaguggaucguggggaccgguccggauacagcggcaucuucucuguagaggguaagucauguauuaaucgcugcuuuuauguugaacugaucagagggaggaaagaggaaaacgaggugcuauggaccaguaauagcaucgucguguucuguggcacauccggaacuuacggcaccgggucuuggccugauggagccgaccucaaccugaugccaauuuga

SEQ ID NO: 144982 - RNA, 1410 nt, Artificial Sequence; identical to SEQ ID NO: 144162
  derived and/or modified sequence opt3 from neuraminidase__InfluenzaA__AFN19462

SEQ ID NO: 144983 - RNA, 1410 nt, Artificial Sequence
  derived and/or modified sequence opt3 from neuraminidase__InfluenzaA__AFN19466
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauagcaggguucgcccccuuuagcaaagauaacuccauucgguuaucugcgggaggugacaucuggguaacacgcgagccuuaugugucgugcgauccagacaaguguuaccaauucgcucugggccaggggaccacgcuaaauaacguccauucaaauaacacugugcgagaucguacccccuauagaacacuccugaugaaugaacuuggaguuccuuuucaccugggcacuaaacaggugugcauugccuggagcaguuccucuugucaugacgguaaggcaugguugcacgucugcaucaccggggaugacaagaacgccacagcuagcuucaucuacaauggaaggcucguggauuccguaguuucauggaguaaagagauucugcggacccaggaaagcgagugugugugcauaaacggcacguguacugucgugaugacagacggcucugcauccgggaaggccgauaccaaaauccuguuuauugaggaaggaaagaucgugcauacuucaacacucagcgguagugcucaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacaccccucgcaagaaugauucaaguagcuccucucauugccuggacccaaacaaugaggaaggugggcacggaguuaaaggcugggccuucgaugacggcaacgauguguggauggggcgaacgauuaaugagaccagcagacuuggauaugagacauuuaaggucaucgaagguuggucaaaccccaaaaguaaguugcagauuaauaggcaagugauaguagaccggggcgaucguuccggguacagcggaaucuucucuguugagggcaaaucauguauuaaccgcugcuuuuauguggaacugaucagagguaggaaggaggaaacugagguccuauggaccaguaauagcaucguggucuucugugggacauccggcacuuacggaaccggcucuuggccugacggggcggaucucaaccugaugccaauuuga

SEQ ID NO: 144984 - RNA, 1410 nt, Artificial Sequence; identical to SEQ ID NO: 144162
  derived and/or modified sequence opt3 from neuraminidase__InfluenzaA__AFN19468

SEQ ID NO: 144985 - RNA, 1410 nt, Artificial Sequence
  derived and/or modified sequence opt3 from neuraminidase__InfluenzaA__AFN19470
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauaugaccgaaauuguguauuugacaaacaccacuaucgagaaggaaauuugccccaaaccugcugaguacaggaauuggaguaagccacagugugacaucacaggguucgcacccuuuagcaaagauaacuccauacgguuaucugccggaggugacauuuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcaucgcuuggagcaguuccucuugucaugacgguaaggccugguugcacgucugcauuacaggggaugacaagaacgcaaccgccagcuucaucuacaauggaaggcucguggauuccguaguuucauggaguaaagagauccugcggacgcaggaaagcgagugugugugcauuaacggcacuuguacagucgugaugaccgacggcucugcuuccgggaaggcagauacuaaaauacuguuuaucgaggaaggaaagauugugcauacaucaacccucagcgguagugcccaacacgucgaggaaugcucuugcuauccacgcuacccgggcguuagaugugugugcagggacaacuggaagggguccaaucggcccaucguagauauaaacauuaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccaucaaugagacaagcagacuuggauaugagacuuuuaaggucauugaagguuggucaaaccccaaaaguaaguugcagaucaauaggcaagugauuguaaacaaauccgaccggagcggcuacucugggauauucucaguugagggaaagaguuguaucaaucguugcuuuuauguggaacugauucgcggcagaaaggaggaaaccgagguccuauggacaagcaacuccaucguggucuucugugguacuucugggaccuacggcacaggaucguggccugauggcgccgaccucaaucugaugccaaucuga

SEQ ID NO: 144986 - RNA, 1410 nt, Artificial Sequence; identical to SEQ ID NO: 144938
  derived and/or modified sequence opt3 from neuraminidase__InfluenzaA__AFN19472

SEQ ID NO: 144987 - RNA, 1410 nt, Artificial Sequence
  derived and/or modified sequence opt3 from neuraminidase__InfluenzaA__AFN19476
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuaagcaaagacaacuccauucggcugucugccgguggcgauaucuggguaacccgcgagccuuaugugucgugcgacccagauaaguguuaccaauuugcgcuagggcagggaacgacucucaauaacguccauucaaauaacaccgugcgagaccguacacccuauagaacucugcuuaugaaugaacugggcguuccuuuccacuuggguaccaaacaggugugcauugcuuggagcaguuccucuugucaugaugggaaggccuggcuccacgucugcaucacaggagacgauaagaacgcaaccgccagcuuuaucuacaauggcaggcugguggacuccguaguuucauggaguaaagagauucugcggacgcaggaaagcgagugugugugcauaaacggcacuuguacagucgugaugaccgaugggucugcuuccggaaaggcagacacuaaaauccucuucauugaggaagguaagaucgugcauacaucaaccuuaagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggccuggugggugacacgccucgcaagaaugacucaaguagcuccucucauugccuugauccaaacaaugaggaagggggacacggcguuaaaggcugggcuuuugacgaugggaacgacguguggaugggacgaaccauuaaugagacaagcagauuggguuaugagacuuucaaggucaucgaaggcuggucaaaccccaaaaguaagcugcagauuaauaggcaagugauaguagaucguggggaccgguccggauacagcggcaucuuuucuguugaggguaaaucauguauuaaccgcugcuucuauguggaacuaaucagagggaggaaggaggaaaccgagguccucuggacaaguaauagcaucguggucuuuuguggcacuuccggaaccuacggcacagggucuuggccugauggagccgaccugaaccuuaugccaauuuga

SEQ ID NO: 144988 - RNA, 1410 nt, Artificial Sequence; identical to SEQ ID NO: 144938
  derived and/or modified sequence opt3 from neuraminidase__InfluenzaA__AFN19478

SEQ ID NO: 144989 - RNA, 1410 nt, Artificial Sequence
  derived and/or modified sequence opt3 from neuraminidase__InfluenzaA__AFN19480
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauaugaccgaaauuguguauuugacaaacaccacuaucgagaaggaaauuugccccaaaccugcugaguacaggaauuggaguaagccacagugugacaucacaggguucgcacccuuuagcaaagauaacuccauacgguuaucugccggaggugacauuuggguaacccgcgagccuuaugugucgugcgauccagacaaguguuaccaauucgcgcugggccaggggacgacucuaaauaacguccauucaaauaacaccgugggagaucgaacacccuaucguacucuccugaugaaugaacuuggcguuccuuuucaccuggguaccaaacaggugugcaucgcuuggagcaguuccucuugucaugacgggaaggccugguugcacgucugcauuacaggagaugacaagaacgcaaccgccagcuucaucuacaauggcagacucguggauuccguaguuucauggaguaaagagauccugaggacgcaggaaagcgagugugugugcauuaacggcacuuguacagucgugaugaccgacgggucugcuuccggaaaggcagauacuaaaauacuguuuaucgaggaagguaagauugugcauacaucaacccucagcggcagugcccaacacgucgaggaaugcucuugcuauccacgguacccggggguucgcugugugugcagagacaacuggaagggauccaauaggcccaucguagauauaaacauuaaagaccacagcaucgugucgucuuacgucuguuccggcuuagugggugacacgccucggaagaaugauucaaguagcuccucucauugccuggacccaaacaaugaggaagggggacacggcguuaaaggcugggcuuucgaugacgggaacgauguguggaugggacgcaccaucaaugagacaagccgacuugguuaugagacuuuuaaggucauugaaggcuggucaaaccccaaaaguaaguugcagaucaauagacaggugauuguagacagguccgaucggagcggguacucuggaauauucucaguugagggcaaaaguuguaucaaccguugcuuuuauguggaacugauucgcgguagaaaggaggaaaccgagguccuauggacaagcaauuccaucguggucuucugugggacuucuggcaccuacggaacaggcucguggccugacggggccgaucucaaccugaugccaaucuga

SEQ ID NO: 144990 - RNA, 1410 nt, Artificial Sequence
  derived and/or modified sequence opt3 from neuraminidase__InfluenzaA__AFN19482
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcuaaguacaggaauuggaguaaaccacagugugacauaacaggguucgcacccuuuagcaaggauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugagcuuggaguuccuuuucaccugggcaccaaacaggugugcauugcuuggagcaguuccucuugucaugacgguaaggccugguugcacgucugcaucacaggggaugacaaaaacgcaaccgccagcuucaucuacaauggaaggcucguggauuccguaguuucauggaguaaggaaauucugcggacgcaggagagcgaaugugugugcauaaacggcacuuguacagucgugaugaccgacggcucugcuuccgggaaagcagauacuaagauccuguuuauugaggagggaaagaucgugcauacaucaacccucagcgguagugcccaacacgucgaagagugcucuugcuauccacgcuacccgggcguuagaugugugugcagggacaacuggaaaggguccaaucggcccauaguagauauuaacaucaaggaccacagcaucgugucgucuuacgucuguuccggauuagugggcgacacgccucgcaaaaaugauucaaguagcuccucucauugccuggacccaaacaaugaagagggugggcacggaguuaagggcugggcuuucgaugacggcaacgauguguggauggggcgaaccauuaaugaaacaagcagacuuggauaugagacuuuuaaagucaucgaggguuggucaaaccccaagaguaaauugcagauuaauaggcaagugauaguagaccgguccgaucguagcggcuacucugggaucuucucaguugaaggaaagaguuguauuaaccgcugcuuuuauguggagcugaucagaggcaggaaggaagagaccgaaguccuauggacaagcaauuccaucguggucuucugugguacuucugggaccuacggcacaggaucguggccugacggcgccgaucucaaccugaugccaauuuga

SEQ ID NO: 144991 - RNA, 1410 nt, Artificial Sequence; identical to SEQ ID NO: 144162
  derived and/or modified sequence opt3 from neuraminidase__InfluenzaA__AFN19484

SEQ ID NO: 144992 - RNA, 1410 nt, Artificial Sequence; identical to SEQ ID NO: 144938
  derived and/or modified sequence opt3 from neuraminidase__InfluenzaA__AFN19488

SEQ ID NO: 144993 - RNA, 1410 nt, Artificial Sequence
  derived and/or modified sequence opt3 from neuraminidase__InfluenzaA__AFN19492
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaaacucguggauuccguaguuucauggaguaaggagauucugaggacgcaggaaagcgagugugugugcauaaacggcacuuguacagucgugaugaccgacggcucugcuuccgggaaagcagauacuaagauccuguuuauugaggaaggaaagaucgugcauacaucaacccucagcgguagugcccaacacgucgaggaaugcucuugcuauccacgguacccgggcguucgcugugugugcagagacaacuggaaaggguccaauaggcccauaguagauauuaacaucaaggaccacagcaucgugucgucuuacgucuguuccggauuagugggcgacacgccucggaaaaaugauucaaguagcuccucucauugccuggacccaaacaaugaggaaggugggcacggaguuaagggcugggcuuucgaugacggcaacgauguguggauggggcgcaccauuaaugagacaagccgacuuggauaugagacuuuuaaagucaucgaagguuggucaaaccccaagaguaaauugcagauuaauagacaggugauaguagacaggggcgaucgguccggguacagcggaaucuucucuguugagggcaagucauguauuaaccguugcuuuuauguggaacugauccgcgguagaaaggaggaaaccgagguccuauggacaaguaauagcaucguggucuucugugggacuuccggcaccuacggaacaggcucuuggccugacggggccgaucucaaccugaugccaauuuga

SEQ ID NO: 144994 - RNA, 1410 nt, Artificial Sequence
  derived and/or modified sequence opt3 from neuraminidase__InfluenzaA__AFN19494
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacaugcauucaaauaacaccguccgagaucguacaccauauagaacucugcuuaugaaugaacugggagugcccuuucacuugggcaccaagcagguuugcauugcuuggagcaguuccucuugucaugacgguaaagccuggcuccacgugugcaucacaggggaugacaagaacgcaaccgccagcuucaucuacaauggaaggcuggucgauuccgugguaucauggaguaaagagauucugcggacgcaggaaagcgaguguguuugcauaaacggcacuuguacaguggucaugaccgacggcucugcuuccgggaaggcagauacuaaaauccucuuuauugaggaaggaaagaucgugcauacaucaaccuuaagcgguagugcccaacacguggaggaaugcucuugcuauccucgcuacccaggcgucagauguguuugcagggacaacuggaagggguccaaucggccgauaguggauauuaacaucaaagaccacagcaucguaucgucuuacguguguuccggacuggucggcgacacgccccgcaagaaugauucaaguagcuccucucauugccuugacccuaacaaugaggaaggugggcacggagugaaaggcugggcuuucgaugacggcaacgauguuuggauggggcgaaccauuaaugagacaagcagauugggauaugagacuuuuaaggugaucgaagguuggucaaacccaaaaaguaagcugcagauuaauaggcaggucauaguggaccggggcaaccguuccggguacagcggaaucuucucuguagagggcaaaucauguauuaaucgcugcuuuuauguugaacuaaucagagguaggaaggaggaaaccgaggugcucuggacaaguaacagcaucgucguguucugugggacuuccggcaccuacggaacaggcucuuggcccgauggggccgaccugaaucuuaugccuauuuga

SEQ ID NO: 144995 - RNA, 1410 nt, Artificial Sequence; identical to SEQ ID NO: 143803
  derived and/or modified sequence opt3 from neuraminidase__InfluenzaA__AFN19496

SEQ ID NO: 144996 - RNA, 1410 nt, Artificial Sequence
  derived and/or modified sequence opt3 from neuraminidase__InfluenzaA__AFN19498
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaaacugguggauuccguaguuucauggaguaaggagauucugaggacgcaggaaagcgagugugugugcauaaacggcacuuguacagucgugaugaccgacggcucugcuuccgggaaagcagauacuaagauccucuuuauugaggaaggaaagaucgugcauacaucaaccuuaagcgguagugcccaacacgucgaggaaugcucuugcuauccucgguacccaggcguucgcugugugugcagagacaacuggaaaggguccaauaggccgauaguagauauuaacaucaaggaccacagcaucgugucgucuuacgucuguuccggacuggugggcgacacgccccggaaaaaugauucaaguagcuccucucauugccuugacccuaacaaugaggaaggugggcacggaguuaagggcugggcuuucgaugacggcaacgauguguggauggggcgcaccauuaaugagacaagccgauugggauaugagacuuuuaaagucaucgaagguuggucaaacccaaagaguaaacugcagauuaauagacaggugauaguagacaggggcaaccgguccggguacagcggaaucuucucuguugagggcaagucauguauuaaucguugcuuuuauguggaacuaauccgcgguagaaccgaggaaacagagguccucuggaccaguaacagcaucguggucuucugugggacuuccggcacauacggaaccggcucuuggcccgauggggccgaccugaaucuuaugccuauuuga

SEQ ID NO: 144997 - RNA, 1410 nt, Artificial Sequence; identical to SEQ ID NO: 144946
  derived and/or modified sequence opt3 from neuraminidase__InfluenzaA__AFN19500

SEQ ID NO: 144998 - RNA, 1410 nt, Artificial Sequence; identical to SEQ ID NO: 144938
  derived and/or modified sequence opt3 from neuraminidase__InfluenzaA__AFN19502

SEQ ID NO: 144999 - RNA, 1410 nt, Artificial Sequence; identical to SEQ ID NO: 141534
  derived and/or modified sequence opt3 from neuraminidase__InfluenzaA__AFN19504

SEQ ID NO: 145000 - RNA, 1410 nt, Artificial Sequence; identical to SEQ ID NO: 141534
  derived and/or modified sequence opt3 from neuraminidase__InfluenzaA__AFN19506

SEQ ID NO: 145001 - RNA, 1410 nt, Artificial Sequence; identical to SEQ ID NO: 144946
  derived and/or modified sequence opt3 from neuraminidase__InfluenzaA__AFN19508

SEQ ID NO: 145002 - RNA, 1410 nt, Artificial Sequence; identical to SEQ ID NO: 144938
  derived and/or modified sequence opt3 from neuraminidase__InfluenzaA__AFN19510

SEQ ID NO: 145003 - RNA, 1410 nt, Artificial Sequence; identical to SEQ ID NO: 144938
  derived and/or modified sequence opt3 from neuraminidase__InfluenzaA__AFN19512

SEQ ID NO: 145004 - RNA, 1410 nt, Artificial Sequence; identical to SEQ ID NO: 144938
  derived and/or modified sequence opt3 from neuraminidase__InfluenzaA__AFN19516

SEQ ID NO: 145005 - RNA, 1410 nt, Artificial Sequence; identical to SEQ ID NO: 144946
  derived and/or modified sequence opt3 from neuraminidase__InfluenzaA__AFN19518

SEQ ID NO: 145006 - RNA, 1410 nt, Artificial Sequence; identical to SEQ ID NO: 144946
  derived and/or modified sequence opt3 from neuraminidase__InfluenzaA__AFN19520

SEQ ID NO: 145007 - RNA, 1410 nt, Artificial Sequence; identical to SEQ ID NO: 144938
  derived and/or modified sequence opt3 from neuraminidase__InfluenzaA__AFN19522

SEQ ID NO: 145008 - RNA, 1410 nt, Artificial Sequence
  derived and/or modified sequence opt3 from neuraminidase__InfluenzaA__AFN19524
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccauuaaugagacaagcagacuuggauaugagacuuuuaaggucaucgaagguuggucaaaccccaaaaguaaguugcagauuaauaggcaagugauaguagaccggggcgaucguuccggguacagcggaaucuucucuguugagggcaaaucauguauuaaccgcugcuuuuauguggaacugaucagagguaggaaggaggaaaccgagguccuauggacaaguaauagcaucguggucuucugugggacuuccggcaccuacggaacaggcucuuggccugacggggccgaucucucgcugaugccaauuuga

SEQ ID NO: 145009 - RNA, 1410 nt, Artificial Sequence
  derived and/or modified sequence opt3 from neuraminidase__InfluenzaA__AFN19526
augaaccccaaucagaagaucauuaccauaggcagcgugucccugacaaucucuacuauuugcuucuuuaugcagaucgccauucucaucacgaccgucacacuucacuucaaacagugugaguuuaacucaccuccaaauaaccagguuaugcugugcgaaccgacuauaaucgagagaaauauuaccgaaaucguguacuugacaaacaccacuacagagaaggaaauuugucccaaaccugcugaguauaggaauuggaguaagccacagugcgacaucaccggguucgcacccuuuagcaaagauaacuccauacgguuaucugccggaggugacauuuggguaacgcgcgagccuuacgugucgugugauccagacaagugcuaucaauucgcgcugggccaggggacuacccuaaauaacguccauucaaauaacacagugcgagaucguacucccuacagaacccuccugaugaaugaacuuggaguuccuuuucaccugggcacaaaacagguguguaucgcuuggagcaguuccucuugccaugacgguaaggccugguugcacgucuguauuaccggggaugacaagaacgcaacggccagcuucaucuauaauggaaggcucguggauuccguaguuucauggaguaaagagauccugcggacucaggaaagcgagugcguguguauuaacggcacaugcaccgucgugaugacugacggcucugcuuccgggaaggcagauacaaaaauacuguuuaucgaggaaggaaagauugugcauaccucaacgcucagcgguagugcccaacacgucgaggaaugcucuuguuacccacgcuauccgggcguuagaugcguguguagggacaacuggaagggguccaaucggcccaucguagauauaaacauuaaagaccacagcaucgugucgucuuacgucugcuccggauuagugggcgacaccccucgcaagacagauucaaguagcuccucucauugucuggacccaaauaacgaggaaggugggcacggaguuaaaggcugggcuuucgaugacggcaaugauguguggauggggcgaacuaucaacgagaccagcagacuuggauacgagacauuuaaggucauugaagguuggucaaaucccaaaaguaaguugcagaucaacaggcaagugauuguagaccggggcgaucguuccggguauagcggaauauucucuguugagggcaaaucaugcaucaaucgcuguuuuuacguggaacugauuagagguaggaaggaggaaacugagguccuauggaccaguaacagcaucguggucuucugcgggacauccggcaccuauggaacuggcucuuggccugacggggccgaucucaaucugaugccaaucuga

SEQ ID NO: 145010 - RNA, 1410 nt, Artificial Sequence
  derived and/or modified sequence opt3 from neuraminidase__InfluenzaA__AFN19528
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauaugaccgaaauuguguauuugacaaacaccacuaucgagaaggaaauuugccccaaaccugcugaguacaggaauuggaguaagccacagugugacaucacaggguucgcacccuuuagcaaagauaacuccauacgguuaucugccggaggugacauuuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcaucgcuuggagcaguuccucuugucaugacgguaaggccugguugcacgucugcauuacaggggaugacaagaacgcaaccgccagcuucaucuacaauggaaggcucguggauuccguaguuucauggaguaaagagauccugcggacgcaggaaagcgagugugugugcauuaacggcacuuguacagucgugaugaccgacggcucugcuuccgggaagucagauacuaaaauacuguuuaucgaggaaggaaagauugugcauacaagcacccucagugguucugcacaacacgucgaggaaugcuccugcuauccacgcuacccgggcguuagaugugugugcagggacaacuggaaggggagcaaucggcccaucguagauauaaacauuaaagaccacucgaucgugucuuccuacgucuguucaggauuagugggcgacacgccucgcaagaaugauaguagcuccucuagccauugccuggacccaaacaaugaggaaggugggcacggaguuaaaggcugggccuucgaugacggcaacgauguguggauggggcgaaccaucaaugagacaucaagacuuggauaugagacuuuuaaggucauugaagguuggaguaaccccaaauccaaguugcagaucaauaggcaagugauuguagaccggagcgaucguucuggcuacucagggauauucaguguugagggaaaaagcuguaucaaccgcugcuuuuauguggaacugauuagaggcaggaaggaggaaaccgagguccuauggacauccaauucuaucguggucuucugugguacuucggggaccuacggcacaggaagcuggccugacggcgcugaucucaaccugaugccaaucuga

SEQ ID NO: 145011 - RNA, 1410 nt, Artificial Sequence; identical to SEQ ID NO: 144974
  derived and/or modified sequence opt3 from neuraminidase__InfluenzaA__AFN19530

SEQ ID NO: 145012 - RNA, 1410 nt, Artificial Sequence; identical to SEQ ID NO: 144938
  derived and/or modified sequence opt3 from neuraminidase__InfluenzaA__AFN19532

SEQ ID NO: 145013 - RNA, 1410 nt, Artificial Sequence; identical to SEQ ID NO: 144974
  derived and/or modified sequence opt3 from neuraminidase__InfluenzaA__AFN19534

SEQ ID NO: 145014 - RNA, 1410 nt, Artificial Sequence; identical to SEQ ID NO: 144938
  derived and/or modified sequence opt3 from neuraminidase__InfluenzaA__AFN19536

SEQ ID NO: 145015 - RNA, 1410 nt, Artificial Sequence; identical to SEQ ID NO: 144938
  derived and/or modified sequence opt3 from neuraminidase__InfluenzaA__AFN19538

SEQ ID NO: 145016 - RNA, 1410 nt, Artificial Sequence; identical to SEQ ID NO: 144938
  derived and/or modified sequence opt3 from neuraminidase__InfluenzaA__AFN19544

SEQ ID NO: 145017 - RNA, 1410 nt, Artificial Sequence
  derived and/or modified sequence opt3 from neuraminidase__InfluenzaA__AFN19546
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugagcgaacuuggcguuccuuuucaccuggguaccaaacaggugugcauugcuuggaguuccucuagcugucaugaugggaaggccugguugcacgucugcaucacaggagacgauaagaaugcaaccgccuccuucaucuacaacggcaggcucguggacucaguaguuaguuggagcaaagagauucugcggacgcaggaaucugagugugugugcauaaauggcacuuguacagucgugaugaccgauggguccgcuucaggaaaggcagacacuaaaauccuguuuauugaggaagguaagaucgugcauacaagcacccucaguggcucugcccaacacgucgaggaaugcuccugcuauccacgcuacccggggguuagaugugugugcagggauaacuggaagggaagcaaccggcccauaguagacauuaauaucaaagaucacucgaucgugucuuccuacgucuguucaggcuuagugggugacacgccucgcaagaacgacaguagcuccucuagccauugccuggauccaaauaacgaggaagggggacacggcguuaaaggcugggcuuucgacgaugggaaugacguguggaugggacgaaccauuaacgagacaucaagacuugguuaugagacuuuuaaggucaucgaaggcuggaguaaucccaaauccaaguugcagauuaacaggcaagugauaguagaucguggggaccggagcggauacucuggcaucuucucaguugaggguaaaaguuguauuaaucgcugcuuuuauguggaacugaucagagggaggaaggaggaaaccgagguccuauggacaagcaacuccaucguggucuucuguggcacuucuggaaccuacggcacagggucguggccugauggagccgaccucaaucugaugccaauuuga

SEQ ID NO: 145018 - RNA, 1410 nt, Artificial Sequence
  derived and/or modified sequence opt3 from neuraminidase__InfluenzaA__AFN19548
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucauucaguagcucccauugccuggacccaaacaaugaggaaggugggcacggaguuaaaggcugggcuuuugaugacggcaacgauguguggauggggcgaaccauuaaugagacaucuagacuuggauaugagacuuucaaggucaucgaagguuggagcaaccccaaaucaaaguugcagauuaauaggcaagugauaguagaccggggcgaucguaguggguacuccggaaucuuuagcguugagggcaaaucuuguauuaaccgcugcuucuauguggaacugaucagagguaggaaggaggaaaccgagguccuauggacaucaaauaguaucguggucuucugugggacuagcggcaccuacggaacaggcuccuggccugacggggccgaucucaaccugaugccaauuuga

SEQ ID NO: 145019 - RNA, 1410 nt, Artificial Sequence
  derived and/or modified sequence opt3 from neuraminidase__InfluenzaA__AFN19550
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccggggaggcagauacuaagauccucuuuauugaagagggaaaaaucauacauacaucaaccuuaagcgguagugcccaacacguggaagagugcucuugcuauccucgcuacccaggcgucagauguguuugcagggacaacuggaagggguccaaucggccgauuguggauaucaacaucaaggaccacagcauuguaucgucuuacguguguuccggacuggucggcgacacgccccgcaaaaaugauucaaguagcuccucucauugccuugacccuaacaaugaagagggugggcacggagugaagggcugggcuuucgaugacggcaacgauguuuggauggggcgaaccaucaaugagacaagcagauugggauaugaaacuuuuaaagugauugaggguuggucaaacccaaagaguaaacugcagauaaauaggcaggucaucguggaccggggcaaccguuccggguacagcggaauuuucucuguagaaggcaagucauguaucaaucgcugcuuuuauguugagcuaaucagagguaggaaagaagagaccgaggugcucuggacaaguaacagcauugucguguucugugggacuuccggcaccuacggaacaggcucuuggcccgauggggccgaccugaaucuuaugccuauauga

SEQ ID NO: 145020 - RNA, 1410 nt, Artificial Sequence; identical to SEQ ID NO: 144938
  derived and/or modified sequence opt3 from neuraminidase__InfluenzaA__AFN19552

SEQ ID NO: 145021 - RNA, 1410 nt, Artificial Sequence; identical to SEQ ID NO: 144162
  derived and/or modified sequence opt3 from neuraminidase__InfluenzaA__AFN19554

SEQ ID NO: 145022 - RNA, 1410 nt, Artificial Sequence; identical to SEQ ID NO: 144162
  derived and/or modified sequence opt3 from neuraminidase__InfluenzaA__AFN19556

SEQ ID NO: 145023 - RNA, 1410 nt, Artificial Sequence
  derived and/or modified sequence opt3 from neuraminidase__InfluenzaA__AFN19558
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccauuaaugagacaagcagacuuggauaugagacuuuuaaggucaucgaagguuggucaaaccccaaaaguaaguugcagaugaauaggcaagugauuguagaccggggcgaucguuccggguacagcggaauauucucuguugagggcaaaucauguaucaaccgcugcuuuuauguggaacugauuagagguaggaaggaggaaaccgagguccuauggacaaguaauagcaucguggucuucugugggacuuccggcaccuacggaacaggcucuuggccugacggggccgaucucaaccugaugccaaucuga

SEQ ID NO: 145024 - RNA, 1410 nt, Artificial Sequence
  derived and/or modified sequence opt3 from neuraminidase__InfluenzaA__AFN19560
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaagggggaggccacggcguuaaagggugggcuuucgacgauggaaacgacguguggaugggucgaaccauuaaugagacaagcagacuuggcuaugagacuuuuaaggucaucgagggguggucaaaccccaaaaguaaguugcagauuaauaggcaagugauaguagaucggggagaccguuccggcuacagcgguaucuucucuguugaagggaaaucauguauuaaccgcugcuuuuauguggagcugaucagaggcaggaaggaagagaccgaaguccuauggacaaguaauagcaucguggucuucuguggaacuuccggcaccuacgggacaggaucuuggccugauggugccgaccucaaccugaugccaauuuga

SEQ ID NO: 145025 - RNA, 1410 nt, Artificial Sequence; identical to SEQ ID NO: 144985
  derived and/or modified sequence opt3 from neuraminidase__InfluenzaA__AFN19562

SEQ ID NO: 145026 - RNA, 1410 nt, Artificial Sequence
  derived and/or modified sequence opt3 from neuraminidase__InfluenzaA__AFN19564
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaccgacucaaguagcuccucucauugccuggauccaaauaacgaggaagggggacacggcguuaaaggcugggcuuucgacgaugggaaugacguguggaugggacgaacaauuaacgagacuagcagacuugguuaugagaccuuuaaggucaucgaaggcuggucaaaucccaaaaguaaguugcagauuaacaggcaagugauaguagaucguggggaccgguccggauacagcggcaucuucucuguugaggguaaaucauguauuaaucgcugcuuuuauguggaacugaucagagggaggaaggaggaaacagagguccuauggaccaguaacagcaucguggucuucuguggcacuuccggaacauacggcaccgggucuuggccugauggagccgaccucaaucugaugccaauuuga

SEQ ID NO: 145027 - RNA, 1410 nt, Artificial Sequence
  derived and/or modified sequence opt3 from neuraminidase__InfluenzaA__AFN19566
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaacgagauucugcggacgcaggaaagcgagugugugugcauaaacggcacuuguacagucgugaugaccgaugggucugcuuccggaaaagcagacacuaagauccuguuuauugaggaagguaaaaucgugcauacaucaacccucagcggcagugcccaacacgucgaggaaugcucuugcuauccacgcuacccggggguuagaugugugugcagggauaauuggaagggauccaaccggcccauaguagacauuaauaucaaggaucacagcaucgugucgucuuacgucuguuccggcuuagugggugacacgccucgcaaaaacgacucaaguagcuccucucauugccuggauccaaauaacgaggaagggggacacggcguuaagggcugggcuuucgacgaugggaaugacguguggaugggacgaaccauuaacgagacaagcagacuugguuaugagacuuuuaaagucaucgaaggcuggucaaaucccaagaguaaauugcagauuaacaggcaagugauaguagaucguggggaccgguccggauacagcggcaucuucucuguugaggguaagucauguauuaaucgcugcuuuuauguggaacugaucagagggaggaaagaggaaaacgagguccuauggaccaguaauagcaucguggucuucuguggcacauccggaacuuacggcaccgggucuuggccugauggagccgaccucaaccugaugccaauuuga

SEQ ID NO: 145028 - RNA, 1410 nt, Artificial Sequence
  derived and/or modified sequence opt3 from neuraminidase__InfluenzaA__AFN19568
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcaagugaauaggcagguaauuguugaucguggggaccgguccggauacagcggcauauucucuguggaggguaaaucauguaucaaccgcugcuuuuaugucgaacugauuagagggaggaaggaggaaaucgaggugcuauggaccaguaauagcaucgucguguucuguggcacauccggaacuuacggcaccgggucuuggccugauggagccgaccucaaccugaugccaauuuga

SEQ ID NO: 145029 - RNA, 1410 nt, Artificial Sequence
  derived and/or modified sequence opt3 from neuraminidase__InfluenzaA__AFN19570
augaaccccaaucagaagaucauuaccauaggcagcgugucccugacaaucucuacuauuugcuucuuuaugcaaaucgccauucucaucacgaccgucacacuucacuucaaacaguacgaguuuaacuauccuccaaauaaccagguuaugcugugugaaccgacuauaaucgagagaaauauuaccgaaaucguguacuugacaaacaccacuauugagaaggaaaucugccccaaaccugcugaguauaggaauuggucaaagccacagugugggauaacaggauucgcacccuuuaguaaagacaacagcauucgguuauccgccgguggcgauaucuggguaacccgcgagccuuacgugucuugcgacccagauaaguguuaucaauucgcgcuggggcagggaacgacucuaaauaacaugcauucgaauaacaccguccgagaccguacacccuacagaacucuccugaugaaugaacuuggcgugccuuuucaccuggguaccaagcagguuugcauugcuuggucaagcaguuccugucaugaugggaaagccugguugcacgugugcaucacaggagacgauaagaacgcaaccgccucuuucaucuauaauggcaggcucgucgacagcgugguauccuggucaaacgagauucugcggacgcaggaaagugaguguguuugcauaaacggcacuuguacaguggucaugaccgaugggagcgcuucuggaaaagcagacacuaagauccuguuuauugaggaagguaaaaucgugcauacauccacccucucaggcagcgcccaacacguggaggaaugcaguugcuacccacgcuacccgggggucagauguguuugcagggauaauuggaagggaucuaaccggcccauaguggacauuaauaucaaggaucacuccaucguaagcucguauguguguucuggcuuagucggugacacgccucgcaaaaacgacuccucaaguagcucccauugccuggauccaaauaacgaggaagggggacacggcgugaagggcugggcuuucgacgaugggaaugacguuuggaugggacgaaccauuaacgagacaucuagacuugguuacgagacuuuuaaagugaucgaaggcuggagcaaucccaagucaaaauugcagauuaacaggcaggucauaguggaucguggggaccggaguggauauuccggcaucuucagcguagaggguaagucuuguauuaaucgcugcuuuuacguugaacugaucagagggaggaaagaggaaaacgaggugcuauggaccucaaauaguaucgucguguucuguggcacaagcggaacuuauggcaccggguccuggccugauggagccgaccucaaccugaugccaauuuga

SEQ ID NO: 145030 - RNA, 1410 nt, Artificial Sequence
  derived and/or modified sequence opt3 from neuraminidase__InfluenzaA__AFN19572
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucggaucucugccggaggugacauuuggguaacccgcgagccuuaugugucgugcgauccagacaaguguuaccaauucgcguuaggccaggggacgacucugaauaacguccauucaaauaacaccgugcgagaucguacacccuauagaacucuacucaugaaugaacugggaguuccuuuucaccuuggcaccaaacaggugugcaucgcuuggagcaguuccucuugucaugacgguaaggccuggcugcacgucugcaucacaggggaugacaagaacgcaaccgccagcuucauuuacaauggaaaauugguggauuccguaguuucauggaguaaggagauacucaggacgcaggaaagcgagugugugugcaucaacggcacuuguacagucgugaugaccgacggcucugcuuccgggaaagcagauacuaagauucuguuuaucgaggaaggaaagauagugcauacaucaacccugagcgguagugcccaacacgucgaggaaugcucuugcuauccacgguacccgggcguucgcugugugugcagagacaacuggaaaggguccaauaggcccauuguagauaucaacaucaaggaccacagcauugugucgucuuacgucuguuccggacucgugggcgacacgccucggaaaaaugauucaaguagcuccucucauugcuuagacccaaacaaugaggaaggugggcacggaguuaagggcugggcuuucgaugacggcaacgauguguggauggggcgcaccaucaaugagacaagccgacugggauaugagacuuuuaaagucauugaagguuggucaaaccccaagaguaaacuucagauaaauagacaggugaucguagacaggggcgaucgguccggguacagcggaauuuucucuguugagggcaagucauguaucaaccguugcuuuuauguggaauugauccgcgguagaaaggaggaaaccgagguccuguggacaaguaauagcauuguggucuucugugggacuuccggcaccuacggaacaggcucuuggccugacggggccgaucuaaaccucaugccaauauga

SEQ ID NO: 145031 - RNA, 1410 nt, Artificial Sequence
  derived and/or modified sequence opt3 from neuraminidase__InfluenzaA__AFN19574
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaaaagauucugcggacgcaggagagcgaaugugugugcauaaacggcacuuguacagucgugaugaccgauggcucugcuuccgggaaagcagacacuaagauccucuuuauugaggagggaaagaucgugcauacaucaaccuuaagcgguagugcccaacacgucgaagagugcucuugcuauccucgcuacccaggcguuagaugugugugcagggauaauuggaaaggguccaaccggccgauaguagacauuaauaugaaggaucacagcaucgugucgucuuacgucuguuccggacuggugggcgacacgccccgcaaaaacgacucaaguagcuccucucauugcuucgauccuaaugacgaagagggugggcacggaguuaagggcugggcuuuugaugacggcaacgauguguggauggggcgaaccaucagcgaaaaaucaagacuuggauaugagacauucaaggucauugaggguuggaguaauccaaaauccaaguugcagaucaacaggcaagugauuguagaccggggcgaucguagcggguacucuggaauauuuucaguugaaggcaagaguuguaucaaucgcugcuucuauguggagcugauuagagguagcaaagaagagacugaaguccuauggaccuccaacucuaucguggucuucugugggacaucgggcacuuacggaaccggcagcuggcccgacggggccgauaucaaucucaugccuauuuga

SEQ ID NO: 145032 - RNA, 1410 nt, Artificial Sequence
  derived and/or modified sequence opt3 from neuraminidase__InfluenzaA__AFN19576
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagaugaugcugugugaaccgacuauaaucgagagaaauauuaccgaaaucguuuauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucugggugacccgcgagccuuauguaucgugcgauccagacaaguguuaccaauucgcgcugggccaggggacgacucuaaauaacgugcauucaaauaacaccguccgagaucguacacccuauagaacucuccugaugaaugaacuuggagugccuuuucaccugggcaccaagcagguuugcauugcuuggagcaguuccucuugucaugacgguaaagccugguugcacgugugcaucacaggggaugacaagaacgcaaccgccagcuucaucuacaauggaaggcucgucgauuccgugguaucauggaguaaagagauucugcggacgcaggaaagcgaguguguuugcauaaacggcacuuguacaguggucaugaccgacggcucugcuuccgggaaggcagauacuaaaauccuguuuauugaggaaggaaagaucgugcauacaucaacccucagcgguagugcccaacacguggaggaaugcucuugcuauccacgcuacccgggcgucagauguguuugcagggacaacuggaagggguccaaucggcccauaguggauauuaacaucaaagaccacagcaucguaucgucuuacguguguuccggauuagucggcgacacgccucgcaagaaugauucaaguagcuccucucauugccuggacccaaacaaugaggaaggugggcacggagugaaaggcugggcuuucgaugacggcaacgauguuuggauggggcgaaccauuaaugagacaagcagacuuggauaugagacuuuuaaggugaucgaagguuggucaaaccccaaaaguaaguugcagauuaauaggcaggucauaguggaccggggcgaucguuccggguacagcggaaucuucucuguagagggcaaaucauguauuaaccgcugcuuuuauguugaacugaucagagguaggaaggaggaaaccgaggugcuauggacaaguaauagcaucgucguguucugugggacuuccggcaccuacggaacaggcucuuggccugacggggccgaucucaaccugaugccaauuuga

SEQ ID NO: 145033 - RNA, 1410 nt, Artificial Sequence; identical to SEQ ID NO: 144938
  derived and/or modified sequence opt3 from neuraminidase__InfluenzaA__AFN19578

SEQ ID NO: 145034 - RNA, 1410 nt, Artificial Sequence; identical to SEQ ID NO: 144938
  derived and/or modified sequence opt3 from neuraminidase__InfluenzaA__AFN19582

SEQ ID NO: 145035 - RNA, 1410 nt, Artificial Sequence; identical to SEQ ID NO: 144938
  derived and/or modified sequence opt3 from neuraminidase__InfluenzaA__AFN19584

SEQ ID NO: 145036 - RNA, 1410 nt, Artificial Sequence; identical to SEQ ID NO: 144938
  derived and/or modified sequence opt3 from neuraminidase__InfluenzaA__AFN19588

SEQ ID NO: 145037 - RNA, 1410 nt, Artificial Sequence; identical to SEQ ID NO: 144938
  derived and/or modified sequence opt3 from neuraminidase__InfluenzaA__AFN19590

SEQ ID NO: 145038 - RNA, 1410 nt, Artificial Sequence; identical to SEQ ID NO: 144974
  derived and/or modified sequence opt3 from neuraminidase__InfluenzaA__AFN19592

SEQ ID NO: 145039 - RNA, 1410 nt, Artificial Sequence; identical to SEQ ID NO: 144938
  derived and/or modified sequence opt3 from neuraminidase__InfluenzaA__AFN19594

SEQ ID NO: 145040 - RNA, 1410 nt, Artificial Sequence; identical to SEQ ID NO: 144946
  derived and/or modified sequence opt3 from neuraminidase__InfluenzaA__AFN19596

SEQ ID NO: 145041 - RNA, 1410 nt, Artificial Sequence; identical to SEQ ID NO: 144946
  derived and/or modified sequence opt3 from neuraminidase__InfluenzaA__AFN19600

SEQ ID NO: 145042 - RNA, 1410 nt, Artificial Sequence
  derived and/or modified sequence opt3 from neuraminidase__InfluenzaA__AFN19602
augaaccccaaucagaagaucauuaccauaggcagcgugucccugacacucucuacuaucugcuucuuuaugcagauugccauccuuauuacgaccgucacacugcacuucaaacaguacgaguuuaacucaccuccaaauaaccagguuauguugugugaaccgacuaucauagagagaaauaugaccgaaaucguguauuuaacaaacaccacuauugagaaggaaaucugccccaaaccugcugaguacaggaauuggaguaagccacagugugacauuacaggguucgcacccuuuagcaaagauaacuccauccggcugucugccggaggugacauauggguaacccgcgagccuuaugugucgugcgauccagacaaguguuaccaauucgcgcuaggccaggggacgacucucaauaacguccauucaaauaacaccgugcgagaucguacacccuauagaacucugcuuaugaaugaacugggaguuccuuuucacuugggcaccaaacaggugugcauugcuuggagcaguuccucuugucaugacgguaaggccuggcuccacgucugcaucacaggggaugacaagaacgcaaccgccagcuucauuuacaauggaaggcugguggauuccguaguuucauggaguaaagagauccugcggacgcaggaaagcgagugugugugcaucaacggcacuuguacagucgugaugaccgacggcucugcuuccgggaaggcagauacuaaaauucucuuuauagaggaaggaaagaucgugcauacaucaaccuuaagcgguagugcccaacacgucgaggaaugcucuugcuauccacgcuacccgggcguuagaugugugugcagggacaacuggaagggguccaaucggcccauuguagauaucaacauaaaagaccacagcauugugucgucuuacgucuguuccggacuggugggcgacacgccucgcaagaaugauucaaguagcuccucucauugccuugacccaaacaaugaggaaggugggcacggaguuaaaggcugggcuuucgaugacggcaacgauguguggauggggcgaaccaucaaugagacaagcagauugggauaugagacuuuuaaggucaucgaagguuggucaaaccccaaaaguaagcugcagauuaauaggcaagugaucguagaccgguccgaucguagcggcuacucugggauuuucucaguugagggaaaaaguuguauaaaccgcugcuuuuauguggaacuaaucagaggcaggaaggaggaaaccgagguccucuggacaagcaauuccauuguggucuucugugguacuucugggaccuacggcacaggaucguggccugacggcgccgaucugaaccuuaugccaaucuga

SEQ ID NO: 145043 - RNA, 1410 nt, Artificial Sequence; identical to SEQ ID NO: 144938
  derived and/or modified sequence opt3 from neuraminidase__InfluenzaA__AFN19604

SEQ ID NO: 145044 - RNA, 1410 nt, Artificial Sequence; identical to SEQ ID NO: 144938
  derived and/or modified sequence opt3 from neuraminidase__InfluenzaA__AFN19606

SEQ ID NO: 145045 - RNA, 1410 nt, Artificial Sequence; identical to SEQ ID NO: 144938
  derived and/or modified sequence opt3 from neuraminidase__InfluenzaA__AFN19608

SEQ ID NO: 145046 - RNA, 1410 nt, Artificial Sequence; identical to SEQ ID NO: 144938
  derived and/or modified sequence opt3 from neuraminidase__InfluenzaA__AFN19610

SEQ ID NO: 145047 - RNA, 1410 nt, Artificial Sequence; identical to SEQ ID NO: 144946
  derived and/or modified sequence opt3 from neuraminidase__InfluenzaA__AFN19612

SEQ ID NO: 145048 - RNA, 1410 nt, Artificial Sequence; identical to SEQ ID NO: 144162
  derived and/or modified sequence opt3 from neuraminidase__InfluenzaA__AFN19614

SEQ ID NO: 145049 - RNA, 1410 nt, Artificial Sequence
  derived and/or modified sequence opt3 from neuraminidase__InfluenzaA__AFN19618
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaacgagauucugcggacgcaggaaagcgagugugugugcauaaacggcacuuguacagucgugaugaccgaugggucugcuuccggaaaagcagacacuaagauccuguuuauugaggaagguaaaaucgugcauacaucaacccucagcggcagugcccaacacgucgaggaaugcucuugcuauccacgcuacccggggguuagaugugugugcagggauaauuggaagggauccaaccggcccauaguagacauuaauaucaaggaucacagcaucgugucgucuuacgucuguuccggcuuagugggugacacgccucgcaaaaacgacucaaguagcuccucucauugccuggauccaaauaacgaggaagggggacacggcguuaagggcugggcuuucgacgaugggaaugacguguggaugggacgaaccauuaacgagacaagcagacuugguuaugagacuuuuaaagucaucgaaggcuggucaaaucccaagaguaaauugcagauuaacaggcaagugauaguagaucguggggaccgguccggauacagcggcaucuucucuguugaggguaagucauguauuaaucgcugcuuuuauguggaacugaucagagggaggaaagaggaaaccgagguccuauggacaaguaacagcaucguggucuucuguggcacuuccggaaccuacggcacagggucuuggccugauggagccgaccucaaucugaugccaauuuga

SEQ ID NO: 145050 - RNA, 1410 nt, Artificial Sequence; identical to SEQ ID NO: 144938
  derived and/or modified sequence opt3 from neuraminidase__InfluenzaA__AFN19620

SEQ ID NO: 145051 - RNA, 1410 nt, Artificial Sequence; identical to SEQ ID NO: 144974
  derived and/or modified sequence opt3 from neuraminidase__InfluenzaA__AFN19624

SEQ ID NO: 145052 - RNA, 1410 nt, Artificial Sequence; identical to SEQ ID NO: 144938
  derived and/or modified sequence opt3 from neuraminidase__InfluenzaA__AFN19630

SEQ ID NO: 145053 - RNA, 1410 nt, Artificial Sequence
  derived and/or modified sequence opt3 from neuraminidase__InfluenzaA__AFN19632
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccuacagaguacaggaauuggaguaagccacagugugacauaaccggguucgcucccuuuagcaaagauaacuccauucgguuaucugcaggaggugacaucuggguaacgcgcgagccuuaugugucgugcgauccagacaaguguuaccaauucgcccugggccaggggacuacccuaaauaacguccauucaaauaacacagugcgagaucguacucccuauagaacccuccugaugaaugaacuuggaguuccuuuucaccugggcacaaaacaggugugcauugcguggagcaguuccucuugucaugacgguaaggcuugguugcacgucugcaucaccggggaugacaagaacgccacggcaaguuucaucuacaauggaaggcucguggauuccguaguuucauggaguaaagagauucugcggacucaggaaagcgagugugugugcauaaacggcacauguaccgucgugaugacugacggcucugccuccgggaaggcugauacaaaaauccuguuuauugaggaaggaaagaucgugcauaccucaacgcucagcgguagugcacaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacaccccucgcaagaaugauucaaguagcuccucucauugccuggacccaaacaaugaggaaggugggcacggaguuaaaggcugggccuucgaugacggcaacgauguguggauggggcgaacaauuaaugagacuagcagacuuggauaugagaccuuuaaggucaucgaagguuggucaaaccccaaaaguaaguugcagauuaauaggcaagugauaguagaccggggcgaucguuccggguacagcggaaucuucucuguugagggcaaaucauguauuaaccgcugcuuuuauguggaacugaucagagguaggaaggaggaaacagagguccuauggacuagcaauagcaucguggucuucugugggaccuccggcacauacggaaccggcucuuggccugacggggcugaucucaaccugaugccaauuuga

SEQ ID NO: 145054 - RNA, 1410 nt, Artificial Sequence
  derived and/or modified sequence opt3 from neuraminidase__InfluenzaA__AFN19634
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacaagcuauagaacucuccugaugaaugaacuuggaguucccuuucaccugggcaccaaacaggugugcauugcuuggaguuccucuagcugucaugacgguaaggccugguugcacgucugcaucacaggggaugacaagaacgcaaccgccuccuucaucuacaauggaaggcucguggauucaguaguuaguuggagcaaagagauucugcggacgcaggaaucugagugugugugcauaaacggcacuuguacagucgugaugaccgacggcuccgcuucagggaaggcagauacuaaaauccuguuuauugaggaaggaaagaucgugcauacaagcacccucagugguucugcccaacacgucgaggaaugcuccugcuauccucgcuacccaggcguuagaugugugugcagggacaacuggaaggggagcaaucggccgauaguagauauuaacaucaaagaccacucgaucgugucuuccuacgucuguucaggauuagugggcgacacgccccgcaagaaugauaguagcuccucuagccauugccuggacccuaacaaugaggaaggugggcacggaguuaaaggcugggcuuucgaugacggcaacgauguguggauggggcgaaccauuaaugagacaucaagacuuggauaugagacuuuuaaggucaucgaagguuggaguaacccaaaauccaaguugcagauuaauaggcaagugauaguagaccggggcgaucguagcggguacucuggaaucuucucaguugagggcaaaaguuguauuaaccgcugcuuuuauguggaacugaucagagguaggaaggaggaaaccgagguccuauggacaagcaauuccaucguggucuucugugggacuucuggcaccuacggaacaggcucguggcccgacggggccgaucucaaccugaugccuauuuga

SEQ ID NO: 145055 - RNA, 1410 nt, Artificial Sequence
  derived and/or modified sequence opt3 from neuraminidase__InfluenzaA__AFN19636
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccauuaucgagaaggaaauaugccccaaaccuacugaguacaggaauuggaguaagccacagugugacauuacaggguucgcucccuuuagcaaagauaacuccauccgguuaucugcaggaggugacauuuggguaacccgcgagccuuaugugucgugcgauccagacaaguguuaccaauucgcccugggccaggggacgacucuaaauaacguccauucaaauaacaccgugcgagaucguacacccuauagaacucuccugaugaaugaacuuggaguuccuuuucaccugggcaccaaacaggugugcaucgcguggagcaguuccucuugucaugacgguaaggcuugguugcacgucugcaucacaggggaugacaagaacgccaccgccagcuucauuuacaauggaaggcucguggauuccguaguuucauggaguaaagagauacugcggacgcaggaaagcgagugugugugcaucaacggcacuuguacagucgugaugaccgacggcucugcauccgggaaggcugauacuaaaauucuguuuaucgaggaaggaaagauagugcauacaucaacccucagcgguagugcacaacacgucgaggaaugcucuugcuauccacgcuacccgggcguuagaugugugugcagggacaacuggaagggguccaaucggcccauuguagauaucaacaucaaagaccacagcauugugucgucuuacgucuguuccggauuagugggcgacacgccucgcaagaaugauucaaguagcuccucucauugccuggacccaaacaaugaggaaggugggcacggaguuaaaggcugggccuucgaugacggcaacgauguguggauggggcgaaccaucaaugagacaagcagacuuggauaugagacuuuuaaggucauugaagguuggucaaaccccaaaaguaaguugcagauaaauaggcaagugaucguagaccggggcgaucguuccggguacagcggaauuuucucuguugagggcaaaucauguaucaaccgcugcuuuuauguggaacugaucagagguaggaaggaggaaaccgagguccuauggacaaguaauagcauuguggucuucugugggacuuccggcaccuacggaacaggcucuuggccugacggggcugaucucaaccugaugccaauauga

SEQ ID NO: 145056 - RNA, 1410 nt, Artificial Sequence; identical to SEQ ID NO: 145055
  derived and/or modified sequence opt3 from neuraminidase__InfluenzaA__AFN19638

SEQ ID NO: 145057 - RNA, 1410 nt, Artificial Sequence; identical to SEQ ID NO: 144938
  derived and/or modified sequence opt3 from neuraminidase__InfluenzaA__AFN19640

SEQ ID NO: 145058 - RNA, 1410 nt, Artificial Sequence
  derived and/or modified sequence opt3 from neuraminidase__InfluenzaA__AFN19642
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauaugaccgaaauuguguauuugacaaacaccacuaucgagaaggaaauuugccccaaaccugcugaguacaggaauuggaguaagccacagugugacaucacaggguucgcacccuuuagcaaagauaacuccauacgguuaucugccggaggugacauuuggguaacccgcgagccuuaugugucgugcgauccagacaaguguuaccaauucgcgcugggccaggggacgacucuaaauaacguccauucaaauaacaccgugagcgaucgaacacccuaucguacucuccugaugaaugaacuuggaguuccuuuucaccugggcaccaaacaggugugcaucgcuuggaguuccucuagcugucaugacgguaaggccugguugcacgucugcauuacaggggaugacaagaacgcaaccgccuccuucaucuacaauggaagacucguggauucaguaguuaguuggagcaaagagauccugaggacgcaggaaucugagugugugugcauuaacggcacuuguacagucgugaugaccgacggcuccgcuucagggaaggcagauacuaaaauacuguuuaucgaggaaggaaagauugugcauacaagcacccucagugguucugcccaacacgucgaggaaugcuccugcuauccacgguacccgggcguucgcugugugugcagagacaacuggaaggggagcaauaggcccaucguagauauaaacauuaaagaccacucgaucgugucuuccuacgucuguucaggauuagugggcgacacgccucggaagaaugauaguagcuccucuagccauugccuggacccaaacaaugaggaaggugggcacggaguuaaaggcugggcuuucgaugacggcaacgauguguggauggggcgcaccaucaaugagacaucacgacuuggauaugagacuuuuaaggucauugaagguuggaguaaccccaaauccaaguugcagaucaauagacaggugauuguagacaggagcgaucggucuggcuacucagggauauucaguguugagggaaaaagcuguaucaaccguugcuuuuauguggaacugauucgcggcagaaaggaggaaaccgagguccuauggacauccaauucuaucguggucuucugugguacuucggggaccuacggcacaggaagcuggccugacggcgccgaucucaaccugaugccaaucuga

SEQ ID NO: 145059 - RNA, 1410 nt, Artificial Sequence; identical to SEQ ID NO: 145055
  derived and/or modified sequence opt3 from neuraminidase__InfluenzaA__AFN19644

SEQ ID NO: 145060 - RNA, 1410 nt, Artificial Sequence
  derived and/or modified sequence opt3 from neuraminidase__InfluenzaA__AFN19646
augaaccccaaucagaagaucauuaccauaggcagcgugucccugacaaucucuacuauuugcuucuuuauccagauugccauccucauaacgaccgucacacuucacuucaaacaguacgaguuuaacucaccuccaaauaaccagguuaugcugugugaaccgacuaucauugagagaaauaucaccgaaauuguguauuugacaaacaccacuaucgagaaggaaauaugccccaaaccugcugaguacaggaauuggaguaagccacagugugacauuacaggguucgcacccuuuagcaaagauaacuccauccgguuaucugccggaggugacauuuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcaucgcuuggagcaguuccucuugucaugacgguaaggccugguugcacgucugcaucacaggggaugacaagaacgcaaccgccagcuucauuuacaauggaaggcucguggauuccguaguuucauggaguaaagagauacugcggacgcaggaaagcgagugugugugcaucaacggcacuuguacagucgugaugaccgacggcucugcuuccgggaaggcagauacuaaaauucuguuuaucgaggaaggaaagauagugcauacaucaacccucagcgguagugcccaacacgucgaggaaugcucuugcuauccacgcuacccgggcguuagaugugugugcagggacaacuggaagggguccaaucggcccauuguagauaucaacaucaaagaccacagcauugugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccaucaaugagacaagcagacuuggauaugagacuuuuaaggucauugaagguuggucaaaccccaaaaguaaguugcagauaaauaggcaagugaucguaaaccgguccgaccguagcggcuacucugggauuuucucaguugagggaaaaaguuguaucaaucgcugcuuuuauguggaacugaucagaggcaggaaggaggaaaccgagguccuauggacaagcaacuccauuguggucuucugugguacuucugggaccuacggcacaggaucguggccugauggcgccgaccucaaucugaugccaauauga

SEQ ID NO: 145061 - RNA, 1410 nt, Artificial Sequence; identical to SEQ ID NO: 144938
  derived and/or modified sequence opt3 from neuraminidase__InfluenzaA__AFN19648

SEQ ID NO: 145062 - RNA, 1410 nt, Artificial Sequence; identical to SEQ ID NO: 144974
  derived and/or modified sequence opt3 from neuraminidase__InfluenzaA__AFN19650

SEQ ID NO: 145063 - RNA, 1410 nt, Artificial Sequence
  derived and/or modified sequence opt3 from neuraminidase__InfluenzaA__AFN19652
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaagugguauauuugacaaacaccacuaucgagaaggaaauuugccccaaaccugcugaguacaggaauuggaguaagccacagugugacaucacaggguucgcacccuuuagcaaagauaacuccauacgguuaucugccggaggugacauuugggugacccgcgagccuuaugucucgugcgauccagacaaguguuaccaauucgcgcugggccaggggacgacucuaaauaacgugcauucaaauaacaccguucgagaucguacacccuauagaacucuccugaugaaugaacuuggagugccuuuucaccugggcaccaagcaggucugcaucgcuuggagcaguuccucuugucaugacgguaaagccugguugcacgugugcauuacaggggaugacaagaacgcaaccgccagcuucaucuacaauggaaggcucguagauuccguugugucauggaguaaagagauccugcggacgcaggaaagcgagugugucugcauuaacggcacuuguacaguggugaugaccgacggcucugcuuccgggaaggcagauacuaaaauacuguuuaucgaggaaggaaagauuguccauacaucaacccucagcgguagugcccaacacguugaggaaugcucuugcuauccacgcuacccgggcgugagauguguaugcagggacaacuggaagggguccaaucggcccaucguggauauaaacauuaaagaccacagcaucgucucgucuuacguguguuccggauuaguuggcgacacgccucgcaagaaugauucaaguagcuccucucauugccuggacccaaacaaugaggaaggugggcacggagugaaaggcugggcuuucgaugacggcaacgaugucuggauggggcgaaccaucaaugagacaagcagacuuggauaugagacuuuuaaggugauugaagguuggucaaaccccaaaaguaaguugcagaucaauaggcagguaauuguugaccggggcgaucguuccggguacagcggaauauucucuguggagggcaaaucauguaucaaccgcugcuuuuaugucgaacugauuagagguaggaaggaggaaaccgaggugcuauggacaaguaauagcaucgucguguucugugggacuuccggcaccuacggaacaggcucuuggccugacggggccgaucucaaccugaugccaaucuga

SEQ ID NO: 145064 - RNA, 1410 nt, Artificial Sequence
  derived and/or modified sequence opt3 from neuraminidase__InfluenzaA__AFN19654
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaacaugccccaaaccuaccgaguacaggaauuggaguaagccacagugugacaucacgggguucgcucccuuuagcaaagauaacuccauacgguuaucugcaggaggugacauuuggguaacucgcgagccuuaugugucgugcgauccagacaaguguuaccaauucgcccugggccaggggaccacacuaaauaacguccauucaaauaacacugugcgagaucguacccccuauagaacacuccugaugaaugaacuuggaguuccuuuucaccugggcaccaaacaggugugcaucgcguggagcaguuccucuugucaugacgguaaggcuugguugcacgucugcauuacgggggaugacaagaacgccacugccagcuucaucuacaauggaaggcucguggauuccguaguuucauggaguaaagagauccugcggacacaggaaagcgagugugugugcauuaacggcaccuguacugucgugaugacagacggcucugcauccgggaaggcugauaccaaaauacuguuuaucgaggaaggaaagauugugcauacgucaacccucagcgguagugcacaacacgucgaggaaugcucuugcuauccacgcuacccgggcguuagaugugugugcagggacaacuggaagggguccaaucggcccaucguagauauaaacauuaaagaccacagcaucgugucgucuuacgucuguuccggauuagugggcgacacaccucgcaagaaugauucaaguagcuccucucauugccuggacccaaacaaugaggaaggugggcacggaguuaaaggcugggccuucgaugacggcaacgauguguggauggggcgaacuaucaaugagaccagcagacuuggauaugagacauuuaaggucauugaagguuggucaaaccccaaaaguaaguugcagaucaauaggcaagugauuguagaccggggcgaucguuccggguacagcggaauauucucuguugagggcaaaucauguaucaaccgcugcuuuuauguggaacugauuagagguaggaaggaggaaacugagguccuauggaccaguaauagcaucguggucuucugugggacauccggcaccuacggaacuggcucuuggccugacggggcugaucucaaccugaugccaaucuga

SEQ ID NO: 145065 - RNA, 1410 nt, Artificial Sequence; identical to SEQ ID NO: 144938
  derived and/or modified sequence opt3 from neuraminidase__InfluenzaA__AFN19656

SEQ ID NO: 145066 - RNA, 1410 nt, Artificial Sequence; identical to SEQ ID NO: 144162
  derived and/or modified sequence opt3 from neuraminidase__InfluenzaA__AFN19658

SEQ ID NO: 145067 - RNA, 1410 nt, Artificial Sequence; identical to SEQ ID NO: 145055
  derived and/or modified sequence opt3 from neuraminidase__InfluenzaA__AFN19660

SEQ ID NO: 145068 - RNA, 1410 nt, Artificial Sequence; identical to SEQ ID NO: 144162
  derived and/or modified sequence opt3 from neuraminidase__InfluenzaA__AFN19662

SEQ ID NO: 145069 - RNA, 1410 nt, Artificial Sequence
  derived and/or modified sequence opt3 from neuraminidase__InfluenzaA__AFN19664
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaauaccauugagaaggaaaucugccccaaaccugcugaguacaggaacuggaguaagccacagugugggauaacuggauucgcacccuuuagcaaagacaauuccauucgguuaucugccgguggcgauaucuggguaacacgcgagccuuaugugucgugcgacccagauaaguguuaccaauucgcgcuggggcagggaaccacgcuaaacaauguccauucaaacaauacugugcgagaccguacccccuauagaacacuccugaugaacgaacuuggcguuccuuuucaccuggguacuaaacaggugugcauugcuuggagcaguuccucuugucaugaugggaaggccugguugcacgucugcaucaccggagacgauaagaaugcaacagccagcuucaucuacaacggcaggcucguggacuccguaguuucauggaguaaagagauucugcggacccaggaaagcgagugugugugcauaaacggcacguguacugucgugaugacagaugggucugcuuccggaaaggcagacaccaaaauccuguuuauugaggaagguaagaucgugcauacuucaacacucagcggcagugcccaacacgucgaggaaugcucuugcuauccacgcuacccggggguuagaugugugugcagggauaauuggaagggauccaaccggcccauaguagacauuaauaucaaagaucacagcaucgugucgucuuacgucuguuccggcuuagugggugacaccccucgcaagaacgacucaaguagcuccucucauugccuggauccaaauaacgaggaagggggacacggcguuaaaggcugggcuuucgacgaugggaaugacguguggaugggacgaacgauuaacgagaccagcagacuugguuaugagacauuuaaggucaucgaaggcuggucaaaucccaaaaguaaguugcagauuaacaggcaagugauaguagaucguggggaccgguccggauacagcggcaucuucucuguugaggguaaaucauguauuaaucgcugcuuuuauguggaacugaucagagggaggaaggaggaaacugagguccuauggaccaguaacagcaucguggucuucuguggcacauccggaacuuacggcaccgggucuuggccugauggagccgaccucaaucugaugccaauuuga

SEQ ID NO: 145070 - RNA, 1410 nt, Artificial Sequence
  derived and/or modified sequence opt3 from neuraminidase__InfluenzaA__AFN19666
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauaugaccgaaauuguguauuugacaaacaccacuaucgagaaggaaauuugccccaaaccugcugaguacaggaauuggaguaagccacagugugacaucacaggguucgcacccuuuagcaaagauaacuccauacgguuaucugccggaggugacauuuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcaucgcuuggagcaguuccucuugucaugacgguaaggccugguugcacgucugcauuacaggggaugacaagaacgcaaccgccagcuucaucuacaauggaaggcucguggauuccguaguuucauggaguaaagagauccugcggacgcaggaaagcgagugugugugcauuaacggcacuuguacagucgugaugaccgacggcucugcuuccgggaaggcagauacuaaaauacuguuuaucgaggaaggaaagauugugcauacaucaacccucagcgguagugcccaacacgucgaggaaugcucuugcuauccacgcuacccgggcguuagaugugugugcagggacaacuggaagggguccaaucggcccaucguagauauaaacauuaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccaucaaugagacaagcagacuuggauaugagacuuuuaaggucauugaagguuggucaaaccccaaaaguaaguugcagaucaauaggcaagugauuguaaaccgguccgaccguagcggcuacucugggauauucucaguugagggaaaaaguuguaucaaucgcugcuuuuauguggaacugauuagaggcaggaaggaggaaaccgagguccuauggacaagcaacuccaucguggucuucugugguacuucugggaccuacggcacaggaucguggccugauggcgccgaccucaaucugaugccaaucuga

SEQ ID NO: 145071 - RNA, 1410 nt, Artificial Sequence
  derived and/or modified sequence opt3 from neuraminidase__InfluenzaA__AFN19668
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauaugaccgaaauuguguauuugacaaacaccacuaucgagaaggaaauuugccccaaaccugcugaguacaggaauuggaguaagccacagugugacaucacaggguucgcacccuuuagcaaagauaacuccauacgguuaucugccggaggugacauuuggguaacccgcgagccuuaugugucgugcgauccagacaaguguuaccaauucgcgcugggccaggggacgacucuaaauaacgaacauucaaauaacaccguccgagaucguacacccuauagaacucuccugaugaaugagcuuggagugccuuuucaccugggcaccaagcagguuugcaucgcuuggagcaguuccucuugucaugacgguaaagccugguugcacgugugcauuacaggggaugacaagaacgcaaccgccagcuucaucuacaauggaaggcucgucgauuccgugguaucauggaguaaagaaauccugcggacgcaggagagcgaguguguuugcauuaacggcacuuguacaguggucaugaccgacggcucugcuuccgggaaggcagauacuaaaauacuguuuaucgaagagggaaagauugugcauacaucaacccucagcgguagugcccaacacguggaagagugcucuugcuauccacgcuacccgggcgucagauguguuugcagggacaacuggaagggguccaaucggcccaucguggauauaaacauuaaagaccacagcaucguaucgucuuacguguguuccggauuagucggcgacacgccucgcaagaaugauucaaguagcuccucucauugccuggacccaaacaaugaagagggugggcacggagugaaaggcugggcuuucgaugacggcaacgauguuuggauggggcgaaccaucaaugagacaagcagacuuggauaugaaacuuuuaaggugauugaggguuggucaaaccccaaaaguaaguugcagaucaauaggcaggucauuguggaccgguccgaucguagcggcuacucugggauauucucaguagaaggaaaaaguuguaucaaccgcugcuuuuauguugagcugauuagaggcaggaaggaagagaccgaggugcuauggacaagcaauuccaucgucguguucugugguacuucugggaccuacggcacaggaucguggccugacggcgccgaucucaaccugaugccaaucuga

SEQ ID NO: 145072 - RNA, 1410 nt, Artificial Sequence; identical to SEQ ID NO: 144974
  derived and/or modified sequence opt3 from neuraminidase__InfluenzaA__AFN19670

SEQ ID NO: 145073 - RNA, 1410 nt, Artificial Sequence; identical to SEQ ID NO: 144162
  derived and/or modified sequence opt3 from neuraminidase__InfluenzaA__AFN19673

SEQ ID NO: 145074 - RNA, 1410 nt, Artificial Sequence; identical to SEQ ID NO: 144938
  derived and/or modified sequence opt3 from neuraminidase__InfluenzaA__AFN19675

SEQ ID NO: 145075 - RNA, 1410 nt, Artificial Sequence
  derived and/or modified sequence opt3 from neuraminidase__InfluenzaA__AFN19677
augaaccccaaucagaagaucauuaccauaggcagcgugucccugacaaucucuauuaucugcuucuuuaugcagauugccauccucauaacuacggucacccuucacuucaaacaguacgaguuuaacucaccuccaaauaaccagguuaugcugugugaaccgacaaucauugagagaaauaucacugaaauuguguauuugaccaacacaaccaucgagaaggaaauaugccccaaaccugcugaguacaggaauuggaguaagccacagugugacauuacuggguucgcacccuuuagcaaagauaacuccauccgguuaucugccggaggugacauuuggguaacacgcgagccuuaugugucgugcgauccagacaaguguuaccaauucgcgcugggccaggggaccacgcuaaauaacguccauucaaauaacacugugcgagaucguacccccuauagaacacuccugaugaaugaacuuggaguuccuuuucaccugggcacuaaacaggugugcaucgcuuggagcaguuccucuugucaugacgguaaggccugguugcacgucugcaucaccggggaugacaagaacgcaacagccagcuucauuuacaauggaaggcucguggauuccguaguuucauggaguaaagagauacugcggacccaggaaagcgagugugugugcaucaacggcacguguacugucgugaugacagacggcucugcuuccgggaaggcagauaccaaaauucuguuuaucgaggaaggaaagauagugcauacuucaacacucagcgguagugcccaacacgucgaggaaugcucuugcuauccacgcuacccgggcguuagaugugugugcagggacaacuggaagggguccaaucggcccauuguagauaucaacaucaaagaccacagcauugugucgucuuacgucuguuccggauuagugggcgacaccccucgcaagaaugauucaaguagcuccucucauugccuggacccaaacaaugaggaaggugggcacggaguuaaaggcugggcuuucgaugacggcaacgauguguggauggggcgaacgaucaaugagaccagcagacuuggauaugagacauuuaaggucauugaagguuggucaaaccccaaaaguaaguugcagauaaauaggcaagugaucguagaccggggcgaucguuccggguacagcggaauuuucucuguugagggcaaaucauguaucaaccgcugcuuuuauguggaacugaucagagguaggaaggaggaaacugagguccuauggaccaguaauagcauuguggucuucugugggacauccggcacuuacggaaccggcucuuggccugacggggccgaucucaaccugaugccaauauga

SEQ ID NO: 145076 - RNA, 1410 nt, Artificial Sequence; identical to SEQ ID NO: 144974
  derived and/or modified sequence opt3 from neuraminidase__InfluenzaA__AFN19683

SEQ ID NO: 145077 - RNA, 1410 nt, Artificial Sequence; identical to SEQ ID NO: 144938
  derived and/or modified sequence opt3 from neuraminidase__InfluenzaA__AFN19685

SEQ ID NO: 145078 - RNA, 1410 nt, Artificial Sequence; identical to SEQ ID NO: 144938
  derived and/or modified sequence opt3 from neuraminidase__InfluenzaA__AFN19687

SEQ ID NO: 145079 - RNA, 1410 nt, Artificial Sequence; identical to SEQ ID NO: 144938
  derived and/or modified sequence opt3 from neuraminidase__InfluenzaA__AFN19689

SEQ ID NO: 145080 - RNA, 1410 nt, Artificial Sequence; identical to SEQ ID NO: 144162
  derived and/or modified sequence opt3 from neuraminidase__InfluenzaA__AFN19691

SEQ ID NO: 145081 - RNA, 1410 nt, Artificial Sequence
  derived and/or modified sequence opt3 from neuraminidase__InfluenzaA__AFN19693
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagacauucugcggacgcaggagagcgaaugugugugcauaaacggcacuugugcugucgugaugacagauggcucugcauccgggaaggccgacaccaaaauccucuuuauugaggagggaaagaucgugcauacuucaacauuaagcgguagugcucaacacgucgaagagugcucuugcuauccucgcuacccaggcguuagaugugugugcagggauaacuggaagggguccaaucggccgauaguagacauuaacaucaaagaccacagcaucgugucgucuuacgucuguuccggacuggugggcgauacccccaggaagaaugacucaaguagcuccucuaacugccuugauccuaauaacgaagagggugggcauggaguuaaaggcugggccuucgacgauggcaaugacguguggauggggcgaacgauuaacgaaaccagcagauugggauaugagacauuuaaggucaucgaggguuggucaaauccaaaaaguaagcugcagauuaaccgccaggugauaguagaucggggcaaucguuccggguacagcggaaucuucucuguugaaggcaaaaacuguauuaaucgcugcuuuuauguggagcuaaucagagguaggaaggaagagacugaaguccucuggaccucaaacaguaucguggucuucugugggacaagcggcacuuacggaaccggcuccuggcccgacggggcggaucugaaucuuaugccuauuuga

SEQ ID NO: 145082 - RNA, 1410 nt, Artificial Sequence
  derived and/or modified sequence opt3 from neuraminidase__InfluenzaA__AFN19697
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagacgcugcggacucaggaaagcgagugugugugcauuaacggcacauguaccgucgugaugacugaugggucugcuuccggaaaggcagacacaaaaauacuguuuaucgaggaagguaagauugugcauaccucaacgcucagcggcagugcccaacacgucgaggaaugcucuugcuauccacgcuacccggggguuagaugugugugcagggauaacuggaagggauccaaucggcccaucguagacauaaacauuaaagaucacagcaucgugucgucuuacgucuguuccggcuuagugggugacaccccucgcaagaaugacucaaguagcuccucucauugccuggauccaaacaaugaggaagggggacacggcguuaaaggcugggcuuucgacgaugggaacgacguguggaugggacgaacaaucaaugagacuagcagacuugguuaugagaccuuuaaggucauugaaggcuggucaaaccccaaaaguaaguugcagaucaauaggcaagugauuguagaucguggggaccgguccggauacagcggcauauucucuguugaggguaaaucauguaucaaccgcugcuuuuauguggaacugauuagagggaggaaggaggaaacagagguccuauggaccaguaauagcaucguggucuucuguggcacuuccggaacauacggcaccgggucuuggccugauggagccgaccucaaccugaugccaaucuga

SEQ ID NO: 145083 - RNA, 1410 nt, Artificial Sequence; identical to SEQ ID NO: 144938
  derived and/or modified sequence opt3 from neuraminidase__InfluenzaA__AFN19699

SEQ ID NO: 145084 - RNA, 1410 nt, Artificial Sequence; identical to SEQ ID NO: 144974
  derived and/or modified sequence opt3 from neuraminidase__InfluenzaA__AFN19701

SEQ ID NO: 145085 - RNA, 1410 nt, Artificial Sequence
  derived and/or modified sequence opt3 from neuraminidase__InfluenzaA__AFN19703
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuagacaauguccauucaaacaauaccgugcgagaucguacacccuauagaacucuccugaugaacgaacuuggcguuccuuuucaccuggguaccaaacaggugugcauugcuuggagcaguuccucuugucaugacgggaaggccugguugcacgucugcaucacaggagaugacaagaaugcaaccgccagcuucaucuacaacggcaggcucguggauuccguaguuucauggaguaaagagauucugcggacgcaggaaagcgagugugugugcauaaauggcacuuguacagucgugaugaccgacgggucugcuuccggaaaggcagauacuaaaauccuguuuauugaggaagguaagaucgugcauacaucaacccucagcggcagugcccaacacgucgaggaaugcucuugcuauccacgcuacccggggguuagaugugugugcagggacaacuggaagggauccaaccggcccauaguagauauuaauaucaaagaccacagcaucgugucgucuuacgucuguuccggcuuagugggugacacgccucgcaagaacgauucaaguagcuccucucauugccuggacccaaauaacgaggaagggggacacggcguuaaaggcugggcuuucgaugacgggaaugauguguggaugggacgaaccauuaacgagacaagcagacuugguuaugagacuuuuaaggucaucgaaggcuggucaaaucccaaaaguaaguugcagauuaacaggcaagugauaguagaccguggggaucgguccggauacagcggcaucuucucuguugaggguaaaucauguauuaaucgcugcuuuuauguggaacugaucagagggaggaaggaggaaaccgagguccuauggacaaguaacagcaucguggucuucuguggcacuuccggaaccuacggcacagggucuuggccugacggagccgaucucaaucugaugccaauuuga

SEQ ID NO: 145086 - RNA, 1410 nt, Artificial Sequence; identical to SEQ ID NO: 142273
  derived and/or modified sequence opt3 from neuraminidase__InfluenzaA__AFN19711

SEQ ID NO: 145087 - RNA, 1410 nt, Artificial Sequence
  derived and/or modified sequence opt3 from neuraminidase__InfluenzaA__AFN19721
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccgauggaaugccggaccuuuuucuuaacacagggggcucugcuaaacgacaagcauaguaauggaaccaucaaagaucgcagccccuaucgaacucucaugucuuguccuauuggcgaggucccaucccccuacaacucacguuuugaaagcguggccuggagugcaucugccugccacgacggcauaaacuggcugacaaucgggauuuccggaccugauaauggugcuguagcaguucuuaaguauaacggcaucauaaccgacacgauuaagagcuggagaaauaacauccugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaauuuggaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucggucggacaaaaaguauuagcucccgcaagggguucgagaugauaugggauccaaacggcuggaccggaacggacaauaacuuuucuaucaaacaagacauugugggcaucaaugaauggucgggguacagcggauccuucguccagcaucccgagcucacuggucuggauuguauucgaccuugcuucuggguggaacugaucagaggcaggccaaaggagaacacaauauggaccucagggaguucuaucagcuuuuguggaguuaauuccgacacugugggcuggucauggcccgauggugcagagcucccguucacaauugacaaauga

SEQ ID NO: 145088 - RNA, 1410 nt, Artificial Sequence; identical to SEQ ID NO: 143094
  derived and/or modified sequence opt3 from neuraminidase__InfluenzaA__AFN19731

SEQ ID NO: 145089 - RNA, 1410 nt, Artificial Sequence; identical to SEQ ID NO: 142273
  derived and/or modified sequence opt3 from neuraminidase__InfluenzaA__AFN19737

SEQ ID NO: 145090 - RNA, 1410 nt, Artificial Sequence
  derived and/or modified sequence opt3 from neuraminidase__InfluenzaA__AFN19747
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacgcaugaaaauaacaccuggguuaaucagacauacgugaacaucagcaauacuaacuucgcugcaggccaguccguagugucugucaaacuggccggaaauucgucauugugcccugugagcgggugggcgauauauaguaaggacaacuccauuagaaucggcucuaaaggugauguuuuugugauuagggagccauucaucagcuguuccccguuagaaugccggaccuuuuuccugacacagggggcucuacucaaugacaagcacucaaacggaaccaucaaagaucgcagucccuaccgaacucugaugagcuguccuauuggcgaggucccaucucccuauaacucccguuuugaaucaguggccuggagcgcaagugccugccaugacggcauaaauuggcuuacaaucgggauuucuggaccugauaacggugcuguagcaguucugaaguacaauggcaucauaaccgacacgauuaaguccuggagaaacaauaucuugaggacucaagagagcgagugugccugcgugaacgggucguguuucaccgucaugacagauggaccaucugacggccaggcuuccuauaaaaucuuucggauugaaaaggguaaaaucgugaagucaguggagaugaaugcccccaacuaccacuaugaagagugcaguuguuacccugauagcuccgagauuacuugcgucugccgcgacaauuggcauggggcgaacagaccauggguuucuuucaaucagaaccucgaauaccagauaggauauaucuguagcggcauuuuuggcgauaauccgaggcccaacgacaaaaccgggucaugcggaccugugaguuccaauggugcaaacggcguaaagggguucagcuuuaaguacggaaacggcguguggaucggucggacaaaaucuaucucaagucgcaauggguucgagaugauuugggauccaaacggcuggaccggaacggacaauaacuuuagcauaaagcaagacaucgucggcauuaaugaaugguccggguauucuggaucguucgugcagcaccccgagcugacuggucuggauuguauccgaccuugcuucuggguugaacucauuagaggcaggccaaaagagaacacaaucuggaccagcggguccucaauaaguuuuuguggagucaauucugacacugugggcuggagcuggcccgauggugccgaguuaccguucacaaucgacaaguga

SEQ ID NO: 145091 - RNA, 1410 nt, Artificial Sequence; identical to SEQ ID NO: 142273
  derived and/or modified sequence opt3 from neuraminidase__InfluenzaA__AFN19749

SEQ ID NO: 145092 - RNA, 1410 nt, Artificial Sequence; identical to SEQ ID NO: 142273
  derived and/or modified sequence opt3 from neuraminidase__InfluenzaA__AFN19759

SEQ ID NO: 145093 - RNA, 1410 nt, Artificial Sequence
  derived and/or modified sequence opt3 from neuraminidase__InfluenzaA__AFN19769
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauagagcuguagcaguucugaaguauaacgguaucauaaccgacacgauuaagagcuggaggaauaacaucuugcggacucaagagucggagugugccugcgugaauggcucuuguuucaccaucaugacagaugggccauccgacggacaggcuucauacaaaauuuuucgcaucgaaaagggcaaaauugucaagaguguggagaugaacgcccccaauuaucauuacgaagagugcagcuguuacccugauuccucugagauaacuugcgugugcagagacaacuggcacgguagcaauaggccaugggucucauucaaccagaaucucgaauaucagaucggguacauuuguaguggaaucuuuggcgauaacccgcggcccaaugacaaaaccggcuccugcgggccuguuagcucuaacggagcgaauggugugaagggcuucucauuuaaguaugggaacggaguauggaucggccgcacaaaaaguauuagcucccgaaaggguuucgagaugauaugggauccaaacggguggaccggcacggacaauaacuuuucuaucaaacaagacauugugggaaucaaugaauggucgggcuacagcggguccuucguccagcaucccgagcugacuggacuggauuguauuagaccuugcuucuggguggaacucaucaggggucggccaaaggagaacacaauauggaccucaggcaguucuaucagcuuuugugggguuaauuccgacacugugggauggucauggcccgauggcgcagaguuaccguucacaauugacaaauga

SEQ ID NO: 145094 - RNA, 1410 nt, Artificial Sequence; identical to SEQ ID NO: 142273
  derived and/or modified sequence opt3 from neuraminidase__InfluenzaA__AFN19783

SEQ ID NO: 145095 - RNA, 1410 nt, Artificial Sequence; identical to SEQ ID NO: 142974
  derived and/or modified sequence opt3 from neuraminidase__InfluenzaA__AFN19793

SEQ ID NO: 145096 - RNA, 1410 nt, Artificial Sequence; identical to SEQ ID NO: 142273
  derived and/or modified sequence opt3 from neuraminidase__InfluenzaA__AFN19807

SEQ ID NO: 145097 - RNA, 1410 nt, Artificial Sequence
  derived and/or modified sequence opt3 from neuraminidase__InfluenzaA__AFN19809
augaaccccaaucagaagaucauuaccauaggcagcgugugcaugaucauugggauggccaaccugaugcuccaaaucggaaauauuaucuccauauggaucucucacucaauucagcuugguaaccagaaucagaucgagacauguaaccaaagugucauuacuuacgaaaauaacacguggguuaaucagaccuaugugaacaucagcaauacaaacuucgcugcaggccaguccguaauaucugugaaacuggccggaaauucgucauugugcccugucagcgggugggcgauuuacaguaaggacaacuccaucagaauuggcucuaaaggugauguguuuguuaucagggagccauucaucagcuguuccccguuagaaugccggaccuuuuuccugacucagggggcucuacucaaugacaagcauucaaacggaacaauuaaagaucgcagucccuaucgaacccugaugagcuguccuauaggcgaggugccaucucccuacaacucccguuuugaaucagucgccuggagcgcaagugccugccacgacggcaucaauuggcuuacuauugggaucucuggaccugauaacggugcuguggcaguacugaaguauaauggcauaauuacagacaccaucaaguccuggagaaacaauaucuugaggacgcaagagagcgagugugccugcguuaacgggucguguuucacugugaugaccgauggaccaucugacggccaggcuuccuacaaaauuuuucggaucgaaaaggguaaaauugucaagucaguggagaugaaugcccccaacuaucauuacgaagagugcaguuguuacccugauagcuccgagauaacaugcgugugccgcgacaauuggcacgggucuaacagaccaugggucagcuucaaucagaaccucgaauaucagaucggauacauuuguucaggcaucuuuggcgauaauccgaggcccaacgacaaaacugggaguugcggaccuguuuccaccaauggugcgaacggcgugaagggguucagcuuuaaguauggaaacggcguauggaucggucggacaaaaucuauuucaagucgcaauggguucgagaugauaugggauccaaacggcuggaccggaacggacaauaaguuuagcaucaaacaagacauugugggcaucaacgaaugguccggguacucuggaucguucguccagcaucccgagcugacuggucuggauuguauucgaccuugcuucuggguggaacucaucagaggcaggccaaaggagaauacaauauggaccagcggguccucaaucaguuuuuguggaguuaacucugacacugugggcuggagcuggcccgauggugcagaguuaccguucacaauugacaaauga

SEQ ID NO: 145098 - RNA, 1410 nt, Artificial Sequence; identical to SEQ ID NO: 143096
  derived and/or modified sequence opt3 from neuraminidase__InfluenzaA__AFN19815

SEQ ID NO: 145099 - RNA, 1410 nt, Artificial Sequence
  derived and/or modified sequence opt3 from neuraminidase__InfluenzaA__AFN19833
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggaaaaauaacaucuugagaacucaagagucggagugugccugcgugaaugggucuuguuucaccaucaugacagauggaccauccgacggccaggcuucauacaagauuuuuaggaucgaaaaagguaagauugucaaaaguguggagaugaacgcccccaauuaucauuacgaagagugcagcuguuacccugauuccucugagauaacuugcgugugccgggacaacuggcacgggagcaaucgcccaugggucucauucaaccagaaucucgaauaucagaucggauacauuuguaguggcaucuuuggcgauaacccgagacccaaugacaagaccggguccugcggaccuguuagcucuaacggugcgaauggcgugaagggguucucauuuaaauauggaaacggcguauggaucgguaggacaaagaguauuagcucccggaaaggguucgagaugauaugggauccaaacggcuggaccggaacggacaauaacuuuucuaucaagcaagacauugugggcaucaaugaauggucgggguacagcggauccuucguccagcaucccgagcugacuggucuggauuguauucgcccuugcuucuggguggaacucauccgaggcagaccaaaagagaacacaauauggaccucagggaguucuaucagcuuuuguggaguuaauuccgacacugugggcuggucauggcccgauggugcagaguuaccguucacaauugacaaguga

SEQ ID NO: 145100 - RNA, 1410 nt, Artificial Sequence; identical to SEQ ID NO: 142732
  derived and/or modified sequence opt3 from neuraminidase__InfluenzaA__AFN19851

SEQ ID NO: 145101 - RNA, 1410 nt, Artificial Sequence; identical to SEQ ID NO: 142273
  derived and/or modified sequence opt3 from neuraminidase__InfluenzaA__AFN19857

SEQ ID NO: 145102 - RNA, 1410 nt, Artificial Sequence
  derived and/or modified sequence opt3 from neuraminidase__InfluenzaA__AFN19867
augaaccccaaucagaagaucauuaccauaggcagcgugugcaugacaaucgggauggccaaccugauucuccaaaucggaaauauuaucuccauauggaucucucacucaauucagaucgguaaccagaaucagauugagacuuguaaccaaagugucaucacguacgaaaauaacaccuggguuaaucagacauaugugaacauaagcaauacuaacuucgcugcaggccaguccguagugucugucaaacuugccggaaauucgucacugugcccugugagcggaugggcgauuuacaguaaggacaacuccaucagaauuggcucuaaaggugauguuuuugugaucagggagccauucaucagcuguuccccguuggaaugccggaccuuuuucuuaacacagggggcucugcuaaaugacaagcauucaaacggaaccauuaaagaucgcagucccuaucgaacucucaugagcuguccuauaggcgaggucccaucucccuacaacucccguuuugaaucaguggccuggagcgcaagugccugccacgacggcaucaauuggcugacaauugggaucucuggaccugauaacggugcuguagcaguucuuaaguauaauggcauaauuaccgacacgaucaaguccuggagaaacaauauccugaggacucaagagagcgagugugccugcgugaacgggucguguuucaccauuaucacagauggaccaucugacggccaggcuuccuacaaaauuuuucggauagaaaaggguaaaaucgucaagucaguggagaugaaugcccccaacuaucauuacgaagagugcaguuguuacccugauagcuccgagauuacuugcgugugccgcgacaauuggcacgggucuaacagaccaugggucagcuucaaucagaacuuggaauaucagaucggauacaucuguucaggcauuuuuggcgauaauccgaggcccaacgacaaaaccgggaguugcggaccuguuuccagcaauggugcgaacggcgugaagggguucucuuuuaaguauggaaacggcguauggauaggucggacaaaaucaaucaguagccgcaagggguucgagaugauuugggauccaaauggcuggaccggaacggacaacaauuuuuccaucaaacaagacauugugggcaucaacgaauggucuggguacucggggagcuucguccagcaucccgagcucacuggucuggauuguauacgaccuugcuucuggguggaacugaucagaggcaggccaaaggagaauacaauuuggaccuccgggucaaguaucucuuuuuguggaguuaacagcgacacugugggcugguccuggcccgauggugcagagcucccguucacaauugacaaauga

SEQ ID NO: 145103 - RNA, 1410 nt, Artificial Sequence; identical to SEQ ID NO: 142725
  derived and/or modified sequence opt3 from neuraminidase__InfluenzaA__AFN19877

SEQ ID NO: 145104 - RNA, 1410 nt, Artificial Sequence; identical to SEQ ID NO: 142273
  derived and/or modified sequence opt3 from neuraminidase__InfluenzaA__AFN19887

SEQ ID NO: 145105 - RNA, 1410 nt, Artificial Sequence
  derived and/or modified sequence opt3 from neuraminidase__InfluenzaA__AFN19897
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccugcaacucacguuuugaaagcguggccuggagugcaucugccugucacgacggcauaaacuggcuuacaaucgggauuuccggaccugauaauggugcuguagcaguucugaaguacaacggcaucauaaccgacacgauuaagagcuggagaaauaacaucuugaggacucaagagucggagugcgccugugugaaugggucuugcuucaccaucaugacagauggaccauccgacggccaggcuucauauaaaauuuuucggaucgaaaaggguaaaauugucaagaguguggagaugaacgcccccaauuaccauuaugaagaguguagcugcuacccugauuccucugagauaacuugcgugugucgcgacaacuggcacgggagcaauagaccaugggucucauucaaccagaaucucgaauaccagaucggauauauuugcaguggcaucuuuggcgauaacccgaggcccaaugacaaaaccggguccuguggaccuguuagcucuaacggugcgaauggcgugaagggguucucauuuaaguacggaaacggcguauggaucggucggacaaaaaguauuagcucccgcaagggguucgagaugauaugggauccaaacggcuggaccggaacggacaauaacuuuucuaucaaacaagacauugugggcaucaaugaauggucgggguauagcggauccuucguccagcaucccgagcugacuggucuggauugcauucgaccuuguuucuggguggaacucaucagaggcaggccaaaggagaacacaauauggaccucagggaguucuaucagcuuuugcggaguuaauuccgacacugugggcuggucauggcccgauggugcagaguuaccguucacaauugacaaauga

SEQ ID NO: 145106 - RNA, 1410 nt, Artificial Sequence; identical to SEQ ID NO: 142273
  derived and/or modified sequence opt3 from neuraminidase__InfluenzaA__AFN19907

SEQ ID NO: 145107 - RNA, 1410 nt, Artificial Sequence; identical to SEQ ID NO: 142732
  derived and/or modified sequence opt3 from neuraminidase__InfluenzaA__AFN19917

SEQ ID NO: 145108 - RNA, 1410 nt, Artificial Sequence
  derived and/or modified sequence opt3 from neuraminidase__InfluenzaA__AFN19923
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaaacgucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcaagggguucgagaugauaugggauccaaauggcuggaccggaacggacaacaauuuuuccaucaaacaagacauugugggcaucaacgaauggucuggguacucggggagcuucguccagcaucccgagcugacuggucuggauuguauucgaccuugcuucuggguggaacucaucagaggcaggccaaaggagaauacaauauggaccuccgggucaaguaucucuuuuuguggaguuaacagcgacacugugggcugguccuggcccgauggugcagaguuaccguucacaauugacaaauga

SEQ ID NO: 145109 - RNA, 1410 nt, Artificial Sequence; identical to SEQ ID NO: 142273
  derived and/or modified sequence opt3 from neuraminidase__InfluenzaA__AFN19933

SEQ ID NO: 145110 - RNA, 1410 nt, Artificial Sequence; identical to SEQ ID NO: 142732
  derived and/or modified sequence opt3 from neuraminidase__InfluenzaA__AFN19943

SEQ ID NO: 145111 - RNA, 1410 nt, Artificial Sequence
  derived and/or modified sequence opt3 from neuraminidase__InfluenzaA__AFN19953
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagagucauuacguacgaaaacaauaccuggguuaaccagacauaugugaauaucagcaacacuaauuucgcugcaggccaguccguagugucugucaaacuggccgggaacucgucauugugcccugugagcggaugggcgauauacaguaaggacaauuccauuaggaucggcucuaaaggugauguuuuugugauucgggagccauucaucagcuguuccccguuagaaugccgcaccuuuuuccugacacagggggcucuacucaacgacaagcauucaaauggaaccaucaaagaucgaagucccuaucguacucugaugagcuguccuauuggcgaggucccaucucccuacaacuccagauuugaaucaguggccuggagcgcaagugccugccacgacggcauaaacuggcuuacaaucgggauuucuggaccugauaauggugcuguagcaguucugaaguauaacggcaucauaaccgacacgauuaaguccuggaggaauaacaucuugcggacucaagagagcgagugugccugcgugaaugggucguguuucaccaucaugacagauggaccaucugacggccaggcuuccuacaaaauuuuucgcaucgaaaaggguaaaauugucaagucaguggagaugaacgcccccaauuaucauuacgaagagugcaguuguuacccugauagcuccgagauaacuugcgugugcagagacaacuggcacgggucuaauaggccaugggucagcuucaaccagaaucucgaauaucagaucggauacauuuguucaggcaucuuuggcgauaacccgcggcccaaugacaaaaccgggaguugcggaccuguuuccagcaacggugcgaauggcgugaagggguucucuuuuaaguauggaaacggcguauggaucggucgcacaaaaucaauuaguagccgaaagggguucgagaugauaugggauccaaacggcuggaccggaacggacaauaacuuuuccaucaaacaagacauuguggaaaucaaugaguggucuggcuacucggggagcuucguccagcaucccgaacugacuggacuggauuguauuagaccuugcuucuggguggagcucaucaggggucggccaaaggagaacacaauauggaccuccggcucaaguaucucuuuuugugggguuaauagcgacacugugggaugguccuggcccgauggcgcagaauuaccguucacaauugacaaauga

SEQ ID NO: 145112 - RNA, 1410 nt, Artificial Sequence
  derived and/or modified sequence opt3 from neuraminidase__InfluenzaA__AFN19967
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaucgaauaucuugaggacucaagagucugagugugccugcgugaacggguccuguuucaccaucaugacagauggaccaucagacggccaggcuaguuacaaaauuuuucggaucgaaaaggguaaaauugucaagagcguggagaugaaugcccccaacuaucauuacgaagagugcuccuguuacccugauucuagcgagauaacuugcgugugccgcgacaauuggcacgggucaaacagaccaugggucaguuucaaucagaaccucgaauaucagaucggauacauuuguuccggcaucuuuggcgauaauccgaggcccaacgacaaaaccgggagcugcggaccuguuucuucaaauggugcgaacggcgugaagggguucaguuuuaaguauggaaauggcguauggaucggucggacaaaaagcauuuccucucgcaagggguucgagaugauaugggauccaaacggcuggaccggaacggacaacaauuuuucgaucaaacaagacauugugggcaucaacgaauggagcggguacuccggaucauucguccagcaucccgagcugacuggucuggauuguauucgaccuugcuucuggguggaacucaucagaggcaggccaaaggagaauacaauauggaccagugggucuagcaucuccuuuuguggaguuaacucagacacugugggcuggagcuggcccgauggugcagaguuaccguucacaauugacaaauga

SEQ ID NO: 145113 - RNA, 1410 nt, Artificial Sequence
  derived and/or modified sequence opt3 from neuraminidase__InfluenzaA__AFN19973
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggauccucagacggccaggcuaguuacaaaauuuuucggaucgaaaaggguaaaauugucaagagcguggagaugaacgccccaaauuaucauuacgaagagugcuccuguuaccccgauucuagcgagauaacuugcgugugccgcgacaacuggcacgggucaaauagaccuugggucaguuucaaccagaaucucgaauaucagaucggauacauuuguuccggcaucuuuggcgauaacccaaggccgaaugacaaaaccgggagcugcggacccguuucuucaaacggugcgaauggcgugaagggguucaguuuuaaguauggaaacggcguauggaucggucggacaaaaagcauuuccucucgcaagggguucgagaugauaugggauccuaacggcuggaccggaacggacaauaacuuuucgaucaaacaagacauugugggcaucaaugaauggagcggguacuccggaucauucguccagcauccagagcugacuggucuggauuguauucgacccugcuucuggguggaacucaucagaggcaggccuaaggagaacacaauauggaccagugggucuagcaucuccuuuuguggaguuaauucagacacugugggcuggagcuggccagauggugcagaguuacccuucacaauugacaaauga

SEQ ID NO: 145114 - RNA, 1410 nt, Artificial Sequence; identical to SEQ ID NO: 142273
  derived and/or modified sequence opt3 from neuraminidase__InfluenzaA__AFN19979

SEQ ID NO: 145115 - RNA, 1410 nt, Artificial Sequence
  derived and/or modified sequence opt3 from neuraminidase__InfluenzaA__AFN19985
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucggucggacaaaaagugugagcucccgcaagggguucgagaugauuugggauccaaacggcuggaccggaacggacaauaacuuuucuauaaaacaagacaucgucggcauuaaugaauggucgggguacagcggauccuucgugcagcaucccgagcugacuggucuggauuguauccgaccuugcuucuggguugaacucauuagaggcaggccaaaggagaacacaaucuggaccucagggaguucuauaucauuuuguggagucaauuccgacacugugggcuggucauggcccgauggugcagaguuaccguucacaaucgacaaauga

SEQ ID NO: 145116 - RNA, 1410 nt, Artificial Sequence
  derived and/or modified sequence opt3 from neuraminidase__InfluenzaA__AFN19995
augaaccccaaucagaagaucauuaccauaggcagcgugugcaugacaaucgggauggccaaccugauucuccaaaucggaaauauuaucuccauauggaucucucacucaauucagcuugguaaccagagucagacugagacguguaaucaaagcgucaucaccuacgaaaacaauacauggguuaaccagacuuaugugaauauuuccaacaccaauuucgcugcaggccagucuguagugucggucaaacuggccgggaacagcagcuugugcccugugaguggaugggcgaucuacuccaaggacaauucuauaagaauuggcagcaaaggugauguuuuugugaucagggagccauucauuuccuguucaccguuagaaugccggacauuuuuccugacccagggggcucuacucaacgacaagcauaguaauggaacuaucaaagaucgcagccccuaucgaacacugaugucuuguccuaucggcgaggucccaucccccuacaacucacguuuugaaagcguggccuggagugcaucugccugccacgacggcauuaacuggcuuaccauagggaucuccggaccugauaauggugcuguagcaguucugaaguauaacggcauuaucacggacacuauaaagagcuggagaaauaacauuuugaggacccaagagucggagugugccugcgugaaugggucuuguuucacaaucaugacugauggaccauccgacggccaggcuucauacaaaaucuuucggauugaaaaggguaaaaucgucaagaguguggagaugaacgcccccaauuaucauuacgaagagugcagcuguuacccugauuccucugagauuaccugcgugugccgcgacaacuggcacgggagcaauagaccaugggucucauucaaccagaaucucgaauaucagauaggauacaucuguaguggcauuuuuggcgauaacccgaggcccaaugacaaaacaggguccugcggaccuguuagcucuaacggugcgaauggcgugaagggguucucauuuaaguauggaaacggcguauggaucggucggaccaaaaguaucagcucccgcaagggguucgagaugauuugggauccaaacggcuggacgggaacugacaauaacuuuucuauaaaacaagacaucgugggcauuaaugaauggucgggguacagcggauccuucguccagcaucccgagcugacaggucuggauuguauccgaccuugcuucuggguggaacucauuagaggcaggccaaaggagaacaccaucuggacuucagggaguucuauaucauuuuguggaguuaauuccgacacagugggcuggucauggcccgauggugcagaguuaccguucaccaucgacaaauga

SEQ ID NO: 145117 - RNA, 1410 nt, Artificial Sequence; identical to SEQ ID NO: 142273
  derived and/or modified sequence opt3 from neuraminidase__InfluenzaA__AFN20001

SEQ ID NO: 145118 - RNA, 1410 nt, Artificial Sequence
  derived and/or modified sequence opt3 from neuraminidase__InfluenzaA__AFN20013
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcgauccuguuagcucuaacggagcgaauggugugaagggcuucucauuuaaguaugggaacggaguauggaucggccggacaaaaaguauuagcucccgcaaggguuucgagaugauaugggacccaaacggguggaccggcacggacaauaacuuuucuaucaaacaagauauugugggaaucaaugaauggucgggcuacagcggguccuucguccagcaucccgagcugacuggacuggacuguauucgaccuugcuucuggguggaacucaucagagguaggccaaaggagaacacaauauggaccucaggcaguucuaucagcuuuugugggguuaauuccgauacugugggauggucauggcccgacggcgcagaguuaccguucacaauugauaaauga

SEQ ID NO: 145119 - RNA, 1410 nt, Artificial Sequence
  derived and/or modified sequence opt3 from neuraminidase__InfluenzaA__AFN20020
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucggucggacaaaaaguauuagcucccgcaagggguucgagaugauaugggauccaaacggcuggaccggaacggacaauaacuuuucuaucaaacaagacauugugggccugaaugaauggucgggguacagcggauccuucguccagcaucccgagcugacuggucucgauuguauccgaccuugcuucuggguggaauuaauuagaggcaggccaaaggagaacacaaucuggaccucagggaguucuauaucauuuuguggaguuaauuccgacacugugggcuggucauggcccgauggugcagagcugccguucacaaucgacaaauga

SEQ ID NO: 145120 - RNA, 1410 nt, Artificial Sequence; identical to SEQ ID NO: 142273
  derived and/or modified sequence opt3 from neuraminidase__InfluenzaA__AFN20022

SEQ ID NO: 145121 - RNA, 1410 nt, Artificial Sequence
  derived and/or modified sequence opt3 from neuraminidase__InfluenzaA__AFN20035
augaaccccaaucagaagaucauuaccauaggcagcgugugcaugacaaucgggauugccaaccugauccuccaaauuggaaauaucauauccaucuggauuucucacucaauccagcuugguaaccagagucagauugagacuuguaaucaaagcgucaucacguacgaaaacaauaccuggguuaaccagacauaugugaauauauccaacacuaauuucgcugcaggccagucuguagugucggucaaacuggccgggaacagcucauugugcccugugaguggaugggcgauuuacuccaaggacaauucuaucagaauuggcagcaaaggugauguuuuugugaucagggagccauucaucuccuguucaccguuagaaugccggaccuuuuuccugacacagggggcucuacucaacgacaagcauaguaauggaaccauuaaagaucgcagccccuaucgaacucugaugucuuguccuauaggcgaggucccaucccccuacaacucacguuuugaaagcguggccuggagugcaucugccugccacgacggcaucaacuggcuuacaauugggaucuccggaccugauaauggugcuguagcaguucugaaguauaacggcauaauuaccgacacgaucaagagcuggagaaauaacaucuugaggacucaagagucggagugugccugcgugaaugggucuuguuucaccauuaugacagauggaccauccgacggccaggcuucauacaaaaucuuucggauugaaaaggguaaaauagucaagaguguggagaugaacgcccccaauuaucauuacgaagagugcagcuguuacccugauuccucugagaucacuugcgugugccgcgacaacuggcacgggagcaauagaccaugggucucauucaaccagaaucucgaauaucagauuggauacaucuguaguggcaucuuuggcgauaacccgaggcccaaugacaaaaccggguccugcggaccuguuagcucuaacggugcgaauggcgugaagggguucucauuuaaguauggaaacggcguauggauuggucggacaaaaaguauaagcucccgcaagggguucgagaugaucugggauccaaacggcuggaccggaacggacaauaacuuuucuauuaaacaagacaucgugggcauuaaugaauggucgggguacagcggauccuucguccagcaucccgagcugacuggucuggauuguauccgaccuugcuucuggguggaacucauaagaggcaggccaaaggagaacacaaucuggaccucagggaguucuauuagcuuuuguggaguuaauuccgacacugugggcuggucauggcccgauggugcagaguuaccguucacaaucgacaaauga

SEQ ID NO: 145122 - RNA, 1410 nt, Artificial Sequence; identical to SEQ ID NO: 142273
  derived and/or modified sequence opt3 from neuraminidase__InfluenzaA__AFN20041

SEQ ID NO: 145123 - RNA, 1410 nt, Artificial Sequence; identical to SEQ ID NO: 142273
  derived and/or modified sequence opt3 from neuraminidase__InfluenzaA__AFN20047

SEQ ID NO: 145124 - RNA, 1410 nt, Artificial Sequence; identical to SEQ ID NO: 143096
  derived and/or modified sequence opt3 from neuraminidase__InfluenzaA__AFN20063

SEQ ID NO: 145125 - RNA, 1410 nt, Artificial Sequence
  derived and/or modified sequence opt3 from neuraminidase__InfluenzaA__AFN20077
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuuaagaucgaaaaagguaagauugucaaaaguguggagaugaacgcccccaauuaucauuacgaagagugcagcuguuacccugauuccucugagauaacuugcgugugccgggacaacuggcacgggagcaaucgcccaugggucucauucaaccagaaucucgaauaucagaucggauacauuuguaguggcaucuuuggcgauaacccgagacccaaugacaagaccggguccugcggaccuguuagcucuaacggugcgaauggcgugaagggguucucauuuaaauauggaaacggcguauggaucgguaggacaaagaguauuagcucccggaaaggguucgagaugauaugggauccaaacggcuggaccggaacggacaauaacuuuucuaucaagcaagacauugugggcaucaaugaauggucgggguacagcggauccuucguccagcaucccgagcugacuggucuggauuguauucgcccuugcuucuggguggaacucauccgaggcagaccaaaagagaacacaauauggaccucagggaguucuaucagcuuuuguggaguuaauuccgacacugugggcuggucauggcccgauggugcagaguuaccguucacaauugacaaguga

SEQ ID NO: 145126 - RNA, 1410 nt, Artificial Sequence; identical to SEQ ID NO: 142273
  derived and/or modified sequence opt3 from neuraminidase__InfluenzaA__AFN20083

SEQ ID NO: 145127 - RNA, 1410 nt, Artificial Sequence
  derived and/or modified sequence opt3 from neuraminidase__InfluenzaA__AFN20094
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuaucuacgaaaacaauacguggguuaaccagaccuaugugaauauauccaacacaaauuucgcugcaggccagucuguagugucggucaaacuggccgggaacagcucauugugcccugugaguggaugggcgauuuacuccaaggacaauucuaucagaauuggcagcaaaggugauguuuuugugaucagggagccauucaucuccuguucaccguuagaaugccggaccuuuuuccugacucagggggcucuacucaacgacaagcauaguaauggaacaauuaaagaucgcagccccuaucgaacccugaugucuuguccuauaggcgaggucccaucccccuacaacucacguuuugaaagcguggccuggagugcaucugccugccacgacggcaucaacuggcuuacuauugggaucuccggaccugauaauggugcuguagcaguucugaaguauaacggcauaauuacagacaccaucaagagcuggagaaauaacaucuugaggacgcaagagucggagugugccugcgugaaugggucuuguuucacuauuaugaccgauggaccauccgacggccaggcuucauacaaaaucuuucggauugaaaaggguaaaauagucaagaguguggagaugaacgcccccaauuaucauuacgaagagugcagcuguuacccugauuccucugagaucacaugcgugugccgcgacaacuggcacgggagcaauagaccaugggucucauucaaccagaaucucgaauaucagauuggauacaucuguaguggcaucuuuggcgauaacccgaggcccaaugacaaagcgggguccugcggaccuguuagcucuaacggugcaaauggcgugaagggguucucauuuaaguauggaaacggcguauggauuggucggacuaaaaguauaagcucccgcaagggguucgagaugaucugggauccaaacggcuggaccggaacagacaauaacuuuucuauuaaacaagacaucgugggcauuaaugaauggucgggguacagcggauccuucguccagcaucccgagcugaccggucuggauuguauccgaccuugcuucuggguggaacucauaagaggcaggccaaaggagaacacgaucuggacuucagggaguucuauuagcuuuuguggaguuaauuccgacacaaugggcuggucauggcccgauggugccgaguuaccguucaccaucgacaaauga

SEQ ID NO: 145128 - RNA, 1410 nt, Artificial Sequence; identical to SEQ ID NO: 142732
  derived and/or modified sequence opt3 from neuraminidase__InfluenzaA__AFN20100

SEQ ID NO: 145129 - RNA, 1410 nt, Artificial Sequence
  derived and/or modified sequence opt3 from neuraminidase__InfluenzaA__AFN20114
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauaguucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuuaagauugaaaaagguaagaucgugaaaucaguggagaugaaugcccccaacuaucauuacgaagagugcaguuguuacccugauagcuccgagauuacuugcgucugccgggacaauuggcacgggucuaaccgcccauggguuagcuucaaucagaaccucgaauaucagauaggauacaucuguucaggcauuuuuggcgauaauccgagacccaacgacaagaccgggaguugcuccccugugagcucuaauggagcgaacgguguaaagggcuucucauuuaaauaugggaacggaguguggaucggcaggacaaagaguaccagcucccggaaugguuucgagaugaucugggauccaaacggguggacgggcacugacaauucuuuuucgaugaaacaagacauugucggaauaaacgaauggagcggcuacuccgggucauucgugcagcaucccgagcugacaggacuggauuguauccgcccuugcuucuggguugaacucauucgagguagaccaaaggagaauaccguguggacuucgggcucuagcaucuccuuuuguggggucaacucagacacagugggauggagcuggcccgauggcgcagaguuaccguucaccauugacaaauga

SEQ ID NO: 145130 - RNA, 1410 nt, Artificial Sequence
  derived and/or modified sequence opt3 from neuraminidase__InfluenzaA__AFN20128
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacucaucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuagaagcuggaggaauaacaucuugcggacucaagagucggagugugccugcgugaaugggucuuguuucaccaucaugacagauggaccauccgacggccaggcuucauacaagauuuuucgcaucgaaaaagguaagauuauaaaaagugucgagaugaacgcccccaauuaucauuacgaagagugcagcuguuacccugauuccucugagaucacuugcgugugcagagacaacuggcacgggagcaauaggccaugggugucauucaaccagaaucucgaauaucagauuggauacaucuguaguggcaucuuuggcgauaacccgcgguccaaugacaagaccgggagcugcggacccgucucuucaaacggugcgaauggcguuaaaggguucaguuuuaaguauggaaacggcguguggauuggucgcacaaagagcauauccucucgaaaaggguucgagaugaucugggauccuaacggcuggaccggaacggacaauaacuuuucgauuaagcaagacaucguaggcauuaaugaauggagcggguacuccggaucauucgugcagcauccagagcugacuggucuggauuguaucagacccugcuucugggucgaacucauaaggggccggccuaaagagaacacaaucuggaccagugggucuagcauuuccuuuuguggagugaauagcgacacuguuggcuggagcuggccagauggugcagaguuacccuucacaaucgacaaguga

SEQ ID NO: 145131 - RNA, 1410 nt, Artificial Sequence; identical to SEQ ID NO: 142273
  derived and/or modified sequence opt3 from neuraminidase__InfluenzaA__AFN87935

SEQ ID NO: 145132 - RNA, 1410 nt, Artificial Sequence
  derived and/or modified sequence opt3 from neuraminidase__InfluenzaA__AFN87937
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuuaagauugaaaaagguaagaucgugaaaucaguggagaugaaugcccccaacuaucauuacgaagagugcaguuguuacccugauagcuccgagauuacuugcgucugccgggacaauuggcacgggucuaaccgcccauggguuagcuucaaucagaaccucgaauaucagauaggauacaucuguucaggcauuuuuggcgauaauccgagacccaacgacaagaccgggaguugcggaccuguguccagcaauggugcgaacggcguaaagggguucucuuuuaaauauggaaacggcguguggaucgguaggacaaagucaaccaguagccggaauggguucgagaugaucugggauccaaacggcuggacgggaacugacaauuccuuuucuaugaaacaagacauugucggcauaaacgaauggucgggguacagcggauccuucgugcagcaucccgagcugacaggucuggauuguauccgcccuugcuucuggguugaacucauucgaggcagaccaaaggagaauaccguguggacuucagggaguucuaucagcuuuuguggagucaacuccgacacagugggcuggucauggcccgauggugcagaguuaccguucaccauugacaaauga

SEQ ID NO: 145133 - RNA, 1410 nt, Artificial Sequence
  derived and/or modified sequence opt3 from neuraminidase__InfluenzaA__AFN87940
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuuaagauugaaaaagguaagaucgugaaaucaguggagaugaaugcccccaacuaucauuacgaagagugcaguuguuacccugauagcuccgagauuacuugcgucugccgggacaauuggcacgggucuaaccgcccauggguuagcuucaaucagaaccucgaauaucagauaggauacaucuguucaggcauuuuuggcgauaauccgagacccaacgacaagaccgggaguugcggaccuguguccagcaauggugcgaacggcguaaagggguucucuuuuaaauauggaaacggcguguggaucgguaggacaaagucaaccaguagccggaauggguucgagaugaucugggauccaaacggcuggacgggaacugacaauuccuuuucuauuaaacaagacauagucggcaucaacgaauggucgggguacagcggauccuucgugcagcaucccgagcugacaggucuggauuguauucgcccuugcuucuggguugaacucauccgaggcagaccaaaggagaauaccauuuggacuucagggaguucuaucagcuuuuguggagugaacuccgacacagucggcuggucauggcccgauggugcagaguuaccguucaccauagacaaauga

SEQ ID NO: 145134 - RNA, 1410 nt, Artificial Sequence; identical to SEQ ID NO: 138754
  derived and/or modified sequence opt3 from neuraminidase__InfluenzaA__AFN87942

SEQ ID NO: 145135 - RNA, 1410 nt, Artificial Sequence; identical to SEQ ID NO: 145132
  derived and/or modified sequence opt3 from neuraminidase__InfluenzaA__AFN87944

SEQ ID NO: 145136 - RNA, 1410 nt, Artificial Sequence
  derived and/or modified sequence opt3 from neuraminidase__InfluenzaA__AFN87946
augaaccccaaucagaagaucauuaccauaggcagcgugugcaugacaaucgggauggccaaccugacucuccaaauuggaaauaucauuuccaucuggauaucucacucaauccagcuugguaaccagaaucagauugagacguguaaccaaagugucaucaauuacgaaaacaauaccuggguuaaccagacauaugugaauauuagcaacacuaauuucgcugcaggccaguccguagugucugucaaacuggccgggaacucgucauugugcccugugagcggaugggcgaucuacaguaaggacaauuccauaagaauuggcucuaaaggugauguuuuugugaucagggagccauucgucagcuguuccccguuagaaugccggaccuuuuuccugacacagggggcucuacucaacgacaagcauucaaacggaaccauuaaagaucgcagucccuaucgaacucugaugagcuguccuaucggcgaggugccaucucccuacaauucccguuuugaaucaguagccuggagcgcaagugccugccacgacggcaucaacuggcuuacaauugggauaucuggaccugauaauggugcuguugcagugcugaaguauaacggcaucauuaccgacacgaucaaguccuggagaaauaacauauugaggacucaagagagcgagugugccugcgucaaugggucguguuucaccgugaugacagauggaccaucugacggccaggcuuccuacaaaauuuuucggaucgaaaaggguaaaaucgugaagucagucgagaugaacgcccccaauuaucauuacgaagagugcaguuguuacccugauagcuccgagguuacuugcgugugccgcgacaacuggcacgggucuaauagaccaugggugagcuucaaccagaaucucgaauaucagauuggauacaucuguucaggcauuuuuggcgauaacccgaggcccaaugacaaaaccgggaguugcggaccuguauccagcaacggugcgaacggcgucaagggguucucuuuuaaguauggaaauggcguguggauaggucggacaaaaucaaucaguagccgcaacggguucgagaugauuugggauccaaauggcuggaccggaacggacaacaauuuuuccaucaagcaagacaucguuggcauuaacgaauggucuggguacucggguagcuucgugcagcaucccgagcugacuggacuggauuguauacgaccuugcuucugggucgaacucaucagaggcaggccaaaagagaauacaauuuggaccuccgggucaaguaucucuuuuuguggagugaacagcgacacuguaggcugguccuggcccgauggugcagaguuaccguucacaauugacaaguga

SEQ ID NO: 145137 - RNA, 1410 nt, Artificial Sequence
  derived and/or modified sequence opt3 from neuraminidase__InfluenzaA__AFN87948
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuuaagauugaaaaagguaagaucgugaaaucaguggagaugaaugcccccaacuaucauuacgaagagugcaguuguuacccugauagcuccgagauuacuugcgucugccgggacaauuggcacgggucuaaccgcccauggguuagcuucaaucagaaccucgaauaucagauaggauacaucuguucaggcauuuuuggcgauaauccgagacccaacgacaagaccgggaguugcggaccuguguccagcaauggugcgaacggcguaaagggguucucuuuuaaauauggaaacggcguguggaucgguaggacaaagucaaccaguagccggaauggguucgagaugaucugggauccaaacggcuggacgggaacugacaauuccuuuucuauuaaacaagacauagucggcaucaacgaauggucgggguacagcggauccuucgugcagcaucccgagcugacaggucuggauuguauucgcccuugcuucuggguugaacucauccgaggcagaccaaaggagaauaccauuuggacuucagggaguucuaucagcuuuuguggagugaacuccgacauagucggcuggucauggcccgauggugcagaguuaccguucacaaucgacaaauga

SEQ ID NO: 145138 - RNA, 1410 nt, Artificial Sequence
  derived and/or modified sequence opt3 from neuraminidase__InfluenzaA__AFN87950
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccgucaugacagauggaccauccgacggccaggcuucauacaaaaucuuucggauugaaaaggguaaaaucgugaagaguguggagaugaacgcccccaauuaucauuacgaagagugcagcuguuacccugauuccucugagauuacuugcgucugccgcgacaacuggcacgggagcaauagaccauggguuucauucaaccagaaucucaaauaucagauaggauacaucuguaguggcauuuuuggcgauaacccgaggcccaaugacaagaccggguccugcggaccugugagcucuaacggugcgaauggcguaaagggguucucauuuaaauauggaaacggcguguggaucggucggacaaagaguaucagcucccgcaaaggguucgaaaugauuugggauccaaacggcuggaccggaacggacaauaacuuuucuauaaagcaagacaucauuggcaucaaugaguggucgggguacagcggauccuucguccagcaucccgaacugacuggucuggauuguauucgaccuugcuucuggguggagcucaucagaggcaggccaaaagaaaacacaauauggaccucagggaguucuaucagcuuuuguggaguuaauuccgacacugugggcuggucauggcccgauggugcagaguuaccguucacaauugacaaguga

SEQ ID NO: 145139 - RNA, 1410 nt, Artificial Sequence; identical to SEQ ID NO: 142725
  derived and/or modified sequence opt3 from neuraminidase__InfluenzaA__AFN87952

SEQ ID NO: 145140 - RNA, 1410 nt, Artificial Sequence
  derived and/or modified sequence opt3 from neuraminidase__InfluenzaA__AFN87954
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaagggguucgagaugauuugggauccaaauggcuggaccggaacggacaacaauuuuuccauaaaacaagacaucgucggcauuaacgaauggucuggguacucggggagcuucgugcagcaucccgagcugacuggucuggauuguauccgaccuugcuucuggguugaacucauuagaggcaggccaaaggagaauacaaucuggaccuccgggucaaguauaucuuuuuguggagugaacagcgacacuaugggcugguccuggcccgauggugcagaguuaccguucacaaucgacaaauga

SEQ ID NO: 145141 - RNA, 1410 nt, Artificial Sequence
  derived and/or modified sequence opt3 from neuraminidase__InfluenzaA__AFN87956
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacugguggggaacagcagcuugugcccuguuaguggaugggccauauacuccaaggacaauucuauuagaaucggcagcaaaggugauguguuugucauuagggagccauucaucuccuguucaccguuagaaugccggaccuuuuuccugacacagggggcgcuacucaacgacaagcauaguaauggaaccaucaaagaucgcagccccuaucgaacucugaugucuuguccuauuggcgaggugccaucccccuacaacucacguuuugaaagcguagcuuggagugccucugcaugccacgacggcauaaacuggcuuacaaucgggauuuccggaccugauaauggugccguugcugugcugaaguauaacggcaucauaaccgacacgauuaagagcuggagaaauaacaucuugaggacucaagagucggagugugcaugcgucaaugggucuuguuucaccaucaugacagauggaccauccgacggccaggccucauacaaaauuuuucggaucgaaaaggguaaaauugugaagaguguggagaugaacgcucccaauuaucauuacgaagagugcagcuguuacccugauuccucugagauaacuugcgucugccgcgacaacuggcacgggagcaauagaccauggguuucauucaaccagaaucucgaauaucagaucggauacauuuguaguggcaucuuuggcgauaacccgaggcccaaugacaaaaccggguccugcggaccugugagcucuaacggugccaauggcguaaagggguucucauuuaaguauggaaacggcguguggaucggucggacaaaaaguauuagcucccgcaagggguucgagaugauaugggauccaaacggcuggaccggaacggacaauaacuuuucuaucaaacaagacauugucggcacuaaugaauggucgggguacagcggauccuucgugcagcaucccgagcugacaggucuggauuguauccgaccuugcuucuggguugaacucauuagaggcaggccaaaggagaacaccaucuggacuucagggaguucuauaucauuuuguggagucaauuccgacacagugggcuggucauggcccgauggugcggaguuaccguucaccaucgacaacuga

SEQ ID NO: 145142 - RNA, 1410 nt, Artificial Sequence
  derived and/or modified sequence opt3 from neuraminidase__InfluenzaA__AFN87958
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuuaagauugaaaaagguaagaucgugaaaucaguggagaugaaugcccccaacuaucauuacgaagagugcaguuguuacccugauagcuccgagauuacuugcgucugccgggacaauuggcacgggucuaaccgcccauggguuagcuucaaucagaaccucgaauaucagauaggauacaucuguucaggcauuuuuggcgauaauccgagacccaacgacaagaccgggaguugcggaccugcguccagcaauggugcaaacggcgugaagggguucucuuuuaaauauggaaacggcguauggaucgguaggacaaagucaaccaguagccggaauggguucgagaugaucugggauccaaacggcuggacgggaacugacaauuccuuuucuaugaaacaagacauugugggcauaaacgaauggucgggguacagcggauccuucguccagcaucccgagcugacaggucuggauuguauccgcccuugcuucuggguggaacucauucgaggcagaccaaaggagaauaccguuuggacuucagggaguucuaucagcuuuuguggagugaacuccgacacagucggcuggucauggcccgauggugccgaguuaccguucaccauugacaaauga

SEQ ID NO: 145143 - RNA, 1410 nt, Artificial Sequence
  derived and/or modified sequence opt3 from neuraminidase__InfluenzaA__AFN87960
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacucauccuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucggucggacaaaaaguauuagcucccgcaagggguucgagaugauaugggauccaaacggcuggaccggaacggacaauaacuuuucuaucaaacaagacauugugggcaucaaugaauggucgggguacagcggauccuucguccagcaucccgagcugacuggucuggauuguauucgaccuugcuucuggaucgaacucauaagaggcaggccaaaggagaacacaaucuggaccucagggaguucuauuagcuuuuguggagugaauagcgacacuguuggcuggucauggcccgauggugcagaguuaccguucacaaucgacaaauga

SEQ ID NO: 145144 - RNA, 1413 nt, Artificial Sequence
  derived and/or modified sequence opt3 from neuraminidase__InfluenzaA__AFO64805
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccaacaauggggccgcguccuacaaaaucuucaagauugaaaagggaaaaguuacaaagucaauagagcucaacgcaccuaauagucacuaugaagaguguagcugcuacccagacaccggcacggugaugugugucugccgggauaacuggcacggcuccaaucgccccugggugucuuuuaaccagaaucuggacuaccagaucggguauauuugcagcggaguguucggugauaacccuagaccaaaagacggcgaggggucauguaauccggucacuguugauggagccgacggcgugaaggguuuuaguuacaaauaugggaacggcguauggaucggaaggacaaaguccaaucggcugcgcaaaggcuucgaaaugaucugggaccccaacggguggaccgauacugacagcgauuuuucugugaagcaagacgucguggcuauuacagauuggucaggauacagugguagcuucguucagcauccugagcucaccggcuuagacugcauacgaccauguuuuuggguggaacuggucagagggcuucccagggagaauacgaccaucuggacauccggaucuucgauuagcuucugcggcgugaacuccgauacugccaacuggucauggccugacggugcagaauugccauucaccaucgauaaguga

SEQ ID NO: 145145 - RNA, 1413 nt, Artificial Sequence
  derived and/or modified sequence opt3 from neuraminidase__InfluenzaA__AFO64816
augaaccccaaucagaagaucauuaccauaggcagcaucugcauggccauugggaucauuucccugauccuccaaauaggaaacaucgugucuauuuggaucucacacaguauucagacagguagccagaauuacacuggcaucuguaaccagagaauaauuacguaugaaaauuccaccugggucaaccaaacauacguuaauaucaacaauacuaacgugguagcugggcaggacaccacaucuguggcacuugccggaaauucgucacugugcccuauuagcggcugggcgaucuauaguaaagauaacuccaucaggauugguucuaagggggacgucuucgugauacgggagccauuuaucagcuguucccauuuggagugccgcaccuucuuuuuaacucagggagcucugcuaaaugauaaacacucaaacggcacaguuaaggaccgaaguccguaccgugcccucaugagcugucccauuggcgaagcaccuucuccauauaauuccagauucgagucaguggccuggagcgcuagugcaugccaugaugggaugggauggcugaccaucgguauaucuggccccgacgauggggccgucgcugugcuuaaauacaacggaauuaucacggaaacuaucaaguccuggaggcggcgcauucugagaacccaggagagcgaguguguaugcguuaacggcucguguuuuacaaucaugacugacgguccuaauaacgggccagccucuuauaagauuuucaaaauagaaaagggaaaagugaccaaguccaucgaguuggaugcgcccaauucacacuacgaagagugcaguuguuacccugacgcaggcacagucaugugcgugugcagggauaacuggcauggcagcaaucggccauggguguccuuuaaccaaaaucucgacuaucagauuggguacaucuguucuggagucuucggugauaacccgcgccccaaagacggcaaggggagcugcgacccuguuaccguggauggagccgacggcguaaaggguuuuucauaucgauacgggaauggcguguggaucggaagaacgaaaaguaacuccagcaggcggggcuucgagaugauuugggauccaaauggguggacugacacagauucuaaguuucuggucaaacaggacgugguugcuaugaccgauuggucaggauauagugguagcuucgugcagcaccccgaacugacuggccucgacuguaugcguccuugcuuuugggucgaguuaauacgcgggagaccaagggaaaacacaaccaucuggacguccggaucuucgauuagcuucuguggcgugaauggugauaccgccaacugguccuggcccgacggggcagagcugccguucacaaucgauaaguga

SEQ ID NO: 145146 - RNA, 1413 nt, Artificial Sequence
  derived and/or modified sequence opt3 from neuraminidase__InfluenzaA__AFO64827
augaaccccaaucagaagaucauuaccauaggcagcaucuccauggccauugggaucauuucucugauccuccaaauaggaaacaucauuucaaucugggugagucacagcauucagacagguucccagaaucauacuggcaucugcaaccagagaauaauuacguacgaaaauucuaccugggucaaccaaacauauguuaauaucaacaauacuaacgugauugcugggaaagacaagaccucgguaacacuugcaggaaauucaagccuguguccuaucaggggcugggccaucuacaccaaagauaacaguauucggauagguuccaagggggacguguucgucauccgcgagccauuuauuucuugcagccacuuggagugucgaacuuucuuuuuaacacagggagcgcugcuaaaugauaaacauuccaacggcaccgugaaggaccguucaccguauagagcucucaugaguugcccccugggcgaagccccuagcccauacaauucuagguucgaguccguugcauggucagccagcgcuugucacgaugggaugggauggcuuacgaucgguauaaguggccccgacgauggggcaguggccguccugaaguauaacggaauuaucacugaaaccaucaaaucuuggaagaaacggauuuugcgcacacaggaguccgagugcguguguguaaacggcagcugcuuuacuaucaugaccgacgguccuucgaauggggcugccucuuacagaauuuucaagauagaaaaaggaaagguuacaaaguccaucgagcucgaugcgccaaacucacauuaugaagaguguaguugcuaccccgacaccggcacggugaugugugucugcagggauaauuggcacggcagcaaccggccuuggguguccuuuaaucagaaccuggacuaccaaauuggguauaucugcucuggaguguucggugauaauccacgcccgaaagacggcaaggggagcugugaccccgucacuguugauggagcagacggcgugaaagguuuuucauaccgauaugggaacggcguauggaucggaagaacaaagaguaauagguuccggaaaggcuuugagaugauuugggauccuaacggguggaccgacacugauuccgacuuccuggugaagcaggaugucguggccaugacagacuggagcggauacucugguucauuuguucagcacccagaacucaccggcuuagauugcaugcgucccuguuucuggguggagcugguccgcgggagaccuagggaaaauacgaccauauggacaaguggaagcuccaucucuuucugcggcgugaacucggacacugcuaauuggagcuggccagauggugccgagcuucccuuuaccauugacaaauga

SEQ ID NO: 145147 - RNA, 1413 nt, Artificial Sequence
  derived and/or modified sequence opt3 from neuraminidase__InfluenzaA__AFO64838
augaaccccaaucagaagaucauuaccauaggcagcaucuccauggccauugggaucauuucucugauccuccaaauaggaaacaucauuucaaucugggcuagucacagcauucagacagguucccagaaucauacuggcaucugcaaccagagaauaauuacguacgaaaauucuaccugggugaaccaaacauaugucaauaucaacaauacuaacguuguggcagggaaagacaagaccucgguaacacuugccggaaauucaagccuguguccuauuaggggcugggcgaucuacaccaaagauaacaguauccggauugguuccaagggggacguguucgucauacgcgagccauuuaucucuugcagccacuuggagugucgaacuuucuuuuuaacacagggagcucugcuaaaugauaaacauuccaacggcaccgugaaggaccguucaccguauagagcccucaugaguugcccccugggcgaagcaccuagcccauacaauucuagguucgaguccguugccuggucagcuagcgcaugucacgaugggaugggauggcuuacgauugguaucaguggccccgacaacggggccguggcuguccugaaguauaacggaauaauuacugaaaccaucaaaucuuggaagaaacggaucuugcgcacacaggaguccgagugcguguguguaaauggcagcugcuuuacuauuaugaccgaugguccuucgaacggggccgcgucuuacagaaucuucaagauugaaaaaggaaggguuacaaaguccauagagcucgacgcaccaaauuaucauuacgaagaguguucaugcuaccccgauaccggcacggugaugugugucugccgggacaacuggcacggcaguaaucgcccuugggugagcuuuaaccagaaucuggauuaucaaaucggguacauuugcuccggaguguucggugacaacccacgaccgaaggauggcgaggggucuuguaaucccgucacuguugacggagccgacggcgugaaagguuuuagcuauagauacgggaacggcguauggaucggaaggacaaagucaaaucggcugcguaaaggcuucgaaaugaucugggauccuaacggguggaccgacacugauagugacuuuuccaugaagcaggauguggucgcuaugacagacuggagcggauauucugguucauucgugcagcacccagagcucaccggcuuagauugcaugcgccccuguuuuuggguugaacuggugagagggcuuccuagggagaauacgaccauuuggacaaguggaagcuccauaucuuucugcggcgucaacucggacacugccaauuggagcuggccagauggugcagaauugcccuucaccaucgacaaauga

SEQ ID NO: 145148 - RNA, 1413 nt, Artificial Sequence
  derived and/or modified sequence opt3 from neuraminidase__InfluenzaA__AFO64849
augaaccccaaucagaagaucauuaccauaggcagcaucuccauggccauugggaucauuucucugauccuccaaauaggaaacaucauuucaaucugggcuagucacagcauucagacagguucccagaaucauacuggcaucugcaaccagagaauaauuacguacgaaaauucuaccugggugaaccaaacauaugucaauaucaacaauacuaacguuguggcagggaaagacaagaccucgguaacacuugccggaaauucaagccuguguccuauuaggggcugggcgaucuacaccaaagauaacaguauccggauugguuccaagggggacguguucgucauacgcgagccauuuaucucuugcagccacuuggagugucgaacuuucuuuuuaacacagggagcucugcuaaaugauaaacauuccaacggcaccgugaaggaccguucaccguauagagcccucaugaguugcccccugggcgaagcaccuagcccauacaauucuagguucgaguccguugccuggucagcuagcgcaugucacgaugggaugggauggcuuacgauugguaucaguggccccgacaacggggccguggcuguccugaaguauaacggaauaauuacugaaaccaucaaaucuuggaagaaacagaucuugcggacacaggaguccgagugcguguguguaaauggcagcugcuuuacuauuaugaccgaugguccuucgaacggggccgcgucuuaccgcaucuucaagauugaaaaaggaaagauaacaaaguccaucgagcucgacgcaccaaauucacauuaugaagaguguaguugcuaccccgauaccggcacgguuaugugugugugcagagacaacuggcacggcagcaauaggccuugggucuccuuuaaccaaaaucuggauuaccagauuggguauaucugcucuggaguguucggugacaacccacggccgaaagauggcgaggggagcuguaaucccgugacugucgacggagccgacggcguuaaggguuuuucauaccgcuaugggaacggcguguggaucggacgaacaaaaaguaauagacugaggaagggcuucgaaaugauuugggauccuaacggguggaccgacacugauuccgacuuuagcguaaaacaggauguggucgcuaugacagacuggucuggauacucagguaguuucgugcagcacccagagcucaccggcuuagauugcaugcggcccuguuuuuggguugaacuggugcgugggcgcccuagagagaaugccacgauauggaccagcggauccucuaucucguucugcggcgucaacagcgacacagcaaauugguccuggccagauggugcugaacuucccuucacuauugacaaguga

SEQ ID NO: 145149 - RNA, 1413 nt, Artificial Sequence; identical to SEQ ID NO: 136984
  derived and/or modified sequence opt3 from neuraminidase__InfluenzaA__AFO64860

SEQ ID NO: 145150 - RNA, 1413 nt, Artificial Sequence
  derived and/or modified sequence opt3 from neuraminidase__InfluenzaA__AFO64871
augaaccccaaucagaagaucauuaccauaggcagcaucuccauugccaucgggauuaucucucugauacuccaaaucggaaacauuaucucaauuugggcuagucacagcauccagacagguucccagaaucauacuggcgugugcaaccagagaauaauuacguacgaaaauucuaccugggucaaccaaacauauguuaauaucaacaauacuaacgugguagcagggaaagacaagaccucgaugacacuugccggaaauucaagccuguguccuauuaggggcugggcgaucuacaccaaagauaacaguauccggauugguuccaagggggacguguucgucauacgcgagccauuuaucucuugcagccacuuggagugucgaacuuucuuuuuaacacagggagcucugcuaaaugauaaacauuccaacggcaccgugaaggaccguucaccguauagagcccucaugaguugcccccugggcgaagcaccuagcccauacaauucuagguucgaguccguugccuggucagcuagcgcaugucacgaugggcuuggauggcugacgauugguaucaguggccccgacaacggggccguggcugucuugaaguauaacggaauaauuacugaaaccaucaaaucuuggaagaaacggauccuccgcacacaggaguccgagugcguguguaugaauggcagcugcuuuacuauuaugaccgaugguccuucgaacggggccgcgucuuacagaaucuucaagauugaaaaaggaaggguaacaaaguccauagagcuggacgcaccaaauuaucauuacgaagaguguucaugcuaccccgauaccggcacgguuaugugugugugccgggacaacuggcacggcaguaaucgcccuugggucagcuuuaaccagaaucuggauuaucaaaucggguacauuugcuccggaguguucggugacaacccacgaccgaaggauggcgaggggucuuguaaucccgugacugucgacggagccgacggcguuaaagguuuuagcuauagauacgggaacggcguguggaucggaaggacaaagucaaaucggcuccguaaaggcuucgaaaugaucugggauccuaacggguggaccgacacugauagugacuuuuccaugcgccaggauauuguagcuaugacagacuggagcggauauucugguucauucgugcagcacccagaguuaaccggccuggauugcaugagacccuguuuuugggucgaacuugugaggggguugccucgggagaauacgaccauauggacaaguggaagcuccaucucuuucugcggcguuaacucggacacugccaauuggagcuggccagauggugcagaacugcccuucaccauugacaaguga

SEQ ID NO: 145151 - RNA, 1413 nt, Artificial Sequence
  derived and/or modified sequence opt3 from neuraminidase__InfluenzaA__AFO64882
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugugaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacagccacuaugaagaguguuccugcuacccagacaccggcacggugaugugugucugccgggauaauuggcacggcucuaaccgccccugggugagcuuuaaucagaaccuggacuaccagaucggguauauuugcucaggaguguucggugauaauccuagaccaaaagacggcgaggggaguuguaacccggucacuguugauggagccgacggcgugaaggguuuuuccuacaaauaugggaauggcguauggaucggaaggacaaagagcaaccggcugcgcaaaggcuucgaaaugaucugggaccccaauggguggaccgauacugacucugauuuuucagugaagcaagacgucguggcuauuacagauuggaguggauacagcgguuccuucguucagcauccugagcucaccggcuuagacugcauacgaccauguuuuuggguggaacuggucagagggaggccccgggagaacacgaccaucuggacaucuggaucgagcauuuccuucugcggcgucaauucagauacugccaacuggaguuggccugacggugcagaacuuccauucaccaucgauaaguga

SEQ ID NO: 145152 - RNA, 1413 nt, Artificial Sequence
  derived and/or modified sequence opt3 from neuraminidase__InfluenzaA__AFO64893
augaaccccaaucagaagaucauuaccauaggcagcaucuccguggccauugggaucauuucucugaugcuccaaaucggaaacauaaucucaauuugggcuagucacagcauccagacagguucccagaaucauacuggcauuugcaaccagagaaucauaacguacgaaaauucuaccugggucaaccacacauauguuaauauuaacaauacuaacgugguagcagggaaagacaagaccucggugacacuugccggaaauucaagccuguguaguaucuccggcugggcgauuuacaccaaagauaacucuaucaggaucgguagcaagggggacgucuucgugauucgggagccuuuuauauccugcucacauuuggagugucgcacuuucuuuuuaacacaaggagcucugcuaaaugauaaacacaguaacggcaccguuaaggaccgaagcccauaucgugcccucaugucuugcccgcugggcgaagcacccuccccuuacaauucaaaguucgagagcguggccuggagugcuucugcaugucaugaugggaugggauggcuuacgaucgguauuuccggcccagacaacggggccgucgcugugcugaaauauaacggaaucauaacugaaaccauuaagagcuggaaaaagagaaucuugaggacacaggagucggagugcguauguguuaauggcucuugcuuuacuaucaugaccgauggucccuccgacggggccgcgucauacaaaauuuucaagaucgaaaagggaaaagugacaaagaguauugagcucaacgcaccuaauagccacuaugaagaguguuccugcuacccagauaccggcacggucaugugugugugccgggacaacuggcacggcucuaaucgccccugggugagcuuuaaccagaaucuggauuaccagauaggguauaucugcucaggagucuucggugacaacccuagaccaaaagauggcgaggggaguuguaauccgguuacuguggacggagccgacggcguaaaggguuuuuccuacaaauaugggaacggcguguggauuggaaggacaaagagcaaucgguuccgcaaaggcuuugaaaugaucugggaucccaacggguggaccgacacugauucugacuucucagucaagcaagaugugguugcuaucacagacuggaguggauacagcgguuccuuugugcagcauccugagcugaccggccucgauugcauucgaccauguuucugggucgaauuagugagagggaggccccgggagaauacgaccauauggacaucuggaucgagcaucuccuucugcggcguaaacucagacacugccaauuggaguuggccugauggugcagaacugccauuuaccauugacaaguga

SEQ ID NO: 145153 - RNA, 1413 nt, Artificial Sequence
  derived and/or modified sequence opt3 from neuraminidase__InfluenzaA__AFO64904
augaaccccaaucagaagaucauuaccauaggcagcaucuccguggccauugggaucauuucucugauccuccaaauaggaaacaucauuucaaugugggcuagucacagcauccagacagguucccagaauuacacuggcauuugcaaccagagaaucauaacguaugagaauaacaccugggucaaucaaacauacguuaacauuaauaacacuaaugugguagcagggaaagacaagaucucuaugacccuugccggaaacucgucacuguguccuauuaggggcugggcgaucuauacaaaagauaauagcauccggauugguaguaagggggacguguucgucauacgcgaaccauuuaucuccugcucucauuuggagugucgaaccuucuuuuuaacucagggagcucugcuaaacgauaaacacagcaauggcacagugaaggaccguuccccguacagagcccucaugucaugcccccugggcgaagcaccuaguccauauaacagcagguucgagucuguugccugguccgcuucagcaugucaugaugggcuuggauggcugaccauugguaucagcggccccgacaacggggccguggcugucuugaaguacaauggaauaauuacggaaacuaucaaaaguuggaagaaacagauccuccggacccaggagucugagugcguguguguaaacggcuccugcuuuacaauuaugacugaugguccuagcaaucgcgccgcgucguauagaaucuucaagauugaaaaagggaggguuaccaagucuauagagcuggacgcaccaaacuaccacuacgaagaguguuccugcuaucccgauacaggaaccgugaugugugucugccgggacaauuggcauggcucaaaccgcccuugggugaguuuuaaucaaaaccuggauuaccagaucggcuauauuugcagcgggguguucggagacaauccacgaccgaaggauggugagggcuccuguaaccccgucacgguugacggggccgacggagugaaaggcuuuucuuacaaguaugguaaugggguauggaucggcagaacuaaaagcaacaggcuccggaagggauucgaaaugaucugggauccuaauggcuggacagacaccgauucagacuuuaguaugaaacaggauguggucgcuaugacugacugguccggguacagcggaucuuucgugcagcacccagaguuaacaggucuggauugcaugcgucccuguuuuuggguugaacuugugcgcggcuugccuagagagaacaccacgauuuggaccucagggaguagcauauccuucugcggagucaauucugaaacagccaacuggucguggccagacggcgcagagcugcccuucacuaucgauaaguga

SEQ ID NO: 145154 - RNA, 1413 nt, Artificial Sequence
  derived and/or modified sequence opt3 from neuraminidase__InfluenzaA__AFO65019
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacagccacuaugaagaguguuccugcuacccagacaccggcacggugaugugugucugccgggauaauuggcacggcucuaaccgccccugggugagcuuuaaucagaaccuggacuaccagaucggguauauuugcucaggaguguucggugauaauccuagaccaaaagacggcgaggggaguuguaacccggucacugccgauggagcugacggcguuaaggguuuuuccuacaaauaugggaauggcguguggaucggaaggacaaagagcaaccggcugcgcaaaggcuucgaaaugaucugggaccccaauggguggaccgauacugacucugauuuuucaguaaagcaagacguggucgccauuacagauuggaguggauacagcgguuccuucgugcagcauccugagcucaccggcuuagacugcauacgaccauguuuuuggguugaacuggugagagggaggccccgggagaacacgaccaucuggacaucuggaucgagcauuuccuucugcggcgucaauucagauacugcaaacuggaguuggccugacggugcugaacuuccauucaccaucgauaaguga

SEQ ID NO: 145155 - RNA, 1413 nt, Artificial Sequence; identical to SEQ ID NO: 138469
  derived and/or modified sequence opt3 from neuraminidase__InfluenzaA__AFO65030

SEQ ID NO: 145156 - RNA, 1413 nt, Artificial Sequence
  derived and/or modified sequence opt3 from neuraminidase__InfluenzaA__AFO65041
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugguagcagggaaagacaagaccucggugacacuugccggaaauucaagccuguguaguaucuccggcugggcgauuuacaccaaagauaacucuaucaggaucgguagcaagggggacgucuucgugauucgggagccuuuuauauccugcucacauuuggagugucgcacuuucuuuuuaacacaaggagcucugcuaaaugauaaacacaguaacggcaccguuaaggaccgaagcccauaucgugcccucaugucuugcccgcugggcgaagcacccuccccuuacaauucaaaguucgagagcguggccuggagugcuucugcaugucaugaugggaugggauggcuuacgaucgguauuuccggcccagacaacggggccgucgcugugcugaaauauaacggaaucauaacugaaaccauuaagagcuggaaaaagcagaucuugagaacacaggagucggagugcguauguguuaauggcucuugcuuuacuaucaugaccgauggucccuccaacggggccgcgucauacaaaauuuucaagaucgaaaagggaaaagugacaaagaguauugagcucaaugcaccuaacuuucacuaugaagaguguagcugcuacccagacaccggcacggucaugugugugugcagggauaauuggcacggcuccaaccggcccugggugucuuucaaucagaaccuggacuaccaaauaggguauaucugcagcggagucuuuggugauaauccucgcccaaaagacggcgaggggucauguaacccgguuacuguggauggagccaauggcguaaaggguuucaguuacaaauaugggaacggcguguggauuggaagaacaaaguccaauaggcugcggaaaggcuuugaaaugaucugggaccccaacggguggaccgacacugauagcgacuucucugucaagcaggaugugguugcuaucacagacuggucaggauacagugguagcuuugugcagcauccugagcucaccggcuuagauugcauucgcccauguuucugggucgaacuggugcgagggcuucccagagagaauacgaccauauggacauccggaucuucgaucagcuucugcggcguaaacuccgacacugccaacuggucauggccugauggugcagaauugccauuuaccauugacaaguga

SEQ ID NO: 145157 - RNA, 1413 nt, Artificial Sequence
  derived and/or modified sequence opt3 from neuraminidase__InfluenzaA__AFO65052
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucgcagggaaagacaagaccucgaugacacuugccggaaauucaagccuguguaguauuuccggcugggcgaucuacaccaaagauaacucuaucaggauugguagcaagggggacguauucgugauacgggagccuuuuaucuccugcucacauuuggagugucgcacuuucuuuuuaacacaaggagcucugcuaaaugauaaacacaguaacggcaccgucaaggaccgaagcccauaucgugcccucaugucuugcccgcugggcgaagcacccuccccuuacaauucaaaguucgagagcguggccuggagugcuucugcauguaacgaugggaugggauggcuuacgauugguaucuccggcccagacaacggggccguugcugugcugaaauauaauggaauaauuacugaaaccaucaagagcuggaaaaagcagaucuugagaacacaggagucggagugcgucugugugaacggcucuugcuuuacuauuaugaccgauggucccuccaauggggccgcgucauacaaaaucuucaagauugaaaagggaaaaguaacaaagaguauagagcucaacgcaccuaauuuucauuaugaagaguguagcugcuacccagacaccggcacgguuaugugugugugcagggauaacuggcacggcuccaaucggcccugggucucuuucaaccagaaucuggacuaccaaaucggguauauuugcagcggaguguuuggugauaacccucgcccaaaagacggcgaggggucauguaauccggugacugucgauggagccaacggcguuaaggguuucaguuacaaauaugggaauggcguguggaucggaagaacaaaguccaacaggcugcggaaaggcuuugaaaugaucugggaccccaauggguggaccgacacugauagcgacuucucuguaaagcaggauguggucgcuauuacagacuggucaggauacagugguagcuuugugcagcacccugagcucaccggcuuagauugcauacgcccauguuucuggguugaacuggugcgagggcuucccagagagaacacgaccaucuggacauccggaucuucgauuagcuucugcggcgucaacuccgacacugccaauuggucauggccugauggugcagaauugccauuuaccaucgacaaguga

SEQ ID NO: 145158 - RNA, 1413 nt, Artificial Sequence; identical to SEQ ID NO: 136844
  derived and/or modified sequence opt3 from neuraminidase__InfluenzaA__AFO66139

SEQ ID NO: 145159 - RNA, 1413 nt, Artificial Sequence
  derived and/or modified sequence opt3 from neuraminidase__InfluenzaA__AFO66150
augaaccccaaucagaagaucauuaccauaggcagcaucuccguggccauugggaucauuucucugauccuccaaauaggaaacaucauuucaaucugggcuagucacagcauucagacagguucccagaauuacacuggcaucugcaaccagagaauaauuacguaugagaauaggaccugggucaaccaaacauacguuaauaucaacaauacuaacgugguagcagggaaagacaagaccucuaugacacuugccggaaauucgucacuguguccuauucggggcugggcgaucuauaccaaagauaacagcauccgcauugguaguaagggggacguguucgucauacgagaaccauuuaucuccugcucucauuuggagugucguacuuucuuuuuaacacagggagcucugcuaaaugauaaacacagcaacggcaccauuaaggacagauccccguucagggcccucaugucaugcccccugggcgaagcaccuaguccauacaauagccgguuugagucuguggccugguccgcuucagcaugucaugaugggcuuggauggcugacgaucgguauaagcggccccgacaacggggccguugcuguguugaaguauaacggaauuaucacugaaaccaucaaaaguuggaagaaacagauucuccgcacacaggagucugagugcgucugugugaauggcuccugcuucacuaucaugaccgaugguccuagcaacagagccgcgucguacaggauuuuuaagauagaaaaagggcggguaacaaagucuaucgagcuggacgcaccaaauuaucacuacgaagaguguuccugcuaccccgauaccggaacgguuaugugugugugccgcgacaacuggcauggcucaaaucgaccuugggucaguuucaaccaaaaucuggauuaucagauuggcuacaucugcagcgggguguuuggagacaacccaagaccgaaggauggugagggcuccuguaaucccgugacugucgacggggccgacggaguuaaaggcuucucuuauagguacgguaacgggguguggaucggccggacaaagagcaaucguauucgcaaaggauuugaaaugauaugggauccuaacggcuggaccgacacugauucagacuucaguaugaagcaggauguaguggcuaugacagacugguccggguauagcggaucuuuuguccagcacccagagcucaccgguuuagauugcaugagacccuguuucuggguggaacugguuaggggccuuccucgggagaauacgaccaucuggacaucagggaguagcauuuccuucugcggagugaacucugaaacugccaauuggucguggccagacggcgcagaguugcccuuuaccaucgauaaauga

SEQ ID NO: 145160 - RNA, 1413 nt, Artificial Sequence
  derived and/or modified sequence opt3 from neuraminidase__InfluenzaA__AFO66161
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucgcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagcagaucuugagaacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaucugugucugcagggauaauuggcacggcuccaaccggcccugggugucuuucaaucagaaccuggacuaccaaauuggguauaucugcagcggaguguuuggugauaauccucgcccaaaagacggcgaggggucauguaacccggucacuguugauggagccaauggcgugaaggguuucaguuacaaauaugggaacggcguauggaucggaagaacaaaguccaauaggcugcggaaaggcuuugaaaugauuugggaccccaacggguggaccgacacugauagcgacuucucugugaagcaggaugucguggcuauaacagacuggucaggauacagugguagcuuuguucagcauccugagcucaccggcuuagauugcauccgcccauguuucuggguggaacugguccgagggcuucccaaggagaauacgaccauuuggacauccggaucuucgaucagcuucugcggcgugaacuccgacacugccaacuggucauggccugauggugcagaauugccauuuaccauugacaaauga

SEQ ID NO: 145161 - RNA, 1413 nt, Artificial Sequence
  derived and/or modified sequence opt3 from neuraminidase__InfluenzaA__AFO66172
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguaugaauggcucuugcuuuacuauuaugaccgauggucccuccaacggggccgcgucauacaaaaucuucaagauugaaaagggaaaaguaacaaagaguauagagcucaaugcaccuaacuuucacuaugaagaguguagcugcuacccagacaccggcacgguuaugugugugugccgggauaauuggcacggcuccaaccgccccugggucucuuucaaucagaaccuggacuaccagaucggguauauuugcagcggaguguuuggugauaauccuagaccaaaagacggcgaggggucauguaacccggugacugucgauggagccgacggcguuaaggguuucaguuacaaauaugggaauggcguguggaucggaaggacaaaguccaaccggcugcgcaaaggcuuugaaaugaucugggaccccaauggguggaccgauacugacagcgauuucucuguaaagcaagacguggucgcuauuacagauuggucaggauacagugguagcuuugugcagcauccugagcucaccggcuuagacugcauacgaccauguuucuggguugaacuggugagagggcuucccagggagaacacgaccaucuggacauccggaucuucgauuagcuucugcggcgucaauuccgauacugccaacuggucauggccugacggugcagaauugccauuuaccaucgauaaguga

SEQ ID NO: 145162 - RNA, 1413 nt, Artificial Sequence; identical to SEQ ID NO: 136946
  derived and/or modified sequence opt3 from neuraminidase__InfluenzaA__AFO66183

SEQ ID NO: 145163 - RNA, 1413 nt, Artificial Sequence
  derived and/or modified sequence opt3 from neuraminidase__InfluenzaA__AFO66194
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucgcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagcagaucuugagaacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugcagggauaauuggcacggcuccaaccggcccugggugucuuucaaucagaaccuggacuaccaaaucggguauauuugcagcggaguguuuggugauaauccucgcccaaaagacggcgaggggucauguaacccggucacuguugauggagccaauggcgugaaggguuucaguuacaaauaugggaacggcguauggaucggaagaacaaaguccaauaggcugcggaaaggcuuugaaaugaucugggaccccaacggguggaccgacacugauagcgacuucucugugaagcaggauauugucgcuauaacagacuggucaggauacagugguagcuuugugcagcauccugagcucaccggcuuagauugcauccgcccauguuucuggguugaacuggugcgagggcuucccaaggagaauacgaccauuuggacauccggaucuucgaucagcuucugcggcgucaacuccgacacugccaacuggucauggccugauggugcagaauugccauuuaccauugacaaauga

SEQ ID NO: 145164 - RNA, 1410 nt, Artificial Sequence; identical to SEQ ID NO: 138571
  derived and/or modified sequence opt3 from neuraminidase__InfluenzaA__AFO66205

SEQ ID NO: 145165 - RNA, 1413 nt, Artificial Sequence; identical to SEQ ID NO: 136431
  derived and/or modified sequence opt3 from neuraminidase__InfluenzaA__AFO66216

SEQ ID NO: 145166 - RNA, 1413 nt, Artificial Sequence; identical to SEQ ID NO: 136402
  derived and/or modified sequence opt3 from neuraminidase__InfluenzaA__AFO66227

SEQ ID NO: 145167 - RNA, 1413 nt, Artificial Sequence
  derived and/or modified sequence opt3 from neuraminidase__InfluenzaA__AFO66238
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagcagaucuugagaacacaggagucggagugcguguguaugaauggcucuugcuuuacuauuaugaccgauggucccuccaacggggccgcgucauacaaaaucuucaagauugaaaagggaaaaguaacaaagaguauagagcucaaugcaccuaacuuucacuaugaagaguguagcugcuacccagacaccggcacgguuaugugugugugcagggauaauuggcacggcuccaaccggcccugggucucuuucaaucagaaccuggacuaccaaaucggguauauuugcagcggaguguuuggugauaauccucgcccaaaagacggcgaggggucauguaacccggugacugucgauggagccgacggcguuaaggguuucaguuacaaauaugggaauggcguguggaucggaagaacaaaguccaacaggcugcggaaaggcuuugaaaugaucugggaccccaauggguggaccaacacugauagcgacuucucuguaaagcaggauguggucgcuauuacagacuggucaggauacagugguagcuuugugcagcauccugagcucaccggcuuagauugcauacgcccauguuucuggguugaacuggugcgagggcuucccagagagaauacgaccaucuggacauccggaucuucgauuagcuucugcggcgucaacuccgacacugccaacuggucauggccugauggugcagaauugccauuuaccaucgacaaguga

SEQ ID NO: 145168 - RNA, 1413 nt, Artificial Sequence
  derived and/or modified sequence opt3 from neuraminidase__InfluenzaA__AFO66249
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacuggcaccaucaagagcuggaaaaagcagaucuugagaacacaggaaucggagugcguguguaugaaugguucuugcuuuacuauuaugaccgaugggcccuccaacggagccgcgucauacaaaaucuucaagauugagaagggcaaaguaacaaagaguauagaacucaaugcaccuaacuuucacuaugaggaauguagcugcuacccagacaccggcacgguuaugugugugugcagggauaauuggcacggguccaaccggcccugggucucuuucaaucagaaccuggacuaccaaaucggauauauuugcagcgguguguuuggcgauaauccucgcccaaaagacggggagggaucauguaacccggugacugucgauggcgccgacgguguuaagggguucaguuacaaauauggcaauggaguguggaucggcagaacaaaguccaacaggcugcggaaaggguuugagaugaucugggaccccaauggauggaccaacacugauagcgacuucucuguaaagcaggauguggucgcuauuacagacuggucagguuacaguggcagcuuugugcagcauccugaacucaccggguuagauugcauacgcccauguuucuggguugagcuggugcgaggacuucccagagaaaauacgaccaucuggacauccgguucuucgauuagcuucugcggcgucaacuccgacacugccaacuggucauggccugauggggcagaguugccauuuaccaucgacaaguga

SEQ ID NO: 145169 - RNA, 1413 nt, Artificial Sequence
  derived and/or modified sequence opt3 from neuraminidase__InfluenzaA__AFP33330
augaaccccaaucagaagaucauuaccauaggcagcaucuccguggccauugggaucauuucucugauccuccaaauaggaaacaucauuucaaucugggcuagucacagcauucaggcagguucccagaauuacacaggcaucugcaaccagaaaauaauuacuuaugagaauagaacgugggucaaccaaaccuacguuaauaucaacaauacaaacgugguagccgggaaggacaaaacuucuaugacccuugcgggaaauucgucacuguguccuauuaggggcugggcuaucuauacaaaggauaacagcauccggauugguaguaaaggggacguguucgucauacgcgaaccauuuaucuccugcucucauuuggagugucgaaccuucuuuuuaacucagggagcccugcuaaaugauaagcacagcaacggcacaauuaaggaccguuccccguucagagcacucaugucaugcccccugggcgaagccccuaguccauacaauagcagguuugagucuguggcuugguccgcaucagccugucaugaugggcuuggauggcugaccaucgguauaagcggccccgacaacggggcuguugccguguugaaauauaacggaauuaucacggaaacuaucaagaguuggaaaaagcagauucuccggacccaggagucugagugcgucugugugaauggcuccugcuucacaaucaugacugaugguccuagcaaccgcgcggcaucguacagaauuuuuaaaauagaaaaggggaggguaaccaagucuaucgagcuggacgccccaaauuaucacuacgaagaguguuccugcuaccccgauacaggaaccguuaugugugugugccgggacaacuggcauggcucaaaucgcccuugggucaguuucaaccaaaaucuggauuaucagauuggcuacaucugcagcgggguguuuggagacaacccacgaccgaaagauggugagggcuccuguaaucccgugacggucgacggggcugacggaguuaagggcuucucuuauagauacgguaacgggguguggaucggcaggacuaaaagcaaucggcuccguaagggauuugaaaugauuugggauccuaacggcuggacagacaccgauucagacuucaguaugaaacaggauguaguggccaugacugacugguccggguauagcggaucuuuuguccagcacccagaguuaacaggucuggauugcaugcgccccuguuucuggguggaacuuguuagaggcuugccuagggagaauaccacgauauggaccucagggaguagcaucuccuucugcggagugaacucugaaacagcaaauuggucguggccagacggcgcugagcugcccuuuacuauugauaaguga

SEQ ID NO: 145170 - RNA, 1413 nt, Artificial Sequence
  derived and/or modified sequence opt3 from neuraminidase__InfluenzaA__AFP33331
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuauugcagggaaagacaagaccucggugacacuugccggaaauucaagccuguguaguaucuccggcugggcgaucuacaccaaagauaacucuauuaggauagguagcaagggggacguauucgugauccgggagccuuuuauuuccugcucacauuuggagugucgcacuuucuuuuuaacacaaggagcucugcuaaaugauaaacacaguaacggcaccgucaaggaccgaagcccauaucgugcccucaugucuugcccgcugggcgaagcacccuccccuuacaauucaaaguucgagagcguggccuggagugcuucugcaugucaugaugggaugggauggcuuacgaucgguauauccggcccagacaacggggccguugcugugcugaaauauaacggaauuaucacugaaaccaucaagagcuggaaaaagagaauuuugaggacacaggagucggagugcgucugugugaauggcucuugcuuuacuaucaugaccgauggucccuccaacggggccgcgucauacaaaauuuucaagauagaaaagggaaaaguaacaaagaguaucgagcucaaugcaccuaacuuucacuaugaagaguguagcugcuacccagacaccggcacgguuaugugugugugccgggauaauuggcacggcuccaaccgccccugggucucuuucaaucagaaccuggacuaccagauuggguauaucugcagcggaguguuuggugauaauccuagaccaaaagacggcgaggggucauguaacccggugacugucgauggagccgacggcguuaaggguuucaguuacaaauaugggaauggcguguggaucggaaggacaaaguccaaccggcugcgcaaaggcuuugaaaugauuugggaccccaauggguggaccgauacugacagcgauuucucuguaaagcaagacguggucgcuauaacagauuggucaggauacagugguagcuuugugcagcauccugagcucaccggcuuagacugcauccgaccauguuucuggguugaacuggugagagggcuucccagggagaacacgaccauuuggacauccggaucuucgaucagcuucugcggcgucaauuccgauacugccaacuggucauggccugacggugcagaauugccauuuaccauugauaaguga

SEQ ID NO: 145171 - RNA, 1410 nt, Artificial Sequence; identical to SEQ ID NO: 143159
  derived and/or modified sequence opt3 from neuraminidase__InfluenzaA__AFQ32576

SEQ ID NO: 145172 - RNA, 1410 nt, Artificial Sequence
  derived and/or modified sequence opt3 from neuraminidase__InfluenzaA__AFQ37282
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccgggggauccucaauaaguuuuuguggcgucaauucugacacuguggguuggagcuggcccgauggggcagaguuaccguucacaaucgacaaguga

SEQ ID NO: 145173 - RNA, 1410 nt, Artificial Sequence
  derived and/or modified sequence opt3 from neuraminidase__InfluenzaA__AFQ55691
augaaccccaaucagaagaucauuaccauaggcguggucaacacaacucugagcacgaucgcccuccuuauugggguuggaaaucugguguucaacaccguaauccacgagaaaauuggugaccaucaaacagugacucacccuaccacaaccacuccagcuaucccgaauugcuccgauacaauaaucaccuacaacaauacgauuaucaacaauauuacuaccacaaucauaacugaagcagagagacccuuuaagucuccuuugccauuaugucccuucaggggcuuuuucccuuuucauaaagacaacgccauucggcugggggaaaauaaggaugucaucgugacccgcgagccauauguuucaugcgacaacgauaauuguuggaguuucgcgcuagcucagggagcccuccugggcacaaaacacagcaacgguaccauuaaggaccgaacgcccuaccguucccuuaucagauuuccuaucgggacugcaccagugcugggaaauuauaaggaaauuugcauagccuggucuucgucaagcuguuucgauggcaaagaguggaugcaugucugcaugacaggcaacgacaacgaugcuagugcacagaucauuuacgccgggaagaugaccgacuccaucaaaucuuggaggaaggauauauugcggacucaggagagcgaaugucaaugcauugacggaacaugugugguagcuguuaccgaugguccggccgcguccucagcagaccaccgcaucuauuggaucagagagggcaaaauuaucaaguacgaagacgugcccaagacgaaaauucagcaccucgaggagugcaguuguuaugucgauguggacguguacugcauaugcagggauaauuggaaggggagcaaccggccuuggaugcgcaucaauaacgaaaccauucuggagacaggauacgucuguucuaaauuucauuccgacacuccacgacccgccgauccuucaaccguuagcugcgacaguccaucuaaugugaacggcggucccgggguaaagggauucggcuuuaaagcuggcaaugauguguggcuggggagaacagucuccacuagcggaaggucggguuucgaaaucaucaaggugaccgagggcuggauuaacucuccgaaucacgccaaauccauaacacagacccucaugucaaacaaugacuggaguggguauagcggauccuuuaucauuaagacuaaggauuguuuccagccuugcuucuacguugaauuaauccggggccgucccaacaaaaaugacgaugugucuuggacgagcaacucaauugucacauuuuguggucuggacaaugagccagggaguggcaacuggccugacggauccaacaucggcuucaugcccaaguga

SEQ ID NO: 145174 - RNA, 1410 nt, Artificial Sequence
  derived and/or modified sequence opt3 from neuraminidase__InfluenzaA__AFR68156
augaaccccaaucagaagaucauuaccauaggcagcgugugcaugacaaucgggauggccaaccugauucuccaaaucggaaauauuaucuccauauggaucucucacucaauucagcuuagaaaccagagucagaucgagacuuguaaucaaagcgucauuacguacgaaaacaauaccuggguuaaccagacauaugugaauaucuccaacacuaauuucgcugcaggucagucuguagugucggucaaacuggccggcaacagcucauugugcccugugagugggugggcgauauacuccaaggacaauucuauuaggaucggaagcaaaggcgauguuuuugugauucgggagccauucaucuccuguucaccguuagaaugccgcaccuuuuuccugacacagggugcucuacucaacgacaagcauaguaaugggaccaucaaagaucgaagccccuaucguacucugaugucuuguccuauuggagaggucccaucccccuacaacucaagauuugaaagcguggccuggagugcaucugccugccacgacggcauaaacuggcuuacaaucggcauuuccgggccugauaauggagcuguagcaguucugaaguauaacgguaucauaaccgacacgauuaagagcuggaggaauaacaucuugcggacucaagagucggagugugccugcgugaauggcucuuguuucaccaucaugacagaugggccauccgacggacaggcuucauacaaaauuuuucgcaucgaaaagggcaaaauugucaagaguguggagaugaacgcccccaauuaucauuacgaagagugcagcuguuacccugauuccucugagauaacuugcgugugcagagacaacuggcacgguagcaauaggccaugggucucauucaaccagaaucucgaauaucagaucggguacauuuguaguggaaucuuuggcgauaacccgcggcccaaugacaaaaccggcuccugcgggccuguuagcucuaacggagcgaauggugugaagggcuucucauuuaaguaugggaacggaguauggaucggccgcacaaaaaguauuagcucccgaaaggguuucgagaugauaugggauccaaacggguggaccggcacggacaauaacuuuucuaucaaacaagacauugugggaaucaaugaauggucgggcuacagcggguccuucguccagcaucccgagcugacuggacuggauuguauuagaccuugcuucuggguggaacucaucaggggucggccaaaggagaacacaauauggaccucaggcaguucuaucagcuuuugugggguuaauuccgacacugugggauggucauggcccgauggcgcagaguuaccguucacaauugacaaauga

SEQ ID NO: 145175 - RNA, 1410 nt, Artificial Sequence; identical to SEQ ID NO: 145174
  derived and/or modified sequence opt3 from neuraminidase__InfluenzaA__AFR68166

SEQ ID NO: 145176 - RNA, 1410 nt, Artificial Sequence
  derived and/or modified sequence opt3 from neuraminidase__InfluenzaA__AFR68176
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguagcuucauggaguaaagacauucugcggacgcaggagagcgaauguguuugcauaaacggcacuugugcaguggucaugacagauggcucugccuccgggaaggcugacaccaaaauccucuuuauuaaggagggaaagaucgugcauacuucaacauuaagcgguagugcccaacacguggaggaaugcucuugcuauccucgcuacccaggcgucagauguguuugcagggauaacuggaaaggguccaaucggccgauaguggacauuaacaucaaggaccacagcaucguaucgucuuacguguguuccggacuggucggcgauacgccccgcaaaaaugacucaaguagcuccggucauugccuugauccuaacaaugaggaagggggacacggcgugaagggcugggcguucgacgaugggaacgacguuuggaugggacgaaccauuaaugagaccucuagauuggguuaugaaacauuuaaagugaucgagggcuggagcaacccaaagucaaaacugcagauuaauaggcaggucauaguggaucgggggaaccguaguggauacuccggcaucuucagcguagaggguaagaauuguauuaaccgcugcuuuuauguugaacuaaucagagggaggaaggaggaaacugaggugcucuggaccucuaauucaaucgucguguucuguggcacaaguggaacuuacggcaccgggagcuggcccgacggagcagaucugaaccuuaugccuauuuga

SEQ ID NO: 145177 - RNA, 1410 nt, Artificial Sequence; identical to SEQ ID NO: 138754
  derived and/or modified sequence opt3 from neuraminidase__InfluenzaA__AFR84677

SEQ ID NO: 145178 - RNA, 1410 nt, Artificial Sequence; identical to SEQ ID NO: 139641
  derived and/or modified sequence opt3 from neuraminidase__InfluenzaA__AFR84687

SEQ ID NO: 145179 - RNA, 1410 nt, Artificial Sequence; identical to SEQ ID NO: 138744
  derived and/or modified sequence opt3 from neuraminidase__InfluenzaA__AFR84696

SEQ ID NO: 145180 - RNA, 1410 nt, Artificial Sequence; identical to SEQ ID NO: 138754
  derived and/or modified sequence opt3 from neuraminidase__InfluenzaA__AFR84706

SEQ ID NO: 145181 - RNA, 1410 nt, Artificial Sequence; identical to SEQ ID NO: 138744
  derived and/or modified sequence opt3 from neuraminidase__InfluenzaA__AFR84716

SEQ ID NO: 145182 - RNA, 1410 nt, Artificial Sequence; identical to SEQ ID NO: 138744
  derived and/or modified sequence opt3 from neuraminidase__InfluenzaA__AFR84726

SEQ ID NO: 145183 - RNA, 1410 nt, Artificial Sequence; identical to SEQ ID NO: 138744
  derived and/or modified sequence opt3 from neuraminidase__InfluenzaA__AFR84736

SEQ ID NO: 145184 - RNA, 1410 nt, Artificial Sequence; identical to SEQ ID NO: 138744
  derived and/or modified sequence opt3 from neuraminidase__InfluenzaA__AFR84746

SEQ ID NO: 145185 - RNA, 1410 nt, Artificial Sequence; identical to SEQ ID NO: 138744
  derived and/or modified sequence opt3 from neuraminidase__InfluenzaA__AFR84756

SEQ ID NO: 145186 - RNA, 1410 nt, Artificial Sequence; identical to SEQ ID NO: 138744
  derived and/or modified sequence opt3 from neuraminidase__InfluenzaA__AFR84766

SEQ ID NO: 145187 - RNA, 1410 nt, Artificial Sequence; identical to SEQ ID NO: 138744
  derived and/or modified sequence opt3 from neuraminidase__InfluenzaA__AFR84776

SEQ ID NO: 145188 - RNA, 1410 nt, Artificial Sequence; identical to SEQ ID NO: 138744
  derived and/or modified sequence opt3 from neuraminidase__InfluenzaA__AFR84786

SEQ ID NO: 145189 - RNA, 1410 nt, Artificial Sequence; identical to SEQ ID NO: 138744
  derived and/or modified sequence opt3 from neuraminidase__InfluenzaA__AFR84796

SEQ ID NO: 145190 - RNA, 1410 nt, Artificial Sequence; identical to SEQ ID NO: 138754
  derived and/or modified sequence opt3 from neuraminidase__InfluenzaA__AFR84806

SEQ ID NO: 145191 - RNA, 1410 nt, Artificial Sequence; identical to SEQ ID NO: 138744
  derived and/or modified sequence opt3 from neuraminidase__InfluenzaA__AFR84816

SEQ ID NO: 145192 - RNA, 1410 nt, Artificial Sequence; identical to SEQ ID NO: 138754
  derived and/or modified sequence opt3 from neuraminidase__InfluenzaA__AFR84826

SEQ ID NO: 145193 - RNA, 1410 nt, Artificial Sequence
  derived and/or modified sequence opt3 from neuraminidase__InfluenzaA__AFR84836
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaacucgucauugugcccugugggaggcugggcgauauacagcaaggacaauaguguuagaauugguuccaaaggggauguguuugucaucagggagccauucauuucuuguagcccguuagaaugccggaccuuuuuccugacacagggagcucuacucaaugacaagcauuccaacggcaccaucaaagaucgcucacccuaucgaacucugaugaguuguccuaucggcgaggugccaagccccuacaacucucguuuugaauccguagccuggucagcaagcgccugccacgacgggauuaauuggcuuacaauaggaaucagugguccugauaacggcgcuguugcagugcugaaguauaaugggauuaucaccgacacgauaaagucuuggagaaacaauauuuugaggacucaagaguccgagugugccugcgucaacggaagcuguuucaccgugaugacagauggcccaucgaauggucaggcuucuuacaaaaucuuucggaucgaaaaggggaaaauugugaaguccgucgagaugaacgcccccaauuaucauuacgaagagugcucauguuacccugacaguagcgagaucacuugcguuugccgcgauaacuggcacggauccaauagaccaugggugucuuucaaccagaaucucgaauaucagauuggcuacauauguagcggcaucuuuggggacaacccgaggcccaaugauaaaaccggaucaugcgguccuguaaguuccaacggcgcgaacggggugaagggauucagcuuuaaguauggcaauggugucuggauugggcggacaaaaucuaucucaagucgcaacggcuucgagaugaucugggacccaaauggauggaccgaaacggauaacaauuuuagcauuaagcaagacauagugggcaucaacgagugguccggguacucuggaucguucguucagcaucccgaacugacuggucuggacuguauucgaccuugcuucuggguggagcucaucagaggcaggccaaaagagaauacaauuuggaccagcggguccucaaucaguuuuuguggagucaacucugauacugugggcuggagcuggcccgacggugcagaauuaccguucacaauagauaaguga

SEQ ID NO: 145194 - RNA, 1410 nt, Artificial Sequence; identical to SEQ ID NO: 139558
  derived and/or modified sequence opt3 from neuraminidase__InfluenzaA__AFR84846

SEQ ID NO: 145195 - RNA, 1410 nt, Artificial Sequence; identical to SEQ ID NO: 138754
  derived and/or modified sequence opt3 from neuraminidase__InfluenzaA__AFR84856

SEQ ID NO: 145196 - RNA, 1410 nt, Artificial Sequence
  derived and/or modified sequence opt3 from neuraminidase__InfluenzaA__AFR84866
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuuucgaacucugaugagcuguccuauuggcgaggucccaucucccuauaacucccguuucgaaucaguggccuggagcgcaagugccugccacgacggcauaaauuggcuuacaaucgggauuucuggaccugauaacggugcuguagcaguucugaaguacaauggcaucauaaccgacacgauuaaguccuggagaaacaauaucuugaggacucaagagagcgagugugccugcgugaacgggucguguuuuaccgucaugacagauggaccaucugacggccaggcuuccuauaaaaucuuccggauugaaaaggguaaaaucgugaagucaguggagaugaaugcccccaacuaccauuaugaagagugcaguuguuacccugauagcuccgagauuacuugcgucugccgcgacaauuggcacgggucuaacagaccauggguuagcuuuaaucagaaccucgaauaccagauaggauauaucuguucaggcauuuucggcgauaauccgaggcccaacgacaaaaccgggaguugcggaccuguguccagcaauggugcgaacggcguaaagggguuuucuuucaaguacggaaacggcguguggaucggucggacaaaaucaaucaguagccgcaauggguuugagaugauuugggauccaaacggcuggaccggaacggacaauaacuucuccauaaagcaagacaucgucggcauuaaugaauggucuggguauucggggagcuucgugcagcaucccgagcugacuggucuggauuguauccgaccuugcuuuuggguugaacucauuagaggcaggccaaaagagaacacaaucuggaccuccgggucaaguauaucuuucuguggagugaauagcgacacugucggcugguccuggcccgauggugcagaguuaccguuuacaaucgacaaguga

SEQ ID NO: 145197 - RNA, 1410 nt, Artificial Sequence; identical to SEQ ID NO: 139462
  derived and/or modified sequence opt3 from neuraminidase__InfluenzaA__AFR84876

SEQ ID NO: 145198 - RNA, 1410 nt, Artificial Sequence; identical to SEQ ID NO: 139558
  derived and/or modified sequence opt3 from neuraminidase__InfluenzaA__AFR84895

SEQ ID NO: 145199 - RNA, 1410 nt, Artificial Sequence; identical to SEQ ID NO: 139558
  derived and/or modified sequence opt3 from neuraminidase__InfluenzaA__AFR84905

SEQ ID NO: 145200 - RNA, 1410 nt, Artificial Sequence; identical to SEQ ID NO: 139558
  derived and/or modified sequence opt3 from neuraminidase__InfluenzaA__AFR84915

SEQ ID NO: 145201 - RNA, 1410 nt, Artificial Sequence; identical to SEQ ID NO: 139558
  derived and/or modified sequence opt3 from neuraminidase__InfluenzaA__AFR84925

SEQ ID NO: 145202 - RNA, 1353 nt, Artificial Sequence
  derived and/or modified sequence opt3 from neuraminidase__InfluenzaA__AFU83119
augaaccccaaucagaagaucauuaccauaggcagcgugucccugacaaucgccacugucugcuuccucaugcaaauugcuauccuugcaacgaccguuacacugcacuuuaaacagaacgaguguucuauuccuucaaguaaucaggugguaccaugcgaaccgaucauaguggagagaaacgucacugaauacagggacuggagcaagccccagugucaaaucaccggguucgccccuuuuuccaaagauaauucuauucgguugucggcgggaggugacaucugggugacacgcgagccauauguuucaugcagccccgauaaguguuaccaguucgcuuuaggccaggggaccacucuggacaacaaacauaguaauggaacaauucacgaucgaaucccucaucguacccuacucaugaacgaacugggcgugccauuucaccuugguacgaagcaggucugcauagccugguccucuagcuccugucaugacgggagagcauggcugcacgugugcguaacuggagaugacaggaaugccaccgcuucauucauuuaugauggcguuuugguggacaguaucggcagcuggucucaaaacauucuccggacacaggaguccgagugugucugcaucaaugggacuuguaccguggugaugacagauggaucagcaagcggucgcgccgacaccagaauccuguuuauuaaggaaggcaaaauaguccacguuaguccccugucuggguccgcucagcauaucgaggaaugcagcugcuacccuagguauccagaugugcgguguguaugccgcgacaacuggaagggaucgaaucgaccgauuaucgacauaucuauggccgauuacggcauugacuccucauauguguguaguggucucgucggggauacgcccagaaacgacgauagcuccucuaauagcaacugcaaagacccuaacaaugagaggggaaacccaggcgugaagggcugggcguucgauuacgggaaugacguuuggaugggacggacuaucucaaaagauagucguuccgguuacgagacauuucgcgugaucggcggguggaccauugcaaacagcaagucucaggucaauagacaagugaucguagacaacaauaacuggucaggauauaguggcauuuucagcguugaagguaaguccuguauaaauaggugcuuuuacguggaguuaauccgggggcgaccccaggaaacucgcgucugguggacaucuaacucgauuguggccuucuguggcaccagcggaacguauggcaccggguccuggccugauggagcuaauaucaacuuuaugccaaucuga

SEQ ID NO: 145203 - RNA, 1410 nt, Artificial Sequence
  derived and/or modified sequence opt3 from neuraminidase__InfluenzaA__AFV53208
augaaccccaaucagaagaucauuaccauaggcagcgugucccugacaaucgccacugucugcuuccucauucaaaucgcuauucuuguuacgaccgugacacugcacuuuaaacagcaugagugugacucuccugcaucaaaccagguaaugccaugcgaaccgaucauaaucgagagaaauauuacugaaaucguguacuugaacaauaccacaauugagaaggaaaucugucccaaagucguggaguauaggaacuggaguaagccucagugccaaauaaccggguucgccccauuuagcaaagauaauuccauucgguuaucugcgggaggugacaucuggguuacucgcgagcccuacgugucgugugauccuggcaagugcuaucaguucgcucuggggcagggaacaacccuagacaacaagcacucaaaugauacgauucaugaccgaaucccacaccguacucuccugaugaacgaacuuggcguccccuuucaucuggguaccagacagguguguaucgccuggagcaguuccucuugccacgaugggaaagcaugguugcacguauguauuacaggagacgauaagaaugccacugcuagcuucauauacgacggcaggcucauggauuccaucggcucauggagucaaaacauucugcggacccaggagagcgaaugcguuuguaucaaugggacaugcaccguggucaugacggacggaucugcauccggucgcgccgauacuagaauacuguuuauugaggagggcaaaaucgugcauaucucaccucucagcgggagugcucagcacguggaagagugcucuuguuauccaagguacccgggaguccggugcauuugucgcgacaacuggaagggcuccaaucgacccguuaucgacauuaacauggaagauuauagcauagacucgucuuacgugugcuccgguuuaguaggggauacaccuagaaacgacgauaggucaaguaauagcaacugucggaauccaaacaaugagcguggaaaccagggcgugaaaggcugggccuucgacaauggggaugacgucuggaugggacgcaccaucuccaaggaucugagaucugguuacgaaacuuuuaaggugauuggcggguggagcacacccaacucaaaaagucaaaucaauaggcagguuaucguggacuccgauaaccggagcggauauucuggcauuuucucagucgaggguaagaguugcauaaaucgauguuuuuacguggagcuuauccgcgggagaaaacaggaaaccaggguaugguggacgagcaacuccauuguuguguucugcggcaccucuggaacauauggcacugggucguggccugacggagcgaauaucaacuuuaugccaauuuga

SEQ ID NO: 145204 - RNA, 1410 nt, Artificial Sequence
  derived and/or modified sequence opt3 from neuraminidase__InfluenzaA__AFV53219
augaaccccaaucagaagaccaucacaauuggcagcgugucccugacuauagccacggucugcuuccucaugcaaaucgcuauucuugcaaccacaguuacucugcacuuuaaacagcaugagugugacucuccugccucaaaccaggugaugccaugcgaaccgaucauuaucgagagaaauauaaccgaaaucguauacuugaacaauacaaccauugagaaggaaaucugucccgagguggucgaguauaggaacuggaguaaaccucagugccaaauuacuggguucgcgccauuuagcaaggauaauuccauccgguuaucugcuggaggugacauaugggugacacgcgaacccuacguuucgugugauccuggcaaaugcuaucaguucgcccuggggcagggaaccacgcuagacaacaagcacucaaauggcacuauucaugaucgaaucccacaccguacccuccugaugaacgagcuuggugugcccuuucaucuggggacaaagcaggucuguguggcauggagcaguuccucuugccacgacggaaaagccugguugcacguauguguuacuggcgaugacagaaaugcuaccgccagcuucauuuacgauggcaggcucguggacuccaucgggucauggagucaaaacauccugcggacacaggaaagcgagugcgucuguauuaauggaaccugcacgguggugaugacugaugguucugcauccggccgcgcugacacaagaauacuguuuaucaaggaggggaaaauuguccauaucucaccucucagcggaagugcccagcacauagaagagugcucuuguuauccaagguacccggauguucggugcauuugucgcgacaacuggaagggcuccaaucgacccgugaucgacaucaacauggaagauuauagcauugacucgucuuacguaugcuccgguuuagugggggauaccccuagaaacgacgauucaaguagcaauuccaacuguagggacccaaauaacgagcggggaaaucccggcgucaaaggcugggcguucgauaacggggacgauguguggaugggacguacuaucaauaaggaaucucgcagcgguuacgagacauuuaagguuauuggcggguggucaaccccuaacaguaaaucccaggugaauagacaagucauaguggacaacaauaacuggagcggauauucuggcaucuucucaguagaggguaagaguugcauuaauagguguuuuuacguugaacugauccgggggcgaccacaggagacgcgcgugugguggaccagcaacuccaucgucguguucugcggcacaucuggaacuuauggcaccgggucguggcccgauggagcaaauauuaacuuuaugccgauauga

SEQ ID NO: 145205 - RNA, 1410 nt, Artificial Sequence
  derived and/or modified sequence opt3 from neuraminidase__InfluenzaA__AFV53230
augaaccccaaucagaagaucauuaccauaggcagcgugucccugacaaucgccacugucugcuuccucaugcaaauugcuauccuuguuacgaccgugacacugcacuuuaaacagcaugagugugacucuccugcaucaaaccagguaaugccaugcgaaccgauuaucauagagagaaauaucacugaaauuguguacuugaacaauaccacaaucgagaaggaaauuugucccaaagucguggaguauaggaacuggaguaagccucagugcaaaaucaccggguucgccccauuuagcaaggauaauuccauacgguuaucugcgggaggugacauuuggguuacucgcgagcccuacgugucgugugauccuggcaagugcuaucaauucgcucuggggcagggaacaacccuagacaacaaacacucaaaugauacgauccaugaccguauuccacaccgaacucuccugaugaacgaacuuggcguccccuuucaucuggguaccagacagguguguaucgccuggagcaguuccucuugccacgaugggaaggcaugguugcacguauguguuacaggagacgauaaaaaugccacugcuagcuucaucuacgacggcaggcucguggauuccauuggcucauggagucagaacauacugcggacccaagagagcgaaugcgucuguaucaaugggacaugcaccguggugaugacggacggaucugcauccggucgcgccgauacuaagauucuguuuaucgaggagggcaaaauaguccauauuucaccucucagcgggagugcucagcacguugaagagugcucuuguuauccaagauacccggacgugaggugcaucugucgggacaacuggaagggauccaaucgccccguaguggauaucagcauggaagacuauucgauugauucuuccuacgucugcucaggcuuagugggugacacaccucgaaacgaugacagaaguagcaacuccaauuguaggaacccaaauaacgagcgggggaaucagggaguuaagggcugggccuucgauaacggcgacgauguguggauggggcguaccaucucuaaagaccugcgcagcggauacgaaacuuuuaaggucauugguggcuggucaacacccaauaguaaaucccagauaaacagacaagugaucguagauagcgacaauaggucuggguauucaggaauuuucaguguugagggcaagagcugcaucaaccgguguuuuuacguggagcuuauccgaggucgcaaacaggaaaccagagucugguggacguccaauucuauuguggucuucugcgggaccucgggcacauauggaacuggcagcuggccugacggggcgaacauaaauuugaugccaaucuga

SEQ ID NO: 145206 - RNA, 1410 nt, Artificial Sequence; identical to SEQ ID NO: 138421
  derived and/or modified sequence opt3 from neuraminidase__InfluenzaA__AFV53241

SEQ ID NO: 145207 - RNA, 1410 nt, Artificial Sequence; identical to SEQ ID NO: 136107
  derived and/or modified sequence opt3 from neuraminidase__InfluenzaA__AFV53252

SEQ ID NO: 145208 - RNA, 1413 nt, Artificial Sequence
  derived and/or modified sequence opt3 from neuraminidase__InfluenzaA__AFV53263
augaaccccaaucagaagaucauuaccauaggcagcaucugcauggccauugggacaaucucccugauucuccaaaucggaaacauaaucucuauuuggaucucacacaguauucagacugguagccagaaucauacgggcaucuguaaccagagaauaauuaccuacgagaauaacacaugggugaaucaaacuuaugucaacaucuccaauaccaacguuguggcugggaaagacacaaccucuaugauucuugcaggaaauucgucacugugcccuaucaggggcugggccaucuacagcaaggauaacaguauucggauagguuccaaaggggacguauucgugauccgcgaaccauuuauuucuuguagccacuuggagugccgaacuuucuuuuuaacacagggagcgcugcuaaaugauaagcauuccaacggcaccgucaaagaccguucaccguauagagcucucaugaguugucccaucggcgaagccccuagcccauacaauucuagguucgaguccguggcauggucagccagcgcuugccacgaugggaugggauggcugacgauagguauuaguggccccgacgauggggcaguugccgugcuuaaguauaacggaaucaucacugaaauuaucaagucuuggcggaaacagauucugcgcacccaggaguccgagugugucugcgugaacggcagcuguuuuacaauaaugacugacgguccuucgaauagaccagcuucuuacaggaucuucaagauugaaaaagggaagaucaccaaauccaucgaguuggaugcccccaacucacauuaugaagagugcaguuguuacccugacacaggaaagguaaugugcguuugccgggauaauuggcacggcagcaaccgcccauggguguccuuuaaucaaaaccucgacuaccagauuggcuauauauguucuggggucuucggagauaauccgcgacccaaggacgguaaaggcagcugcgacccugugaacguggauggggcggacggagucaagggcuuuucauacagauaugguaaugggguuuggaucggcaggaccaaaaguaacuccagccggaagggauucgagaugauuugggauccaaauggcuggacgaacacugacgggaauuuuucugugaaacaggauguaguggcaaugacagacuggucaggauacagugguagcuucguccagcaccccgaacugaccggccuggauuguauccguccuugcuuuuggguggagcucauucgcgggagaccaagggaagagacuacaaucuggaccuccggaucuucgaucagcuucuguggcguuaacuccgacacggugaauuggucauggcccgauggugccgaauuaccguucaccauagacaaguga

SEQ ID NO: 145209 - RNA, 1410 nt, Artificial Sequence
  derived and/or modified sequence opt3 from neuraminidase__InfluenzaA__AFV53274
augaaccccaaucagaagaucauuaccauaggcagcgugucccugaucauugccacagucugcuuccucaugcaaaucgcuauucuuguuacuacggugacccugcacuuuaaacagcaugagugugacucuccugcaucaaaccagguaaugccaugcgaaccgaucauaaucgagagaaauauuacagaaaucguguacuugaacaauacuaccauugagaaggaaaucugucccaaagucguggaguauaggaacuggaguaagccucagugccaaauaacaggguucgccccauuuagcaaagauaauuccauucgguuaucugcgggaggugacaucuggguuacccgcgagcccuacgugucgugugauccuggcaagugcuaucaguucgcucuggggcagggaacuacacuagacaacaagcacucaaaugauaccauucaugaccgaaucccacaccguacgcuccugaugaacgaacuuggcguccccuuucaucuggguacuagacagguguguguagccuggagcaguuccucuugccacgaugggaaagcaugguugcacguuugugugaccggagacgauaagaaugccacagcuagcuucaucuacgacggcaggcucgucgauuccauuggcucauggagucaaaacauacugcggacucaggagagcgaaugcguguguaucaaugggaccugcacaguggucaugaccgacggaucugcauccggucgcgccgauacgaggauucuguuuaucgaggagggcaaaauaguucauauuucaccucucagcgggagugcucagcacguggaagagugcucuuguuauccaagauacccggacguacggugcaucugucgcgacaacuggaagggauccaaucgacccgugaucgauauuaacauggaagacuauagcaucgauucgucuuacgucugcuccggcuuagugggugacacuccuagaaacgaugacaggucaaguaauagcaacugucggaauccaaacaaugagcgugggaaccccggaguuaaaggcugggccuucgauaauggcgacgauguguggauggggcgcacaauuuccaaggaccugagaucuggauacgaaaccuuuaaggucauagguggcuggagcacuccuaacucaaaaagucagaucaauaggcaagugauuguagauuccaacaauuggagcggguauucuggaaucuucucaguugagggcaagaguugcaucaaccgguguuuuuacguggagcuuauucgaggucgccagcaggaaacaagagucugguggaccagcaauuccauaguggucuucugcgggacgucuggcaccuauggaacaggcucguggccagacggggcgaacaucaauuuuaugcccauuuga

SEQ ID NO: 145210 - RNA, 1410 nt, Artificial Sequence
  derived and/or modified sequence opt3 from neuraminidase__InfluenzaA__AFV53285
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgagguggucgaguauaggaacuggaguaaaccucagugccaaaucaccggguucgcgccauuuagcaaggauaauuccauacgguuaucugcuggaggugacauuugggugacucgcgaacccuacguuucgugugauccuggcaaaugcuaucaguucgcccuggggcagggaacaacccuagacaacaagcacucaaauggcacgauccaugaucguauuccacaccgaacucuccugaugaacgagcuuggugugcccuuucaucuggggaccaagcaggucuguguggcauggagcaguuccucuugccacgacggaaaagccugguugcacguauguguuacaggcgaugacagaaaugcuacugccagcuucaucuacgauggcaggcucguggacuccaucgggucauggagucaaaacauucugcggacccaggaaagcgagugcgucuguauaaauggaacaugcaccguggugaugacggaugguucugcauccggccgcgcugacacuagaauccuguuuauuaaggaggggaaaaucguccauauaucaccucucagcggaagugcccagcacauugaagagugcucuuguuauccaaggcauccggauguucggugcaucugucgcgacaacuggaagggcuccaaucgacccgugaucaacauuaacauggaagacuacagcaucgauucgucuuauguaugcuccgguuuagugggggacacaccuagaaaugaugacucaaguagcaacuccaauuguagggauccaaacaaugagcggggaaaccccggcgucaaaggcugggcguucgacaauggggaugacguguggaugggacguaccauuaacaaggauucucgcagcgguuacgaaacuuuuaagguuauaggcggguggucaacaccuaauaguaaaucccaggugaacagacaagucaucguggacaauaacaauuggagcggauacucuggcauuuucucaguagaggguaagaguugcaucaacagguguuuuuauguugagcugauccgggggcgaccacaggaaacccgcgugugguggacgagcaauuccauugucguguucugcggcaccucuggaacauacggcacugggucguggcccgauggagcaaacauaaacuuuaugccgaucuga

SEQ ID NO: 145211 - RNA, 1410 nt, Artificial Sequence
  derived and/or modified sequence opt3 from neuraminidase__InfluenzaA__AFV53296
augaaccccaaucagaagaucauuauaaucggcagcgugucccugaccauugccacagucugcuuccucaugcaaaucgcuauucuuguuacuacggugacccugcacuuuaaacagcaugagugugacucuccugcaucaaaccagguaaugccaugcgaaccgaucauaaucgagagaaauauuacagaaaucguguacuugaacaauacuaccauugagaaggaaaucugucccgaggucguggaguauaggaacuggaguaaaccucagugccaaauaacaggguucgccccauuuagcaaggauaauuccauucgguuaucugcgggaggugacaucuggguuacccgcgaacccuacgugucgugugauccuucaaaaugcuaucaguucgcucugggccaggggacuacacuagacaacaagcacagcaaugauaccauucaugaccgaaucccacaccguacgcuccugaugaacgagcuuggaguccccuuucaucugggcacuagacagguguguguagccuggaguuccucuagcugccacgaugguaaggcaugguugcacguuugugugaccggggacgauaaaaaugccacagcuuccuucaucuacgacggaaggcucgucgauucaauuggcaguuggagccaaaacauacugcggacucaggaaucugagugcguguguaucaaugggaccugcacaguggucaugaccgacggcuccgcaucaggacgcgccgauacgaggauucuguuuaucgaggaagguaagauaguucauauuagcccucucaguggcucugcucagcacguggaggaaugcuccuguuauccaagauacccggacguacggugcaucugucgcgacaacuggaaagggagcaaucgacccgugaucgauauuaacauggaggacuauucgaucgauucuuccuacgucugcucaggauuagugggcgacacuccuagaaacgaugacaggaguagcaauuccaacugucgggauccaaauaacgaacgugguaaucccgggguuaagggaugggccuucgacaacggcgaugacguguggaugggccgcacaauuucuaaagaucugagaagcggguacgagaccuuuaaggucauaggagguuggucaacuccuaauaguaagucccagaucaacaggcaagugauuguagacagcaauaacuggucuggcuauucagggaucuucaguguugagggaaaaagcugcaucaaucgguguuuuuacguggaacuuauucgaggccgccagcaggagacaagagucugguggaccuccaacucuauaguggucuucugcgguacgucggggaccuauggcacaggaagcuggccagacggcgcgaauaucaacuuuaugcccauuuga

SEQ ID NO: 145212 - RNA, 1410 nt, Artificial Sequence
  derived and/or modified sequence opt3 from neuraminidase__InfluenzaA__AFV53307
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgagguggucgaguauaggaacuggaguaaaccucagugccaaaucaccggguucgcgccauuuagcaaggauaauuccauacgguuaucugcuggaggugacauuugggugacucgcgaacccuacguuucgugugauccuggcaaaugcuaucaguucgcccuggggcagggaacaacccuagacaacaagcacucaaauggcacgauccaugaucguauuccacaccgaacucuccugaugaacgagcuuggugugcccuuucaucuggggaccaagcaggucuguguggcauggagcaguuccucuugccacgacggaaaagccugguugcacguauguguuacaggcgaugacagaaaugcuacugccagcuucaucuacgauggcaggcucguggacuccaucgggucauggagucaaaacauucugcggacccaggaaagcgagugcgucuguauaaauggaacaugcaccguggugaugacggaugguucugcauccggccgcgcugacacuagaauccuguuuauuaaggaggggaaaaucguccauauaucaccucucagcggaagugcccagcacguugaagagugcucuuguuauccaagguacccggaugugcggugcauuugucgcgacaacuggaagggcuccaaucgacccguaaucgacaucaacauggaagauuauagcauugacucgucuuacgugugcuccgguuuagucggggauacaccuagaaacgacgauucaaguagcaauuccaacuguagggacccaaauaacgagcggggaaaucccggcgugaaaggcugggcguucgauaacggggacgauguuuggaugggacguaccaucaauaaggacucucgcagcgguuacgaaacuuuuaaggugauuggcggguggucaacaccuaacaguaaaucccaggucaauagacaagugauaguagauaacaauaacuggagcggauauucuggcaucuucucaguugaggguaagaguugcauuaauagguguuuuuacguggagcugauccgggggcgaccacaggaaacccgcgucugguggacgagcaacuccaucguggucuucugcggcaccucuggaacauauggcacugggucguggcccgacggagcaaauauuaacuuuaugccgauauga

SEQ ID NO: 145213 - RNA, 1410 nt, Artificial Sequence
  derived and/or modified sequence opt3 from neuraminidase__InfluenzaA__AFV53317
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgagguggucgaguauaggaacuggaguaaaccucagugccaaaucaccggguucgcgccauuuagcaaggauaauuccauacgguuaucugcuggaggugacauuugggugacucgcgaacccuacguuucgugugauccuggcaaaugcuaucaguucgcccuggggcagggaacaacccuagacaacaagcacucaaauggcacgauccaugaucgaagcccacaccguacucuccugaugaacgagcuuggugugcccuuucaucuggggaccaagcaggucugugcagccuggaguuccucuagcugccacgacggaaaggcuugguugcacguguguguaacaggcgaugacagaaaugcaacugccuccuucauuuacgauggcaggcucguugacucaaucgggaguuggagccaaaacauccugcggacccaggaaucugagugcguguguauuaauggaacaugcaccgucgugaugacggaugguuccgcuucaggccgcgccgacacuagaauacuguuuaucaaagaggggaaaauugugcauaucggaccucucagcggcagugcgcagcacauagaagagugcucuuguuauccaagguacccggauguccggugcauuugucgcgacaacuggaaggguuccaaucgacccguuaucgacaucaacauggaagauuauagcauugacucgucuuacgugugcuccggguuaguaggagauacaccuagaaacgacgauucaaguagcaauuccaacuguagggacccaaauaacgagcggggcaaucccggcgugaaagggugggcauucgauaacggagacgaugucuggaugggucguaccaucucuaaggaccugcgcagcggcuacgaaacuuuuaaggugauugggggauggucaacaccuaauaguaaaucccagguuaacagacaagugauagucgauaauaacaauuggagcggcuauucugguaucuucucaguggaggggaagaguugcauuaacagguguuuuuacguagagcuuauccggggccgaccacaggaaacccgcguuugguggacgagcaauuccaucguggucuucugcggaaccucuggcacauaugggacuggaucguggcccgacggugccaacauuaauuuuaugccgauauga

SEQ ID NO: 145214 - RNA, 1410 nt, Artificial Sequence
  derived and/or modified sequence opt3 from neuraminidase__InfluenzaA__AFV53328
augaaccccaaucagaagaucauuaccauaggcagcgugucccugacaaucgccacugucugcuuccucaugcacauugcuauccuugcaacgaccguuacacugcauuuuaaacaacacgagugugacucuccugccucaaaccaggcgaugccaugcgaaccgauuaucauagagagaaauaucacugaaauuguguacuugaacaauaccacaaucgagaaggaaauuugucccgagguaguggaguauaggaacuggaguaaaccucagugccagaucaccggguucgcuccauuuagcaaggauaauuccauacgguuaucugccggaggugacauuugggucacucgcgaacccuacgugucgugugauccuggcaaaugcuaucaauucgcacuggggcagggaacaacccuagacaacaagcauucaaauggcacgauccacgaucgaaucccacaucguacucuccugaugaacgagcuugguguucccuuucaccuggggaccaaacaggugugugucgccuggagcaguuccucuugccacgacggaaaggcuugguugcauguguguauuacaggcgaugacagaaaugcaacugccagcuucaucuacgauggcaggcucguagacuccauugggucauggagucagaacauacugcggacccaagaaagcgagugcguuuguaucaauggaacaugcaccguggucaugacggaugguucugcuuccggccgcgccgacacuaggauucuguuuaucaaggaggggaaaauagugcacauuucaccucucagcggaagugcgcagcauaucgaagagugcucuuguuauccaagauacccggaugugcggugcaucugucgcgacaacuggaagggcuccaaucgacccgucauugacaucaacauggaagauuauagcauugacucgucuuacguuugcuccgguuuagugggggauacaccuagaaacgacgauucaaguagcaauuccaacuguagggacccaaauaacgagcggggaaaucccggcguaaaaggcugggcauucgauaacggggacgauguguggaugggacguaccauaucuaaggaccugcgcagcgguuacgaaacuuuuaaggucaucggcggguggucaacaccuaauaguaaaucccaggugaacagacagguuauuguggauaauaacaauuggagcggauauucuggcaucuucucagucgaggguaagaguugcaucaacagguguuuuuacguggagcuuauucgggggcgaccacaagaaacccgcguaugguggacgagcaauuccauaguuguguucugcggcaccucuggaacauauggcacugggucguggcccgacggagccaacaucaauuuuaugccgauuuga

SEQ ID NO: 145215 - RNA, 1410 nt, Artificial Sequence
  derived and/or modified sequence opt3 from neuraminidase__InfluenzaA__AFV53339
augaaccccaaucagaagaucauuaccauaggcagcgccucccugacaaucgcuacugugugcuuccucaugcaaauugcaauccuugucacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccaaaguggucgaguauaggaacuggaguaagccucagugcaaaaucaccggguucgcgccauuuagcaaggauaauuccauacgguuaucugcuggaggugacauuugggugacucgcgagcccuacguuucgugugauccuggcaagugcuaucaauucgcccuggggcagggaacaacccuagacaacaaacacucaaaugauacgauccaugaccgaaucccacaccguacucuccugaugaacgaacuuggcgugcccuuucaucuggguaccagacaggucuguauugcauggagcaguuccucuugccacgaugggaaggccugguugcacguguguguaacaggagacgauaaaaaugcuacugccagcuucaucuacgacggcaggcucguugauuccauuggcucauggagucagaacauacugcggacccaagagagcgaaugcguguguaucaaugggacaugcaccgucgugaugacggacggaucugcauccggucgcgcugauacuaggauucuguuuaucgaggagggcaagauagugcauaugucaccucucagcgggagugcccagcacgucgaagagugcucuuguuauccaagauacccggacguucggugcauuugucgcgacaacuggaaaggauccaaucgacccgugguagauaucaacauggaagacuauagcaucgauucgucuuacgugugcuccggcuuagucggugacacaccuagaaacgaugacaggucaaguaauagcaacugucggaauccaaacaaugagaaggggaaccagggagugaagggcugggcguucgauaauggcgacgauguuuggauggggcguaccauuuccaaagaccugcgcucuggauacgaaacuuuuaaggugaucgguggcuggagcacacccaacucaaaaagucagauuaauagacaagucauaguggauuccgacaacaggagcggguauucuggaaucuucucaguagagggcaagaguugcauuaaucgguguuuuuacguugagcuuauccgaggucgcaaacaggaaaccagagugugguggacgagcaacuccaucgucguguucugcgggaccucuggcacauauggaacuggcucguggccugacggggcaaauauuaacuugaugccaauauga

SEQ ID NO: 145216 - RNA, 1410 nt, Artificial Sequence; identical to SEQ ID NO: 138754
  derived and/or modified sequence opt3 from neuraminidase__InfluenzaA__AFX96367

SEQ ID NO: 145217 - RNA, 1410 nt, Artificial Sequence; identical to SEQ ID NO: 138754
  derived and/or modified sequence opt3 from neuraminidase__InfluenzaA__AFX96386

SEQ ID NO: 145218 - RNA, 1410 nt, Artificial Sequence; identical to SEQ ID NO: 139108
  derived and/or modified sequence opt3 from neuraminidase__InfluenzaA__AFX96401

SEQ ID NO: 145219 - RNA, 1410 nt, Artificial Sequence; identical to SEQ ID NO: 139108
  derived and/or modified sequence opt3 from neuraminidase__InfluenzaA__AFX96411

SEQ ID NO: 145220 - RNA, 1410 nt, Artificial Sequence; identical to SEQ ID NO: 139108
  derived and/or modified sequence opt3 from neuraminidase__InfluenzaA__AFX96421

SEQ ID NO: 145221 - RNA, 1410 nt, Artificial Sequence; identical to SEQ ID NO: 139108
  derived and/or modified sequence opt3 from neuraminidase__InfluenzaA__AFX96431

SEQ ID NO: 145222 - RNA, 1410 nt, Artificial Sequence; identical to SEQ ID NO: 139108
  derived and/or modified sequence opt3 from neuraminidase__InfluenzaA__AFX96441

SEQ ID NO: 145223 - RNA, 1410 nt, Artificial Sequence; identical to SEQ ID NO: 139108
  derived and/or modified sequence opt3 from neuraminidase__InfluenzaA__AFX96451

SEQ ID NO: 145224 - RNA, 1410 nt, Artificial Sequence; identical to SEQ ID NO: 139108
  derived and/or modified sequence opt3 from neuraminidase__InfluenzaA__AFX96461

SEQ ID NO: 145225 - RNA, 1410 nt, Artificial Sequence; identical to SEQ ID NO: 138754
  derived and/or modified sequence opt3 from neuraminidase__InfluenzaA__AFX96471

SEQ ID NO: 145226 - RNA, 1410 nt, Artificial Sequence; identical to SEQ ID NO: 138754
  derived and/or modified sequence opt3 from neuraminidase__InfluenzaA__AFX96481

SEQ ID NO: 145227 - RNA, 1410 nt, Artificial Sequence; identical to SEQ ID NO: 138754
  derived and/or modified sequence opt3 from neuraminidase__InfluenzaA__AFX96491

SEQ ID NO: 145228 - RNA, 1410 nt, Artificial Sequence; identical to SEQ ID NO: 138754
  derived and/or modified sequence opt3 from neuraminidase__InfluenzaA__AFX96501

SEQ ID NO: 145229 - RNA, 1410 nt, Artificial Sequence; identical to SEQ ID NO: 138754
  derived and/or modified sequence opt3 from neuraminidase__InfluenzaA__AFX96511

SEQ ID NO: 145230 - RNA, 1410 nt, Artificial Sequence
  derived and/or modified sequence opt3 from neuraminidase__InfluenzaA__AFX96521
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaagacaguccguagugucugucaaacuggccggcaauucgucauugugcccugugagcgggugggcgauauacaguaaggacaacuccauuaggaucggaucuaaaggcgauguuuuugugauucgggagccauucaucagcuguuccccguuagaaugccgcaccuuuuuccugacacagggugcucuacucaaugacaagcauucaaacgggaccaucaaagaucgaagucccuaucguacucugaugagcuguccuauuggagaggucccaucucccuacaacuccagauuugaaucaguggccuggagcgcaagugccugccacgacggcauaaauuggcuuacaaucggcauuucugggccugauaacggagcuguagcaguucugaaguauaaugguaucauaaccgacacgauuaaguccuggaggaacaauaucuugcggacucaagagagcgagugugccugcgugaacggcucguguuucaccgucaugacagaugggccaucugacggacaggcuuccuacaaaaucuuucgcauugaaaagggcaaaaucgugaagucaguggagaugaaugcccccaacuaucauuacgaagagugcaguuguuacccugauagcuccgagauuacuugcgucugcagagacaauuggcacgguucuaacaggccauggguuagcuucaaucagaaccucgaauaucagauaggguacaucuguucaggaauuuuuggcgauaauccgcggcccaacgacaaaaccggcaguugcgggccuguguccagcaauggagcgaacgguguaaagggcuucucuuuuaaguaugggaacggaguguggaucggccgcacaaaaucaaucaguagccgaaaugguuucgagaugauuugggauccaaacggguggaccggcacggacaauaacuuuuccauaaagcaagacaucgucggaauuaaugaauggucuggcuacucggggagcuucgugcagcaucccgagcugacuggacuggauuguaucagaccuugcuucuggguugaacucauuaggggucggccaaaagagaacacaaucuggaccuccggcucaaguauaucuuuuuguggggugaauagcgacacugucggaugguccuggcccgauggcgcagaguuaccguucacaaucgacaaguga

SEQ ID NO: 145231 - RNA, 1410 nt, Artificial Sequence; identical to SEQ ID NO: 138754
  derived and/or modified sequence opt3 from neuraminidase__InfluenzaA__AFX96531

SEQ ID NO: 145232 - RNA, 1410 nt, Artificial Sequence; identical to SEQ ID NO: 138754
  derived and/or modified sequence opt3 from neuraminidase__InfluenzaA__AFX96541

SEQ ID NO: 145233 - RNA, 1410 nt, Artificial Sequence; identical to SEQ ID NO: 138754
  derived and/or modified sequence opt3 from neuraminidase__InfluenzaA__AFX96551

SEQ ID NO: 145234 - RNA, 1410 nt, Artificial Sequence; identical to SEQ ID NO: 143278
  derived and/or modified sequence opt3 from neuraminidase__InfluenzaA__AFX96561

SEQ ID NO: 145235 - RNA, 1410 nt, Artificial Sequence; identical to SEQ ID NO: 138754
  derived and/or modified sequence opt3 from neuraminidase__InfluenzaA__AFX96571

SEQ ID NO: 145236 - RNA, 1410 nt, Artificial Sequence; identical to SEQ ID NO: 138754
  derived and/or modified sequence opt3 from neuraminidase__InfluenzaA__AFX96581

SEQ ID NO: 145237 - RNA, 1410 nt, Artificial Sequence; identical to SEQ ID NO: 138754
  derived and/or modified sequence opt3 from neuraminidase__InfluenzaA__AFX96591

SEQ ID NO: 145238 - RNA, 1410 nt, Artificial Sequence; identical to SEQ ID NO: 138754
  derived and/or modified sequence opt3 from neuraminidase__InfluenzaA__AFX96601

SEQ ID NO: 145239 - RNA, 1410 nt, Artificial Sequence; identical to SEQ ID NO: 138754
  derived and/or modified sequence opt3 from neuraminidase__InfluenzaA__AFX96611

SEQ ID NO: 145240 - RNA, 1410 nt, Artificial Sequence; identical to SEQ ID NO: 138754
  derived and/or modified sequence opt3 from neuraminidase__InfluenzaA__AFX96621

SEQ ID NO: 145241 - RNA, 1410 nt, Artificial Sequence; identical to SEQ ID NO: 138754
  derived and/or modified sequence opt3 from neuraminidase__InfluenzaA__AFX96631

SEQ ID NO: 145242 - RNA, 1410 nt, Artificial Sequence
  derived and/or modified sequence opt3 from neuraminidase__InfluenzaA__AFX96641
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacuccaaguuugaaucaguggccuggagcgcaagugccugccacgacggcauaaauuggcuuacaaucgggauuucuggaccugauaacggugcuguagcaguucugaaguauaauggcaucauaaccgacacgauuaaauccuggcguaacaauaucuugagaacucaagagagcgagugugccugcgugaacgggucguguuucaccgucaugacagauggaccaucugacggccaggcuuccuacaagaucuuuaggauugaaaaagguaagaucgugaaaucaguggagaugaaugcccccaacuaucauuacgaagagugcaguuguuacccugauagcuccgagauuacuugcgucugccgggacaauuggcacgggucuaaccgcccauggguuagcuucaaucagaaccucgaauaucagauaggauacaucuguucaggcauuuuuggcgauaauccgagacccaacgacaagaccgggaguugcggaccuguguccagcaauggugcgaacggcguaaagggguucucuuuuaaauauggaaacggcguguggaucgguaggacaaagucaaucaguagccggaauggguucgagaugauuugggauccaaacggcuggaccggaacggacaauaacuuuuccauaaaacaagacaucgucggcauuaaugaauggucuggguacucggggagcuucgugcagcaucccgagcugacuggucuggauuguauccgcccuugcuucuggguugaacucauucgaggcagaccaaaggagaacacaaucuggaccuccgggucaaguauaucuuuuuguggagugaauagcgacacugucggcugguccuggcccgauggugcagaguuaccguucacaaucgacaaauga

SEQ ID NO: 145243 - RNA, 1410 nt, Artificial Sequence; identical to SEQ ID NO: 138754
  derived and/or modified sequence opt3 from neuraminidase__InfluenzaA__AFX96651

SEQ ID NO: 145244 - RNA, 1410 nt, Artificial Sequence; identical to SEQ ID NO: 138754
  derived and/or modified sequence opt3 from neuraminidase__InfluenzaA__AFX96661

SEQ ID NO: 145245 - RNA, 1410 nt, Artificial Sequence; identical to SEQ ID NO: 138754
  derived and/or modified sequence opt3 from neuraminidase__InfluenzaA__AFX96671

SEQ ID NO: 145246 - RNA, 1410 nt, Artificial Sequence; identical to SEQ ID NO: 138754
  derived and/or modified sequence opt3 from neuraminidase__InfluenzaA__AFX96681

SEQ ID NO: 145247 - RNA, 1410 nt, Artificial Sequence; identical to SEQ ID NO: 138754
  derived and/or modified sequence opt3 from neuraminidase__InfluenzaA__AFX96691

SEQ ID NO: 145248 - RNA, 1410 nt, Artificial Sequence
  derived and/or modified sequence opt3 from neuraminidase__InfluenzaA__AFX96701
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaaguauuaucacguacgaaaauaacaccugggucaaucagacauauguuaacauaagcaauacuaacuucgcugcaggccaguccgugguaucugugaaacuggccggaaauucgucauugugcccugucagcgggugggcgauuuacaguaaggacaacuccaucagaauuggcucuaaaggugauguguuuguuaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggugccaucucccuacaacucccguuuugaaucagucgccuggagcgcaagugccugccacgacggcaucaauuggcuuacaauugggaucucuggaccugauaacggugcuguggcaguacugaaguauaauggcauaauuaccgacacgaucaaguccuggagaaacaauaucuugaggacucaagagagcgagugugccugcguuaacgggucguguuucaccgugaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccuucaauggugcgaacggcgugaagggguuuagcuucaaguauggaaacggcguauggaucggucggacaaaaucuauuucaagucgcaauggguuugagaugauaugggauccaaacggcuggaccggaacggacaauaacuucagcaucaagcaagacauugugggcaucaaugaaugguccggguacucuggaucguucguccagcaucccgagcugacuggucuggauuguauucgaccuugcuuuuggguggaacucaucagaggcaggccaaaagagaacacaauauggaccagcggguccaucauuucauucuguggaguuaauagugacacugugggcuggucuuggcccgauggugcagaguuaccguuuacaaucgacaaguga

SEQ ID NO: 145249 - RNA, 1410 nt, Artificial Sequence; identical to SEQ ID NO: 138754
  derived and/or modified sequence opt3 from neuraminidase__InfluenzaA__AFX96711

SEQ ID NO: 145250 - RNA, 1410 nt, Artificial Sequence
  derived and/or modified sequence opt3 from neuraminidase__InfluenzaA__AFX96721
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaguguggaccuccgggucaaguaucucuuuuuguggagucaauagcgacacugugggcugguccuggcccgauggugcagaguuaccguucacaauagacaaguga

SEQ ID NO: 145251 - RNA, 1410 nt, Artificial Sequence; identical to SEQ ID NO: 145250
  derived and/or modified sequence opt3 from neuraminidase__InfluenzaA__AFX96731

SEQ ID NO: 145252 - RNA, 1410 nt, Artificial Sequence; identical to SEQ ID NO: 138754
  derived and/or modified sequence opt3 from neuraminidase__InfluenzaA__AFX96741

SEQ ID NO: 145253 - RNA, 1410 nt, Artificial Sequence; identical to SEQ ID NO: 138754
  derived and/or modified sequence opt3 from neuraminidase__InfluenzaA__AFX96751

SEQ ID NO: 145254 - RNA, 1410 nt, Artificial Sequence; identical to SEQ ID NO: 139772
  derived and/or modified sequence opt3 from neuraminidase__InfluenzaA__AFX96761

SEQ ID NO: 145255 - RNA, 1410 nt, Artificial Sequence; identical to SEQ ID NO: 138754
  derived and/or modified sequence opt3 from neuraminidase__InfluenzaA__AFX96771

SEQ ID NO: 145256 - RNA, 1410 nt, Artificial Sequence
  derived and/or modified sequence opt3 from neuraminidase__InfluenzaA__AFX96791
augaaccccaaucagaagaucauuaccauaggcagcgugugcaugacaaucgggauggccaaccugauucuccaagucggaaauaucauuuccaucuggauaucucacucaauccagcuugguaaccagaaucagauugagacuuguaaccaaaguguuaucacguacgaaaauaacaccugggugaaucagacauauguaaacauuagcaauacuaacuucgcugcaggccaguccguggucucugugaaacuggccggaaauucgucauugugcccuguuagcggaugggcgaucuacaguaaggacaacuccauaagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcaucaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucacaaucgacaaguga

SEQ ID NO: 145257 - RNA, 1410 nt, Artificial Sequence; identical to SEQ ID NO: 145256
  derived and/or modified sequence opt3 from neuraminidase__InfluenzaA__AFX96801

SEQ ID NO: 145258 - RNA, 1410 nt, Artificial Sequence
  derived and/or modified sequence opt3 from neuraminidase__InfluenzaA__AFX96811
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucagacuggccggaaauucgucauugugcccugugagcggaugggcgauauacaguaaagacaacuccauuaggaucggcucuaagggugauguuuuugugauucgggagccauucaucagcuguuccccguuagaaugccgcaccuuuuuccugacacagggggcucuacucaaugacaaacauucaaacggaaccaucaaggaucgaagucccuaucguacucugaugagcuguccuauuggcgaggucccaucucccuacaacuccagauuugaaucaguggccuggagcgcaagugccugccacgacggcauaaauuggcuuacaaucgggauuucuggaccugauaacggugcuguagcaguucugaaauauaauggcaucauaaccgacacgauuaaguccuggaggaacaauaucuugcggacucaagagagcgagugugccugcgugaacgggucguguuucaccgucaugacagauggaccaucugacggccaggcuuccuacaagaucuuucgcauugaaaaagguaagaucgugaaaucaguggagaugaaugcccccaacuaucauuacgaagagugcaguuguuacccugauagcuccgagauuacuugcgucugcagagacaauuggcacgggucuaacaggccauggguuagcuucaaucagaaccucgaauaucagauaggauacaucuguucaggcauuuuuggcgauaauccgcggcccaacgacaagaccgggaguugcggaccuguguccagcaauggugcgaacggcguaaaaggguucucuuuuaaguauggaaacggcguguggaucggucgcacaaagucaaucaguagccgaaauggguucgagaugauuugggauccaaacggcuggaccggaacggacaauaacuuuuccauaaaacaagacaucgucggcauuaaugaauggucuggguacucggggagcuucgugcagcaucccgagcugacuggucuggauuguaucagaccuugcuucuggguugaacucauuaggggccggccaaaggagaacacaaucuggaccuccgggucaaguauaucuuuuuguggagugaauagcgacacugucggcugguccuggcccgauggugcagaguuaccguucacaaucgacaaauga

SEQ ID NO: 145259 - RNA, 1410 nt, Artificial Sequence; identical to SEQ ID NO: 138754
  derived and/or modified sequence opt3 from neuraminidase__InfluenzaA__AFX96821

SEQ ID NO: 145260 - RNA, 1410 nt, Artificial Sequence; identical to SEQ ID NO: 145256
  derived and/or modified sequence opt3 from neuraminidase__InfluenzaA__AFX96831

SEQ ID NO: 145261 - RNA, 1410 nt, Artificial Sequence
  derived and/or modified sequence opt3 from neuraminidase__InfluenzaA__AFX96841
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucagacuggccggaaauucgucauugugcccugugagcggaugggcgauauacaguaaagacaacuccauuaggaucggcucuaagggugauguuuuugugauucgggagccauucaucagcuguuccccguuagaaugccgcaccuuuuuccugacacagggggcucuacucaaugacaaacauucaaacggaaccaucaaggaucgaagucccuaucguacucugaugagcuguccuauuggcgaggucccaucucccuacaacuccagauuugaaucaguggccuggagcgcaagugccugccacgacggcauaaauuggcuuacaaucgggauuucuggaccugauaacggugcuguagcaguucugaaauauaauggcaucauaaccgacacgauuaaguccuggaggaacaauaucuugcggacucaagagagcgagugugccugcgugaacgggucguguuucaccgucaugacagauggaccaucugacggccaggcuuccuacaagaucuuucgcauugaaaaagguaagaucgugaaaucaguggagaugaaugcccccaacuauuacuacgaagagugcaguuguuauccugauagcuccgagauuacuugcgucugcagagacaauuggcaugggucuaacaggccauggguuagcuucaaucagaaccucgaauaccagauaggauauaucuguucaggcauuuuuggcgauaauccgcggcccaacgacaagaccgggaguugcggaccuguguccagcaauggugcgaacggcguaaaaggguucucuuuuaaguacggaaacggcguguggaucggucgcacaaagucaaucaguagccgaaauggguucgagaugauuugggauccaaacggcuggaccggaacggacaauaacuuuuccauaaaacaagacaucgucggcauuaaugaauggucuggguauucggggagcuucgugcagcaccccgagcugacuggucuggauuguaucagaccuugcuucuggguugaacucauuaggggccggccaaaggagaacacaaucuggaccuccgggucaaguauaucuuuuuguggagugaauagcgacacugucggcugguccuggcccgauggugcagaguuaccguucacaaucgacaaauga

SEQ ID NO: 145262 - RNA, 1410 nt, Artificial Sequence; identical to SEQ ID NO: 138754
  derived and/or modified sequence opt3 from neuraminidase__InfluenzaA__AFX96859

SEQ ID NO: 145263 - RNA, 1410 nt, Artificial Sequence; identical to SEQ ID NO: 138754
  derived and/or modified sequence opt3 from neuraminidase__InfluenzaA__AFX96907

SEQ ID NO: 145264 - RNA, 1410 nt, Artificial Sequence; identical to SEQ ID NO: 138754
  derived and/or modified sequence opt3 from neuraminidase__InfluenzaA__AFX96917

SEQ ID NO: 145265 - RNA, 1410 nt, Artificial Sequence; identical to SEQ ID NO: 138754
  derived and/or modified sequence opt3 from neuraminidase__InfluenzaA__AFX96927

SEQ ID NO: 145266 - RNA, 1410 nt, Artificial Sequence
  derived and/or modified sequence opt3 from neuraminidase__InfluenzaA__AFX96937
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcuccacuaauuucgcugcaggccagucuguagugucggucaaacuggccgggaacagcagcuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccgucaugacagauggaccauccgacggccaggcuucauacaaaaucuuucggauugaaaaggguaaaaucgugaagaguguggagaugaacgcccccaauuaucauuacgaagagugcagcuguuacccugauuccucugagauuacuugcgucugccgcgacaacuggcacgggagcaauagaccauggguuucauucaaccagaaucucgaauaucagauaggauacaucuguaguggcauuuuuggcgauaacccgaggcccaaugacaaaaccggguccugcggaccugugagcucuaacggugcgaauggcguaaagggguucucauuuaaguauggaaacggcguguggaucggucggacaaaaaguaucagcucccgcaacggguucgagaugauuugggauccaaauggcuggaccggaacggacaacaauuuuucuauaaagcaagacaucgucggcauuaacgaauggucgggguacagcggauccuucgugcagcaucccgagcugacuggucuggauuguauccgaccuugcuucuggguugaacucauuagaggcaggccaaaagagaauacaaucuggaccucagggaguucuauaucauuuuguggagugaacuccgacacugucggcuggucauggcccgauggugcagaguuaccguucacaaucgacaaguga

SEQ ID NO: 145267 - RNA, 1410 nt, Artificial Sequence; identical to SEQ ID NO: 138744
  derived and/or modified sequence opt3 from neuraminidase__InfluenzaA__AFY23991

SEQ ID NO: 145268 - RNA, 1410 nt, Artificial Sequence; identical to SEQ ID NO: 138754
  derived and/or modified sequence opt3 from neuraminidase__InfluenzaA__AFY24001

SEQ ID NO: 145269 - RNA, 1410 nt, Artificial Sequence; identical to SEQ ID NO: 138754
  derived and/or modified sequence opt3 from neuraminidase__InfluenzaA__AFY24022

SEQ ID NO: 145270 - RNA, 1410 nt, Artificial Sequence; identical to SEQ ID NO: 138754
  derived and/or modified sequence opt3 from neuraminidase__InfluenzaA__AFY24043

SEQ ID NO: 145271 - RNA, 1410 nt, Artificial Sequence
  derived and/or modified sequence opt3 from neuraminidase__InfluenzaA__AFY24153
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucacggacuacagcaucgugucgucuuaugucuguuccggacuggugggcgacacaccccggaaaaaugauucaaguagcuccucucauugccuugacccuaacaaugaggaaggugggcacggaguuaagggcugggcuuucgaugacggcaacgauguguggauggggcgcaccauuagcgagaaauugcgaucaggauacgagacuuuuaaggucaucgaagguuggaguaauccaaacuccaaacugcagauuaauagacaggugauaguagacaggggcaaccggagcggguauucuggaaucuucucaguugagggcaagaguuguauuaaucguugcuuuuacguggaacuaauccgcgguagaaaagaggaaaccgagguccucuggacaagcaacuccaucguggucuucugugggacuucuggcaccuauggaacaggcucguggcccgauggggccgacauuaaucugaugccuauauga

SEQ ID NO: 145272 - RNA, 1410 nt, Artificial Sequence
  derived and/or modified sequence opt3 from neuraminidase__InfluenzaA__AFY24208
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacaaucgaacaccauaucguacucugcuuaugaacgaacugggaguucccuuucauuugggcaccaaacaggugugcauugcuuggagcaguuccucuugucacgaugguaaggccuggcuccaugucugcgugacaggggacgaugagaaugcaaccgccagcuucaucuacaacggaagacugguagacuccaucguuucauggaguaagaaaauucugaggacgcaggaaagcgagugugugugcauaaacggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaauuggaagggguccaacaggccgauaguagacauuaauaucaaagauuacagcaucgugucgucuuaugucuguuccggacuggugggcgacacgccccggaagaacgacucaaguagcuccucucauugccuugauccuaauaacgaggaaggugggcacggaguuaaaggcugggcuuucgacgauggcaaugacguguggauggggcgcaccauuagcgagcgauugagaucaggauacgagacauuuaaggucaucgaagguuggaguaacccaaauuccaaacugcagauuaacaggcaagugauaguagaucggggcaaucguagcggguauucuggaaucuucucaguugagggcaagaguuguauuaaccgcugcuuuuacguggaacuaaucagagguaggaaacaggagacugaaguccucuggaccagcaauuccaucguggucuucugugggacaucuggcacuuauggaaccggcucguggcccgacggggccgauauuaaccugaugccuauauga

SEQ ID NO: 145273 - RNA, 1410 nt, Artificial Sequence; identical to SEQ ID NO: 137945
  derived and/or modified sequence opt3 from neuraminidase__InfluenzaA__AFY24219

SEQ ID NO: 145274 - RNA, 1410 nt, Artificial Sequence
  derived and/or modified sequence opt3 from neuraminidase__InfluenzaA__AGB12978
augaaccccaaucagagaaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaaggcaguccguagugucugucaagcuggccggcaauucgucauugugcccugugagcgggugggcgauauacaguaaagacaacuccauucggaucggaucuaagggcgauguuuuugugauucgcgagccauucaucagcuguuccccguuagaaugccgaaccuuuuuccugacacagggugcucuacucaaugacaaacauucaaacgggaccaucaaggaucguagucccuauagaacucugaugagcuguccuauuggagaggucccaucucccuacaacuccagguuugaaucaguggccuggagcgcaagugccugccacgacggcauaaauuggcuuacaaucggcauuucugggccugauaacggagcuguagcaguucugaaauauaaugguaucauaaccgacacgauuaaguccuggcggaacaauaucuugcgcacucaagagagcgagugugccugcgugaacggcucguguuucaccaucaugacagaugggccaucugacggacaggcuuccuacaagauuuuuagaaucgaaaaaggcaagauugucaaaucaguggagaugaaugcccccaacuaucauuacgaagagugcaguuguuacccugauagcuccgagauaacuugcgugugcagggacaauuggcacgguucuaaccggccaugggucagcuucaaucagaaccucgaauaucagaucggguacauuuguucaggaaucuuuggcgauaauccgcgccccaacgacaagaccggcaguugcgggccuguuuccagcaauggagcgaacggugugaaaggcuucucuuuuaaguaugggaacggaguauggaucggccgaacaaagucaauuaguagcagaaaagguuucgagaugauaugggauccaaauggguggaccggcacggacaacaauuuuuccaucaagcaagacauugugggaaucaacgaauggucuggcuacucggggagcuucguccagcaucccgagcugacuggacuggauuguauuaggccuugcuucuggguggaacucauccggggucguccaaaagagaauacaauauggaccuccggcucaaguaucucuuuuugugggguuaacagcgacacugugggaugguccuggcccgauggcgcagaguuaccguucacaauugacaaguga

SEQ ID NO: 145275 - RNA, 1410 nt, Artificial Sequence; identical to SEQ ID NO: 142273
  derived and/or modified sequence opt3 from neuraminidase__InfluenzaA__AGB12989

SEQ ID NO: 145276 - RNA, 1410 nt, Artificial Sequence; identical to SEQ ID NO: 142725
  derived and/or modified sequence opt3 from neuraminidase__InfluenzaA__AGB13009

SEQ ID NO: 145277 - RNA, 1410 nt, Artificial Sequence; identical to SEQ ID NO: 142725
  derived and/or modified sequence opt3 from neuraminidase__InfluenzaA__AGB13019

SEQ ID NO: 145278 - RNA, 1410 nt, Artificial Sequence; identical to SEQ ID NO: 142725
  derived and/or modified sequence opt3 from neuraminidase__InfluenzaA__AGB13029

SEQ ID NO: 145279 - RNA, 1410 nt, Artificial Sequence; identical to SEQ ID NO: 142974
  derived and/or modified sequence opt3 from neuraminidase__InfluenzaA__AGB13039

SEQ ID NO: 145280 - RNA, 1410 nt, Artificial Sequence; identical to SEQ ID NO: 142725
  derived and/or modified sequence opt3 from neuraminidase__InfluenzaA__AGB13051

SEQ ID NO: 145281 - RNA, 1410 nt, Artificial Sequence
  derived and/or modified sequence opt3 from neuraminidase__InfluenzaA__AGB13069
augaaccccaaucagaagaucauuaccauaggcagcaucugcaugacaauugggauggccaaccugauccuccaaauuggaaauaucauauccaucuggauuucucacucaauccagcuugguaaccagaaucagauugagacuuguaaccaaagugugaucacguacgaaaauaacaccugggucaaucagacauauguuaacauaagcaauacuaacuucgcugcaggccaguccgugguaucugugaaacuggccggaaauucgucauugugcccugucagcggaugggcgauuuacaguaaggacaacuccaucagaauuggcucuaaaggugauguguuuguuaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggugccaucucccuacaacucccguuuugaaucagucgccuggagcgcaagugccugccacgacggcaucaauuggcuuacaauugggaucucuggaccugauaacggugcuguggcaguacugaaguauaauggcauaauuaccgacacgaucaaguccuggagaaacaauaucuugaggacucaagagagcgagugugccugcguuaacgggucguguuucaccgugaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccauggaucagcuucaaucagaaccucgaauaucagauuggauacaucuguucaggcaucuuuggcgauaauccgaggcccaacgacaaaaccgggaguugcggaccugucuccagcaauggugcgaacggcguuaagggguucucuuuuaaguauggaaacggcguguggauuggucggacaaaaucaauaaguagccgcaauggguucgagaugaucugggauccaaacggcuggaccggaacggacaauaacuuuuccauuaagcaagacaucguaggcauuaaugaauggucuggguacucggggagcuucgugcagcaucccgagcugacuggucuggauuguauccgaccuugcuucugggucgaacucauaagaggcaggccaaaagagaacacaaucuggaccuccgggucaaguauuucuuuuuguggagugaauagcgacacuguuggcugguccuggcccgauggugcagaguuaccguucacaaucgacaaguga

SEQ ID NO: 145282 - RNA, 1410 nt, Artificial Sequence
  derived and/or modified sequence opt3 from neuraminidase__InfluenzaA__AGB13074
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagccucugugaaacuggcgggaaauucgucauugugcccugucagcggaugggcuauauacaguaaggacaacuccgugagaauuggcucuaaaggugauguuuuugugaucagggagccauucauuagcuguuccccguuagaaugccggaccuuuuuccugacacagggggcccuacucaaugacaagcauucaaacggaaccaucaaagaucgcagucccuaucgaacucugaugagcuguccuaucggcgaggucccaucucccuacaacucccguuuugaaucaguggcauggagcgccagugcuugccacgacggcauuaauuggcuuacaauagggaucucuggaccugauaacggugcaguagccguucugaaguauaauggcauuaucaccgacacgauaaaguccuggagaaacaauauuuugaggacucaagagagcgagugugcuugcgugaacgggucguguuucaccgucaugacagauggaccaucugacggccaggccuccuacaaaaucuuucggaucgaaaaggguaaaauugugaagucaguggagaugaaugcgcccaacuaucauuacgaagagugcaguuguuacccugauagcuccgagaucacuugcgucugccgcgacaauuggcacgggucuaacagaccauggguuagcuucaaucagaaccucgaauaucagauuggauacauauguucaggcaucuuuggcgauaauccgaggcccaacgacaaaaccgggaguugcggaccuguguccagcaauggugcaaacggcguaaagggguucucuuuuaaguauggaaacggcguguggauuggucggacaaaaucaaucaguagccgcaauggguucgagaugaucugggauccaaacggcuggaccggaacggacaauaacuuuuccauuaagcaagacauagucggcaucaaugaauggucuggguacucggggagcuucgugcagcaucccgagcugacuggucuggauuguauucgaccuugcuucuggguugaacucaucagaggcaggccaaaagagaacacaauuuggaccuccgggucaaguaucucuuuuuguggagugaauagcgacacugucggcugguccuggcccgauggugccgaguuaccguucacaauagacaaguga

SEQ ID NO: 145283 - RNA, 1410 nt, Artificial Sequence
  derived and/or modified sequence opt3 from neuraminidase__InfluenzaA__AGB13115
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuuguguuaagggagccauucauuagcuguuccccgcuggaaugccggaccuuuuuccuaacacagggggcucuccugaaugacaagcauucaaacggaaccaucaaagaucgcagucccuaucgaacucuuaugagcuguccuaucggcgaggucccaucucccuacaacucccguuuugaaucaguggccuggagcgcaagugccugccacgacggcauuaauuggcugacaauagggaucucuggaccugauaacggugcuguagcaguuuugaaguauaauggcauuaucaccgacacgauaaaguccuggagaaacaauauucucaggacucaagagagcgagugugccugcgugaacgggucguguuucaccaucaugacagauggaccaucugacggccaggcuuccuacaaaaucuuucggauugaaaaggguaaaaucgucaagucaguggagaugaaugcccccaacuaucauuacgaagagugcaguuguuacccugauagcuccgagauuacuugcgugugccgcgacaauuggagagggucuaacaggccaugggucagcuucaaucagaaccuggaauaucagauaggauacaucuguucaggcauuuuuggcgauaauccgcggcccaacgacaaaaccgggaguugcggaccuguuuccagcaauggugcgaacggcgugaagggguucucuuuuaaguauggaaacggcguauggaucggucgcacaaaaucaaucaguagccgaaagggguucgagaugauuugggauccaaauggcuggaccggaacggacaacaauuuuuccauaaaacaagacaucgugggcauuaacgaauggucuggguacucggggagcuucguccagcaccccgagcugacuggucucgauuguaucagaccuugcuucuggguggaauuaauuaggggccggccaaaggagaauacaaucuggaccuccgggucaaguauaucuuuuuguggaguuaacagcgacacugugggcugguccuggcccgauggugcagagcugccguucacaaucgacaaauga

SEQ ID NO: 145284 - RNA, 1410 nt, Artificial Sequence; identical to SEQ ID NO: 142725
  derived and/or modified sequence opt3 from neuraminidase__InfluenzaA__AGB13133

SEQ ID NO: 145285 - RNA, 1410 nt, Artificial Sequence; identical to SEQ ID NO: 142273
  derived and/or modified sequence opt3 from neuraminidase__InfluenzaA__AGB13152

SEQ ID NO: 145286 - RNA, 1410 nt, Artificial Sequence; identical to SEQ ID NO: 142273
  derived and/or modified sequence opt3 from neuraminidase__InfluenzaA__AGB13162

SEQ ID NO: 145287 - RNA, 1410 nt, Artificial Sequence; identical to SEQ ID NO: 143096
  derived and/or modified sequence opt3 from neuraminidase__InfluenzaA__AGB13173

SEQ ID NO: 145288 - RNA, 1410 nt, Artificial Sequence
  derived and/or modified sequence opt3 from neuraminidase__InfluenzaA__AGB13183
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggacaagauaacggugcuguagcaguucugaaguauaauggcaucauaaccgacacgauuaaguccuggagaaacaauaucuugaggacucaggagagcgagugugccugcgugaacgggucguguuucaccaucaugacagauggaccuucugacggccaggcuuccuacaaaauuuuucggaucgaaaaggguaaaauugucaagucaguggagaugaaugccccaaacuaucauuacgaagagugcaguuguuaccccgauagcuccgagauaacuugcgugugccgcgacaauuggcacgggucuaacagaccuugggucagcuucaaucagaaccucgaauaucaaaucggauacauuuguucaggcaucuuuggcgauaauccaaggccgaacgacaaaaccgggaguugcggacccguuuccagcaauggugcgaacggcgugaagggguucucuuuuaaguauggaaacggcguauggaucggucggacaaaaucaauuaguagccgcaagggguucgagaugauaugggauccuaauggcuggaccggaacggacaacaauuuuuccaucaaacaggacauugugggcaucaacgaauggucuggguacucggggagcuucguccagcauccagagcugacuggucuggauuguauucgacccugcuucuggguggaacucaucagaggcaggccuaaggagaauacaauauggaccuccgggucaaguaucucuuuuuguggaguuaacagcgacacugugggcugguccuggccagauggugcagaguuacccuucacaauugacaaauga

SEQ ID NO: 145289 - RNA, 1410 nt, Artificial Sequence; identical to SEQ ID NO: 142725
  derived and/or modified sequence opt3 from neuraminidase__InfluenzaA__AGB13193

SEQ ID NO: 145290 - RNA, 1410 nt, Artificial Sequence; identical to SEQ ID NO: 142792
  derived and/or modified sequence opt3 from neuraminidase__InfluenzaA__AGB13203

SEQ ID NO: 145291 - RNA, 1410 nt, Artificial Sequence; identical to SEQ ID NO: 142725
  derived and/or modified sequence opt3 from neuraminidase__InfluenzaA__AGB13213

SEQ ID NO: 145292 - RNA, 1410 nt, Artificial Sequence; identical to SEQ ID NO: 142725
  derived and/or modified sequence opt3 from neuraminidase__InfluenzaA__AGB13223

SEQ ID NO: 145293 - RNA, 1410 nt, Artificial Sequence; identical to SEQ ID NO: 142725
  derived and/or modified sequence opt3 from neuraminidase__InfluenzaA__AGB13233

SEQ ID NO: 145294 - RNA, 1410 nt, Artificial Sequence
  derived and/or modified sequence opt3 from neuraminidase__InfluenzaA__AGB13243
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucugacggccaggcuuccuacaaaauuuuucggaucgaacgcgguaagauugucaaaucaguggagaugaaugcccccaacuauuacuacgaagagugcaguuguuauccugauagcuccgagauaacuugcgugugcagagacaauuggcaugggucuaacaggccaugggucagcuucaaucagaaccucgaauaccagaucggauauauuuguucaggcguuuuuggcgauaauccgcggcccaacgacaagaccgggaguugcggaccuguguccagcaauggugcgaacggcguaaaaggguucucuuuuaaguacggaaacggcguguggaucggucgcacaaagucaaucaguagccgaaaaggguucgagaugauuugggauccaaauggcuggaccggaacggacaacaauuuuuccauaaagcaagacaucgucggcauuaacgaauggucuggguauucggggagcuucgugcagcaccccgagcugacuggucuggauuguaucagaccuugcuucuggguugaacucauuaggggccggccaaaagagaauacaaucuggaccuccgggucaaguauaucuuuuuguggagugaacagcgacacugucggcugguccuggcccgauggugcagaguuaccguucacaaucgacaaguga

SEQ ID NO: 145295 - RNA, 1410 nt, Artificial Sequence; identical to SEQ ID NO: 142792
  derived and/or modified sequence opt3 from neuraminidase__InfluenzaA__AGB13253

SEQ ID NO: 145296 - RNA, 1410 nt, Artificial Sequence
  derived and/or modified sequence opt3 from neuraminidase__InfluenzaA__AGB13263
augaaccccaaucagaagaucauuaccauaggcagcgugugcaugacaaucgggauggccaaccugauucuccaaaucggaaauauuaucuccauauggaucucucacucaauucagcuugguaaccagaaucagacugagacguguaaccaaagugucaucaccuacgaaaauaacacauggguuaaucagacuuaugugaacauuagcaauaccaacuucgcugcaggccaguccguagugucugucaaacuggccggaaauucgucauugugcccugugagcggaugggcgaucuacaguaaggacaacuccauaagaauuggcucuaaaggugauguuuuugugaucagggagccauucauuagcuguuccccguuagaaugccggacauuuuuccugacccagggggcucuacucaaugacaagcauucaaacggaacuaucaaagaucgcagucccuaucgaacacugaugagcuguccuaucggcgaggucccaucucccuacaacucccguuuugaaucaguggccuggagcgcaagugccugccacgacggcauuaauuggcuuaccauagggaucucuggaccugauaacggugcuguagcaguucugaaguauaauggcauuaucacggacacuauaaaguccuggagaaacaauauuuugaggacccaagagagcgagugugccugcgugaacgggucguguuucacagucaugacugauggaccaucugacggccaggcuuccuacaaaaucuuucggaucgaaaaggguaaaauugugaagucaguggagaugaaagcccccaauuaucauuacgaagagugcaguuguuacccugauagcuccgagauuaccugcgucugccgcgacaacuggcacgggucuaauagaccauggguuagcuucaaccagaaucucgaauauaggaucggauacauauguucaggcaucuuuggcgauaacccgcggcccaaugacaagacagggaguugcggaccuguguccagcaacggugcgaauggcguaaagggguucucuuuuaaauauggaaacggcguguggauuggucgcaccaagucaaucaguagccgaaacggguucgagaugaucugggauccaaauggcuggacgggaacugacaacaauuuuuccauuaaacaggacauaaucggcauuaacgaauggucuggguacucggggagcuucguccaacaucccgagcugacaggucuggauuguaucagaccuugcuucuggguggaacucauuaggggccggccaaaggagaauaccaucuggacuuccgggucaaguauaucuuuuuguggaguuaacagcgacacagugggcugguccuggcccgauggugcagaguuaccguucaccgucgacaaauga

SEQ ID NO: 145297 - RNA, 1410 nt, Artificial Sequence; identical to SEQ ID NO: 142725
  derived and/or modified sequence opt3 from neuraminidase__InfluenzaA__AGB13273

SEQ ID NO: 145298 - RNA, 1410 nt, Artificial Sequence
  derived and/or modified sequence opt3 from neuraminidase__InfluenzaA__AGB13283
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgccgaggguucgagaugauaugggauccaaauggcuggaccggaacggacaacaauuuuuccaucaagcaagacauugugggcaucaacgaauggucuggguacucggggagcuucguccagcaucccgagcugacuggucuggauuguauuagaccuugcuucuggguggaacucaucaggggccggccaaaagagaauacaauauggaccuccgggucaaguaucucuuuuuguggaguuaacagcgacacugugggcugguccuggcccgauggugcagaguuaccguucacaauugacaaguga

SEQ ID NO: 145299 - RNA, 1410 nt, Artificial Sequence; identical to SEQ ID NO: 142725
  derived and/or modified sequence opt3 from neuraminidase__InfluenzaA__AGB13293

SEQ ID NO: 145300 - RNA, 1410 nt, Artificial Sequence; identical to SEQ ID NO: 142725
  derived and/or modified sequence opt3 from neuraminidase__InfluenzaA__AGB13303

SEQ ID NO: 145301 - RNA, 1410 nt, Artificial Sequence
  derived and/or modified sequence opt3 from neuraminidase__InfluenzaA__AGB13313
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugccaaacuggcgggaaauucgucauugugcccugucagcggaugggcuauauacaguaaggacaacuccauuagaaucggcucuaaaggugauguguuuguuauuagggagccauucaucagcuguuccccguuagaaugccggaccuuuuuccugacacagggggcccuacucaaugacaagcauucaaacggaaccaucaaagaucgcagucccuaucgaacucugaugagcuguccuauuggcgaggugccaucucccuacaacucccguuuugaaucagucgcauggagcgccagugcuugccacgacggcauaaauuggcuuacaaucgggauuucuggaccugauaacggugcaguggccguacugaaguauaauggcaucauaaccgacacgauuaaguccuggagaaacaauaucuugaggacucaagagagcgagugugcuugcguuaacgggucguguuucaccgugaugacagauggaccaucugacggccaggccuccuacaaaaucuuucggauugaaaaggguaaaaucgucaagucaguggagaugaaugcgcccaacuaucauuacgaagagugcaguuguuacccugauagcuccgagauuacuugcgugugccgcgacaauuggcacgggucuaacagaccaugggucagcuucaaucagaaccucgaauaucagauaggauacaucuguucaggcauuuuuggcgauaauccgaggcccaacgacaaaaaggggaguugcggaccuguuuccagcaauggugcaaacggcgugaagggguucucuuuuaaauauggaaacggcguauggaucggucggaccaagucaaucaguagccgcaauggguucgagaugauuugggauccaaacggcuggacaggaaccgacaauaacuuuuccauaaaacaagacaucgugggcauuaaugaauggucuggguacucggggagcuucguccagcaucccgagcugacgggucuggauuguauccgaccuugcuucuggguggaacucauuagaggcaggccaaaggagaacacuaucuggacauccgggucaaguauaucuuuuuguggaguuaauagcgacaccgugggcugguccuggcccgauggugccgaguuaccguucacuaucgacaaauga

SEQ ID NO: 145302 - RNA, 1410 nt, Artificial Sequence; identical to SEQ ID NO: 142725
  derived and/or modified sequence opt3 from neuraminidase__InfluenzaA__AGB13323

SEQ ID NO: 145303 - RNA, 1410 nt, Artificial Sequence
  derived and/or modified sequence opt3 from neuraminidase__InfluenzaA__AGB13333
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucugccguaucggugaaacuggcggggaacucauccuugugcccugucaguggaugggcuauauacuccaaggacaauucuauuagaaucggcagcaaaggugauguguuuguuauuagggagccauucaucuccuguucaccguuagaaugccggaccuuuuuccugacacagggggcccuacucaacgacaagcauaguaauggaaccaucaaagaucgcagccccuaucgaacucugaugucuuguccuauuggcgaggugccaucccccuacaacucacguuuugaaagcgucgcauggagugccucugcuugccacgacggcauaaacuggcuuacaaucgggauuuccggaccugauaauggugcaguggccguacugaaguauaacggcaucauaaccgacacgauuaagagcuggagaaauaacaucuugaggacucaagagucggagugugcuugcguuaaugggucuuguuucaccaucaugacagauggaccauccgacggccaggccucauacaaaauuuuucggaucgaaaaggguaaaauugugaagagugucgagaugaacgcgcccaauuaucauuacgaagagugcagcuguuacccugauuccucugagauaacuugcgugugccgcgacaacuggcacgggagcaauagaccaugggugucauucaaccagaaucucgaauaucagaucggauacauuuguaguggcaucuuuggcgauaacccgaggcccaaugacaaaaccggguccugcggaccugucagcucuaacggugcaaauggcguuaagggguucucauuuaaguauggaaacggcguguggaucggucggacaaaaaguauuagcucccgcaagggguucgagaugauaugggauccaaacggcuggaccggaacggacaauaacuuuucuaucaaacaagacauuguaggcaucaaugaauggucgggguacagcggauccuucgugcagcaucccgagcugacuggucuggauuguauucgaccuugcuucugggucgaacucaucagaggcaggccaaaggagaacacaauauggaccucagggaguucuaucagcuuuuguggagugaauagcgacacuguuggcuggucauggcccgauggugccgaguuaccguucacaauugacaaauga

SEQ ID NO: 145304 - RNA, 1410 nt, Artificial Sequence; identical to SEQ ID NO: 142725
  derived and/or modified sequence opt3 from neuraminidase__InfluenzaA__AGB13343

SEQ ID NO: 145305 - RNA, 1410 nt, Artificial Sequence; identical to SEQ ID NO: 142974
  derived and/or modified sequence opt3 from neuraminidase__InfluenzaA__AGB13353

SEQ ID NO: 145306 - RNA, 1410 nt, Artificial Sequence
  derived and/or modified sequence opt3 from neuraminidase__InfluenzaA__AGB13363
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagccucugugaaacuggcgggaaauucgucauugugcagcgucagugggugggcuauauacuccaaggacaacucuauuagaaucggcagcaaaggugauguguuuguuauuagggagccuuucaucuccuguucaccauuagaaugccggaccuuuuuccugacacagggggcccuacucaaugacaagcauaguaacggaaccaucaaagaucgcagcccguaucgaacucugaugucuugucccauuggcgaggugccuuccccauacaacucacguuuugaaagcgucgcauggagugccucugcuugccacgacggcauaaauuggcuuacaaucgggauuuccggacccgauaacggugcaguggccguacugaaguauaauggcaucauaaccgacacgauuaagagcuggagaaacaauaucuugaggacucaagagucggagugugcuugcguuaacgggucuuguuucaccaucaugacagauggaccuuccgacggccaggccucauacaaaauuuuucggaucgaaaaggguaaaauugugaagagugucgagaugaaugcgccaaacuaucauuacgaagagugcagcuguuaccccgauuccucugagauaacuugcgugugccgcgacaauuggcacgggagcaacagaccuugggugucauucaaucagaaccucgaauaucagaucggauacauuuguaguggcaucuuuggcgauaauccaaggccgaacgacaaaaccggguccugcggacccgucagcucuaauggugcaaacggcguuaagggguucucauuuaaguauggaaacggcguguggaucggucggacaaaaaguauuagcucccgcaagggguucgagaugauaugggauccuaauggcuggaccggaacggacaacaauuuuucuaucaaacaagacauuguaggcaucaacgaauggucgggguacagcggauccuucgugcagcauccagagcugacuggucuggauuguauucgacccugcuucugggucgaacucaucagaggcaggccuaaggagaauacaauauggaccucagggaguucuaucagcuuuuguggagugaacuccgacacuguuggcuggucauggccagauggugccgaguuacccuucacaauugacaaauga

SEQ ID NO: 145307 - RNA, 1410 nt, Artificial Sequence
  derived and/or modified sequence opt3 from neuraminidase__InfluenzaA__AGB13383
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaucaggcguauggaucggucggacaaaaaguauuagcucccgcaagggguucgagaugauaugggauccaaacggcuggaccggaacggacaauaacuuuucuaucaaacaagacauugugggcaucaaugaauggucgggguacagcggauccuucguccagcaucccgagcugacuggucuggauuguauucgaccuugcuucuggguggaacucaucagaggcaggccaaaggagaacacaauauggaccucagggaguucuaucagcuuuuguggaguuaauuccgacacugugggcuggucauggcccgauggugcagaguuaccguucacaauugacaaauga

SEQ ID NO: 145308 - RNA, 1410 nt, Artificial Sequence; identical to SEQ ID NO: 142273
  derived and/or modified sequence opt3 from neuraminidase__InfluenzaA__AGB13393

SEQ ID NO: 145309 - RNA, 1410 nt, Artificial Sequence; identical to SEQ ID NO: 142973
  derived and/or modified sequence opt3 from neuraminidase__InfluenzaA__AGB13403

SEQ ID NO: 145310 - RNA, 1410 nt, Artificial Sequence; identical to SEQ ID NO: 142273
  derived and/or modified sequence opt3 from neuraminidase__InfluenzaA__AGB13413

SEQ ID NO: 145311 - RNA, 1410 nt, Artificial Sequence; identical to SEQ ID NO: 142273
  derived and/or modified sequence opt3 from neuraminidase__InfluenzaA__AGB13423

SEQ ID NO: 145312 - RNA, 1410 nt, Artificial Sequence; identical to SEQ ID NO: 142973
  derived and/or modified sequence opt3 from neuraminidase__InfluenzaA__AGB13433

SEQ ID NO: 145313 - RNA, 1410 nt, Artificial Sequence; identical to SEQ ID NO: 142973
  derived and/or modified sequence opt3 from neuraminidase__InfluenzaA__AGB13443

SEQ ID NO: 145314 - RNA, 1410 nt, Artificial Sequence
  derived and/or modified sequence opt3 from neuraminidase__InfluenzaA__AGB13453
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucggucggacaaaaaguuucagcucccgcaagggguuugagaugauuugggauccaaacggcuggaccggaacggacaauaacuucucuauaaaacaagacaucgugggcauuaaugaauggucgggguacagcggauccuucguccagcaucccgagcugacuggucuggauuguauccgaccuugcuuuuggguggaacucauuagaggcaggccaaaggagaacacaaucuggaccucagggaguucuauaucauucuguggaguuaauuccgacacugugggcuggucauggcccgauggugcagaguuaccguuuacaaucgacaaauga

SEQ ID NO: 145315 - RNA, 1410 nt, Artificial Sequence; identical to SEQ ID NO: 142273
  derived and/or modified sequence opt3 from neuraminidase__InfluenzaA__AGB13463

SEQ ID NO: 145316 - RNA, 1410 nt, Artificial Sequence; identical to SEQ ID NO: 142725
  derived and/or modified sequence opt3 from neuraminidase__InfluenzaA__AGB13473

SEQ ID NO: 145317 - RNA, 1410 nt, Artificial Sequence
  derived and/or modified sequence opt3 from neuraminidase__InfluenzaA__AGB13483
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucggucggacaaaaaguauuagcucccgcaagggguucgagaugauaugggauccaaacggcuggaccggaacggacaauaacuuuucuaucaaacaagacauugugggcaucaaugaauggucgggguacagcggauccuucguccagcaucccgagcugacuggucuggauuguauucgaccuugcuucuggguggaacucaucagaggccagccaaaggagaacacaauauggaccucagggaguucuaucagcuuuuguggaguuaauuccgacacugugggcuggucauggcccgauggugcagaguuaccguucacaauugacaaauga

SEQ ID NO: 145318 - RNA, 1410 nt, Artificial Sequence; identical to SEQ ID NO: 143010
  derived and/or modified sequence opt3 from neuraminidase__InfluenzaA__AGB13493

SEQ ID NO: 145319 - RNA, 1410 nt, Artificial Sequence; identical to SEQ ID NO: 142802
  derived and/or modified sequence opt3 from neuraminidase__InfluenzaA__AGB13503

SEQ ID NO: 145320 - RNA, 1410 nt, Artificial Sequence; identical to SEQ ID NO: 140216
  derived and/or modified sequence opt3 from neuraminidase__InfluenzaA__AGB13513

SEQ ID NO: 145321 - RNA, 1410 nt, Artificial Sequence; identical to SEQ ID NO: 143008
  derived and/or modified sequence opt3 from neuraminidase__InfluenzaA__AGB13523

SEQ ID NO: 145322 - RNA, 1410 nt, Artificial Sequence; identical to SEQ ID NO: 143008
  derived and/or modified sequence opt3 from neuraminidase__InfluenzaA__AGB13533

SEQ ID NO: 145323 - RNA, 1410 nt, Artificial Sequence; identical to SEQ ID NO: 142725
  derived and/or modified sequence opt3 from neuraminidase__InfluenzaA__AGB13543

SEQ ID NO: 145324 - RNA, 1410 nt, Artificial Sequence; identical to SEQ ID NO: 142725
  derived and/or modified sequence opt3 from neuraminidase__InfluenzaA__AGB13553

SEQ ID NO: 145325 - RNA, 1410 nt, Artificial Sequence
  derived and/or modified sequence opt3 from neuraminidase__InfluenzaA__AGB13563
augaaccccaaucagaagaucauuaccauaggcagcgugugcaugacaaucggggucgccaaccugauucuccaaaucggaaauauuaucuccauauggaucucucacucaauucagcuugguaaccagaaucagaucgagacuuguaaccaaaguguuauuacguacgaaaauaacaccugggugaaucagacauauguaaacaucagcaauacuaacuucgcugcaggccaguccguggucucugugaaucuggccgggaacucgucauugugcccuguuagcggaugggcgauauacaguaaagacaauuccauuagaaucggcucuaagggugauguguuugucauuagggagccauucaucagcuguuccccguuagaaugccggaccuuuuuccugacacagggggcucuacucaacgacaaacauucaaacggaaccaucaaggaucgcagucccuaucgaacucugaugagcuguccuauuggcgaggugccaucucccuacaauucccguuuugaaucaguagccuggagcgcaagugccugccacgacggcauaaacuggcuuacaaucgggauuucuggaccugauaauggugcuguugcagugcugaaauauaacggcaucauaaccgacacgauuaaguccuggagaaauaacaucuugaggacucaagagagcgagugugccugcgucaaugggucguguuucaccaucaugacagauggaccaucugacggccaggcuuccuacaagauuuuucggaucgaaaaagguaagauugugaaaucaguggagaugaacgcccccaauuaucauuacgaagagugcaguuguuacccugauagcuccgagauaacuugcgucugccgcgacaacuggcacgggucuaauagaccauggguuagcuucaaccagaaucucgaauaucagaucggauacauuuguucaggcaucuuuggcgauaacccgaggcccaaugacaagaccgggaguugcggaccuguguccagcaacggugcgaacggcguaaaaggguucucuuuuaaguauggaaauggcguguggaucggucggacaaagaacauuucaagucgcaaaggguucgagaugauaugggauccaaauggcuggaccggaacggacaacaauuuuagcaucaagcaagacauugucggcaucaacgaaugguccggguacucuggaucguucgugcagcaucccgagcugacuggucuggauuguauucgaccuugcuucuggguugaacucaucagaggcaggccaaaagagaauacaauauggaccagcggguccucaaucaguuuuuguggagugaacucugacacugucggcuggagcuggcccgauggugcagaguuaccguucacaauugacaaguga

SEQ ID NO: 145326 - RNA, 1410 nt, Artificial Sequence; identical to SEQ ID NO: 142725
  derived and/or modified sequence opt3 from neuraminidase__InfluenzaA__AGB13573

SEQ ID NO: 145327 - RNA, 1410 nt, Artificial Sequence
  derived and/or modified sequence opt3 from neuraminidase__InfluenzaA__AGB13583
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagggucugugaaacuggccggaaauucgucauugugcccugucagcggcugggcgauauacaguaaggacaacuccauuagaaucgguucuaaaggggauguguuuguuauuagggagccauucaucagcuguuccccguuagaaugccggaccuuuuuccugacacagggagcucuacucaaugacaagcauucaaacggcaccaucaaagaucgcagucccuaucgaacucugaugagcuguccuauuggcgaggugccaucucccuacaacucccguuuugaaucagucgccuggagcgcaagugccugccacgacgggauaaauuggcuuacaaucggaauuucugguccugauaacggcgcuguggcaguacugaaguauaaugggaucauaaccgacacgauuaaguccuggagaaacaauaucuugaggacucaagagagcgagugugccugcguuaacggaucguguuucaccaucaugacagauggcccaucugacggucaggcuuccuacaaaauuuuucggaucgaaaaggggaaaauugugaagucagucgagaugaaugcccccaacuaucauuacgaagagugcaguuguuacccugauagcuccgagauaacuugcgugugccgcgacaauuggcacggaucuaacagaccaugggugagcuucaaucagaaccucgaauaucagaucggcuacauuuguucaggcaucuuuggggauaauccgaggcccaacgacaaaaccggaaguugcgguccugucuccagcaauggcgcgaacgggguuaagggauucucuuuuaaguauggcaacgguguguggaucgggcggacaaaaucaauuaguagccgcaagggcuucgagaugauaugggauccaaauggauggaccggcacggacaacaauuuuuccaucaaacaagacauuguagggaucaacgaauggucuggauacucggguagcuucgugcagcaucccgagcugacuggccuggauuguauucgaccuugcuucugggucgaacucaucagagggaggccaaaggagaauacaauauggaccuccggaucaaguaucucuuuuuguggcgugaacagcgacacuguugguugguccuggcccgauggggcagaguuaccguucacaauugacaaauga

SEQ ID NO: 145328 - RNA, 1410 nt, Artificial Sequence; identical to SEQ ID NO: 142725
  derived and/or modified sequence opt3 from neuraminidase__InfluenzaA__AGB13593

SEQ ID NO: 145329 - RNA, 1410 nt, Artificial Sequence; identical to SEQ ID NO: 142725
  derived and/or modified sequence opt3 from neuraminidase__InfluenzaA__AGB13603

SEQ ID NO: 145330 - RNA, 1410 nt, Artificial Sequence; identical to SEQ ID NO: 142725
  derived and/or modified sequence opt3 from neuraminidase__InfluenzaA__AGB13613

SEQ ID NO: 145331 - RNA, 1410 nt, Artificial Sequence; identical to SEQ ID NO: 142725
  derived and/or modified sequence opt3 from neuraminidase__InfluenzaA__AGB13623

SEQ ID NO: 145332 - RNA, 1410 nt, Artificial Sequence
  derived and/or modified sequence opt3 from neuraminidase__InfluenzaA__AGB13633
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucggucggacaaaaaguauuagcucccgcaagggguucgagaugauaugggauccaaacggcuggaccggaacggacaauaacuuuucuaucaaacaagacauugugggcaucaaugaauggucgggguacagcggauccuucguccagcaucccgagcugacuggucuggauuguauucgaccuugcuucuggguggaacucaucagaggcaggccaaaggagaacacaauauggaccucagggaguaucauuucuuuuuguggaguuaauagcgacacugugggcugguccuggcccgauggugcagaguuaccguucacaaucgacaaauga

SEQ ID NO: 145333 - RNA, 1410 nt, Artificial Sequence
  derived and/or modified sequence opt3 from neuraminidase__InfluenzaA__AGB13643
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacggcauuagaaucgguuccaaaggggauguuuuugugauuagggagccauucaucucuuguagcccguuagaaugccggaccuuuuuccugacacagggagcucuacucaaugacaagcauuccaacggcaccaucaaagaucgcucacccuaucgaacucugaugaguuguccuauuggcgaggucccaagccccuacaacucucguuuugaauccguggccuggucagcaagcgccugccacgacgggauaaauuggcuuacaaucggaauuagugguccugauaacggcgcuguagcaguucugaaguauaaugggaucauaaccgacacgauuaagucuuggagaaacaauaucuugaggacucaagaguccgagugugugugcgucaacggaagcuguuucaccgugaugacagauggcccaucggacggucaggccucuuacaaaaucuuucggauugaaaaggggaaaaucgugaaguccgucgagaugaaugcucccaacuaucauuacgaagagugcucauguuacccugauaguagcgagauuacuugcguuugccgcgacaauuggcacggauccaacagaccaugggugucuuucaaucagaaccucgaauaucagauaggcuacaucuguagcggcauuuuuggggauaauccgaggcccaacgacaaaaccggaucaugcgguccuguaaguuccaauggcgccaacggggugaagggauucagcuuuaaguauggcaacggugucuggaucgggcggacaaaaucuaucucaagucgcaauggcuucgagaugauuugggauccaaacggauggaccggcacggacaauaacuuuagcgugaagcaagacauaaucgggauuaaugaaugguccggauacucugguucguucguucagcaucccgagcugacuggccuggauuguauccgaccuugcuucuggguggaacucauuagagggaggccaaaagagaacacaaucuggaccagcggauccucaauaaguuuuuguggcgucaauucugacacuguggguuggagcuggcccgauggggcggaguuaccguucacaaucgacaaguga

SEQ ID NO: 145334 - RNA, 1410 nt, Artificial Sequence
  derived and/or modified sequence opt3 from neuraminidase__InfluenzaA__AGB13653
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugugugcgucaacgggucguguuucaccgugaugacagauggaccaucugacggccaggccuccuacaaaaucuuucggauugaaaaggguaaaaucgugaagucagucgagaugaaugcucccaacuaucauuacgaagagugcaguuguuacccugauagcuccgagauuacuugcguuugccgcgacaauuggcacgggucuaacagaccaugggugagcuucaaucagaaccucgaauaucagauaggauacaucuguucaggcauuuuuggcgauaauccgaggcccaacgacaaaaccgggaguugcggaccuguauccagcaauggugccaacggcgugaagggguucucuuuuaaguauggaaacggcgucuggaucggucggacaaaaucaaucaguagccgcaauggguucgagaugauuugggauccaaacggcuggaccggaacggacaauaacuuuuccgugaagcaagacauaaucggcauuaaugaauggucuggguacucggggagcuucguucagcaucccgagcugacuggucuggauuguauccgaccuugcuucuggguggaacucauuagaggcaggccaaaagagaacacaaucuggaccuccgggucaaguauaucuuuuuguggagucaauagcgacacugugggcugguccuggcccgauggugcggaguuaccguucacaaucgacaaguga

SEQ ID NO: 145335 - RNA, 1410 nt, Artificial Sequence; identical to SEQ ID NO: 142273
  derived and/or modified sequence opt3 from neuraminidase__InfluenzaA__AGB13663

SEQ ID NO: 145336 - RNA, 1410 nt, Artificial Sequence; identical to SEQ ID NO: 142273
  derived and/or modified sequence opt3 from neuraminidase__InfluenzaA__AGB13724

SEQ ID NO: 145337 - RNA, 1410 nt, Artificial Sequence; identical to SEQ ID NO: 142725
  derived and/or modified sequence opt3 from neuraminidase__InfluenzaA__AGB13734

SEQ ID NO: 145338 - RNA, 1410 nt, Artificial Sequence; identical to SEQ ID NO: 139230
  derived and/or modified sequence opt3 from neuraminidase__InfluenzaA__AGB51359

SEQ ID NO: 145339 - RNA, 1410 nt, Artificial Sequence
  derived and/or modified sequence opt3 from neuraminidase__InfluenzaA__AGB97270
augaaccccaaucagaagaucauuaccauaggcagcgugugcaugacaaucgggauggccaaccugauucuccaaaucggaaauauuaucuccauauggaucucucacucaauucagcuuagaaaccagaaucagaucgagacuuguaaccaaagugucauuacguacgaaaauaacaccuggguuaaucagacauaugugaacaucagcaauacuaacuucgcugcaggucaguccguagugucugucaaacuggccggcaauucgucauugugcccugugagcgggugggcgauauacaguaaggacaacuccauuaggaucggaucuaaaggcgauguuuuugugauucgggagccauucaucagcuguuccccguuagaaugccgcaccuuuuuccugacacagggugcucuacucaaugacaagcauucaaacgggaccaucaaagaucgaagucccuaucguacucugaugagcuguccuauuggagaggucccaucucccuacaacuccagauuugaaucaguggccuggagcgcaagugccugccacgacggcauaaauuggcuuacaaucggcauuucugggccugauaacggagcuauggcaguacugaaguauaaugguaucauaaccgacacgauuaaguccuggaggaacaauaucuugcggacucaagagagcgagugugccugcguuaacggcucguguuucaccaucaugacagaugggccaucugacggacaggcuuccuacaaaauuuuucgcaucgaaaagggcaaaauugugaagucagucgagaugaaugcccccaacuaucauuacgaagagugcaguuguuacccugauagcuccgagauaacuugcgugugcagagacaauuggcacgguucuaacaggccaugggugagcuucaaucagaaccucgaauaucagaucggguacauuuguucaggaaucuuuggcgauaauccgcggcccaacgacaaaaccggcaguugcgggccugucuccagcaauggagcgaacgguguuaagggcuucucuuuuaaguaugggaacggaguguggaucggccgcacaaaaucaauuaguagccgaaaggguuucgagaugauaugggauccaaauggguggaccggcacggacaacaauuuuuccaucaaacaagacauuguaggaaucaacgaauggucuggcuacucggggagcuucgugcagcaucccgagcugacuggacuggauuguauuagaccuugcuucugggucgaacucaucaggggucggccaaaggagaauacaauauggaccuccggcucaaguaucucuuuuuguggggugaacagcgacacuguuggaugguccuggcccgauggcgcagaguuaccguucacaauugacaaauga

SEQ ID NO: 145340 - RNA, 1410 nt, Artificial Sequence
  derived and/or modified sequence opt3 from neuraminidase__InfluenzaA__AGB97274
augaaccccaaucagaagaucauuaccauaggcagcgugugcaugacaaucgggauggccaaccugauucuccaaaucggaaauauuaucuccauauggaucucucacucaauucagcuuagaaaccagaaucagaucgagacuuguaaccaaagugucauuacguacgaaaauaacaccuggguuaaucagacauaugugaacaucagcaauacuaacuucgcugcaggucaguccguagugucugucaaacuggccggcaauucgucauugugcccugugagcgggugggcgauauacaguaaggacaacuccauuaggaucggaucuaaaggcgauguuuuugugauucgggagccauucaucagcuguuccccguuagaaugccgcaccuuuuuccugacacagggugcucuacucaaugacaagcauucaaacgggaccaucaaagaucgaagucccuaucguacucugaugagcuguccuauuggagaggucccaucucccuacaacuccagauuugaaucaguggccuggagcgcaagugccugccacgacggcauaaauuggcuuacaaucggcauuucugggccugauaacggagcuguagcaguucugaaguauaaugguaucauaaccgacacgauuaaguccuggaggaacaauaucuugcggacucaagagagcgagugugccugcgugaacggcucguguuucaccaucaugacagaugggccaucugacggacaggcuuccuacaaaauuuuucgcaucgaaaagggcaaaauugucaagucaguggagaugaaugcccccaacuaucauuacgaagagugcaguuguuacccugauagcuccgagauaacuugcgugugcagagacaauuggcacgguucuaacaggccaugggucagcuucaaucagaaccucgaauaucagaucggguacauuuguucaggaaucuuuggcgauaauccgcggcccaacgacaaaaccggcaguugcgggccuguuuccagcaauggagcgaacggugugaagggcuucucuuuuaaguaugggaacggaguauggaucggccgcacaaaaucaauuaguagccgaaaggguuucgagaugauaugggauccaaauggguggaccggcacggacaacaauuuuuccaucaaacaagacauugugggaaucaacgaauggucuggcuacucggggagcuucguccagcaucccgagcugacuggacuggauuguauuagaccuugcuucuggguggaacucaucaggggucggccaaaggagaauacaauauggaccuccggcucaaguaucucuuuuugugggguuaacagcgacacugugggaugguccuggcccgauggcgcagaguuaccguucacaauugacaaauga

SEQ ID NO: 145341 - RNA, 1410 nt, Artificial Sequence; identical to SEQ ID NO: 144162
  derived and/or modified sequence opt3 from neuraminidase__InfluenzaA__AGB97289

SEQ ID NO: 145342 - RNA, 1410 nt, Artificial Sequence
  derived and/or modified sequence opt3 from neuraminidase__InfluenzaA__AGE15475
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacaggggagucuacucaacgacaagcauagcaauggaaccaucaaagaucgcucucccuaucgaacucugauguccuguccuauuggcgaggucccaucacccuacaacagccguuuugaaaguguggcuuggucugccuccgcaugccacgacggcauaaacuggcuuacaaucgggauuagcggaccugauaauggugccguagcuguucugaaguauaacggcaucauaaccgacacgauuaagucguggagaaauaacaucuugaggacucaagagucugagugugcaugcgugaauggguccuguuucaccaucaugacagauggaccaucagacggccaggccaguuacaaaauuuuucggaucgaaaaggguaaaauugucaagagcguggagaugaacgcucccaauuaucauuacgaagagugcuccuguuacccugauucuagcgagauaacuugcgugugccgcgacaacuggcacgggucaaauagaccaugggucaguuucaaccagaaucucgaauaucagaucggauacauuuguuccggcaucuuuggcgauaacccgaggcccaaugacaaaaccgggagcugcggaccuguuucuucaaacggugccaauggcgugaagggguucaguuuuaaguauggaaacggcguauggaucggucggacaaaaagcauuuccucucgcaagggguucgagaugauaugggauccaaacggcuggaccggaacggacaauuacuuuucgaucaaacaagacauugugggcaucaacgaauggagcggguauuccggaucauucguccagcaucccgagcugacuggucuggauuguauucgaccuugcuucuggguggaacucaucagaggcaggccaaaggagaauacaauauggaccagugggucuagcaucuccuuuuguggaguuaacucagacacugugggcuggagcuggcccgauggugcggaguuaccguucucuauugacaaauga

SEQ ID NO: 145343 - RNA, 1410 nt, Artificial Sequence
  derived and/or modified sequence opt3 from neuraminidase__InfluenzaA__AGE15476
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacaggggagucuacucaacgacaagcauagcaauggaaccaucaaagaucgcucucccuaucgaacucugauguccuguccuauuggcgaggucccaucacccuacaacagccguuuugaaaguguggcuuggucugccuccgcaugccacgacggcauaaacuggcuuacaaucgggauuagcggaccugauaauggugccguagcuguucugaaguauaacggcaucauaaccgacacgauuaagucguggagaaauaacaucuugaggacucaagagucugagugugcaugcgugaauggguccuguuucaccaucaugacagauggaccaucagacggccaggccaguuacaaaauuuuucggaucgaaaaggguaaaauugucaagagcguggagaugaacgcucccaauuaucauuacgaagagugcuccuguuacccugauucuagcgagauaacuugcgugugccgcgacaacuggcacgggucaaauagaccaugggucaguuucaaccagaaucucgaauaucagaucggauacauuuguuccggcaucuuuggcgauaacccgaggcccaaugacaaaaccgggagcugcggaccuguuucuucaaacggugccaauggcgugaagggguucaguuuuaaguauggaaacggcguauggaucggucggacaaaaagcauuuccucucgcaagggguucgagaugauaugggauccaaacggcuggaccggaacggacaauuacuuuucgaucaaacaagacauugugggcaucaacgaauggagcggguauuccggaucauucguccagcaucccgagcugacuggucuggauuguauucgaccuugcuucuggguggaacucaucagaggcaggccaaaggagaauacaauauggaccagugggucuagcaucuccuuuuguggaguuaacucagacacugugggcuggagcuggcccgauggugcggaguuaccguucacaauugacaaauga

SEQ ID NO: 145344 - RNA, 1410 nt, Artificial Sequence; identical to SEQ ID NO: 145174
  derived and/or modified sequence opt3 from neuraminidase__InfluenzaA__AGE15477

SEQ ID NO: 145345 - RNA, 1410 nt, Artificial Sequence
  derived and/or modified sequence opt3 from neuraminidase__InfluenzaA__AGE15478
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacaggggagucuacucaacgacaagcauagcaauggaaccaucaaagaucgcucucccuaucgaacucugauguccuguccuauuggcgaggucccaucacccuacaacagccguuuugaaaguguggcuuggucugccuccgcaugccacgacggcauaaacuggcuuacaaucgggauuagcggaccugauaauggugccguagcuguucugaaguauaacggcaucauaaccgacacgauuaagucguggagaaauaacaucuugaggacucaagagucugagugugcaugcgugaauggguccuguuucaccaucaugacagauggaccaucagacggccaggccaguuacaaaauuuuucggaucgaaaaggguaaaauugucaagagcguggagaugaacgcucccaauuaucauuacgaagagugcuccuguuacccugauucuagcgagauaacuugcgugugccgcgacaacuggcacgggucaaauagaccaugggucaguuucaaccagaaucucgaauaucagaucggauacauuuguuccggcaucuuuggcgauaacccgaggcccaaugacaaaaccgggagcugcggaccuguuucuucaaacggugccaauggcgugaagggguucaguuuuaaguauggaaacggcguauggaucggucggacaaaaagcauuuccucucgcaagggguucgagaugauaugggauccaaacggcuggaccggaacggacaauuacuuuucgaucaaacaagacauugugggcaucaacgaauggagcggguauuccggaucauucguccagcaucccgagcugacuggucuggauuguauucgaccuugcuucuggguggaacucaucagaggcaggccaaaggagaauacaauauggaccagugggucuagcaucuccuuuuguggaguuaaaucagacacugugggcuggagcuggcccgauggugcggaguuaccguucacaauugacaaguga

SEQ ID NO: 145346 - RNA, 1410 nt, Artificial Sequence
  derived and/or modified sequence opt3 from neuraminidase__InfluenzaA__AGE15479
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacaggggagucuacucaacgacaagcauagcaauggaaccaucaaagaucgcucucccuaucgaacucugauguccuguccuauuggcgaggucccaucacccuacaacagccguuuugaaaguguggcuuggucugccuccgcaugccacgacggcauaaacuggcuuacaaucgggauuagcggaccugauaauggugccguagcuguucugaaguauaacggcaucauaaccgacacgauuaagucguggagaaauaacaucuugaggacucaagagucugagugugcaugcgugaauggguccuguuucaccaucaugacagauggaccaauugacggccaggccucauacaaaaucuuucggauugaaaaggguaaaauagucaagaguguggagaugaacgcucccaauuaucauuacgaagagugcagcuguuacccugauuccucugagaucacuugcgugugccgcgacaacuggcacgggagcaauagaccaugggucucauucaaccagaaucucgaauaucagauuggauacaucuguaguggcaucuuuggcgauaacccgaggcccaaugacaaaaccggguccugcggaccuguuagcucuaacggugccaauggcgugaagggguucucauuuaaguauggaaacggcguauggauuggucggacaaaaaguauaagcucccgcaagggguucgagaugaucugggauccaaacggcuggaccggaacggacaauuacuuuucuauuaaacaagacaucgugggcauuaacgaauggucgggguauagcggauccuucguccagcaucccgagcugacuggucuggauuguauccgaccuugcuucuggguggaacucauaagaggcaggccaaaggagaauacaaucuggaccucagggaguucuauuagcuuuuguggaguuaacuccgacacugugggcuggucauggcccgauggugcggaguuaccguucacaaucgacaaauga

SEQ ID NO: 145347 - RNA, 1410 nt, Artificial Sequence; identical to SEQ ID NO: 145174
  derived and/or modified sequence opt3 from neuraminidase__InfluenzaA__AGE15480

SEQ ID NO: 145348 - RNA, 1410 nt, Artificial Sequence; identical to SEQ ID NO: 140216
  derived and/or modified sequence opt3 from neuraminidase__InfluenzaA__AGE89270

SEQ ID NO: 145349 - RNA, 1410 nt, Artificial Sequence; identical to SEQ ID NO: 140216
  derived and/or modified sequence opt3 from neuraminidase__InfluenzaA__AGE89280

SEQ ID NO: 145350 - RNA, 1410 nt, Artificial Sequence
  derived and/or modified sequence opt3 from neuraminidase__InfluenzaA__AGE89290
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaaacugguggauuccguaguuucauggaguaaggagauucugaggacgcaggaaagcgagugugugugcauaaacggcacuuguaucgucgugaugacagacggcucugcuuccgggaaagcagauaccaagauucucuuuguggaggaaggaaagaucguccauacuucaacauuaagcgguagugcccaacacguugaggaaugcucuugcuauccucgguacccaggcgugcgcuguguaugcagagacaacuggaaaggguccaauaggccgauaguggauauuaacaucaaggaccacagcaucauuucgucuuacgucuguuccggacuggugggcgacacgccccggaaaaaugauucaaguagcuccucucauugccuugacccuaacaaugaggaaggugggcacggaguuaagggcugggcuuucgaugacggcaacgauguguggauggggcgcaccaucaaugagaccagccgauugggauaugagacauuuaaagucauugaagguuggucaaacccaaagaguaaacugcagauaaauagacaggugaucguagacaggggcaaccgguccggguacagcggaauuuucucuguugagggcaagucauguaucaaucguugcuuuuauguggaacuaauccgcgguagaaaggaggaaacugagguccucuggaccaguaacagcauuguggucuucugugggacauccggcacuuacggaaccggcucuuggcccgauggggccgaccugaaucuuaugccuauauga

SEQ ID NO: 145351 - RNA, 1410 nt, Artificial Sequence; identical to SEQ ID NO: 142273
  derived and/or modified sequence opt3 from neuraminidase__InfluenzaA__AGE89301

SEQ ID NO: 145352 - RNA, 1410 nt, Artificial Sequence
  derived and/or modified sequence opt3 from neuraminidase__InfluenzaA__AGE89311
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggaaaaacaauaucuugagaacucaagagagcgagugugccugcgugaacgggucguguuucaccgucaugacagauggaccaucugacggccaggcuuccuacaagaucuuuaggauugaaaaagguaagaucgugaaaucaguggagaugaaugcccccaacuaucauuacgaagagugcaguuguuacccugauagcuccgagauuacuugcgucugccgggacaauuggcacgggucuaaccgcccauggguuagcuucaaucagaaccucgaauauagaauaggauacaucuguucaggcauuuuuggcgauaauccgaggcccaacgacaagaccgggaguugcggaccuguguccagcaauggugcgaacggcguaaagggguucucuuuuaaauauggaaacggcguguggaucggucggacaaagucaaucaguagccgcaauggguucgagaugauuugggauccaaacggcuggaccggaacggacaauaacuuuuccaaaaagcaggacauaaucggcauuaaugaauggucuggguacucggggagcuucguccaacaucccgagcugacuggucuggauuguauccgaccuugcuucuggguggaacucauuagaggcaggccaaaagagaacacaaucuggaccuccgggucaaguaugucuuuuuguggaguuaauagcgacacugugggcugguccuggcccgauggugcagaguuaccguucacaauagacaaguga

SEQ ID NO: 145353 - RNA, 1410 nt, Artificial Sequence; identical to SEQ ID NO: 143803
  derived and/or modified sequence opt3 from neuraminidase__InfluenzaA__AGE89321

SEQ ID NO: 145354 - RNA, 1410 nt, Artificial Sequence; identical to SEQ ID NO: 143159
  derived and/or modified sequence opt3 from neuraminidase__InfluenzaA__AGE89332

SEQ ID NO: 145355 - RNA, 1410 nt, Artificial Sequence; identical to SEQ ID NO: 142273
  derived and/or modified sequence opt3 from neuraminidase__InfluenzaA__AGE89343

SEQ ID NO: 145356 - RNA, 1410 nt, Artificial Sequence
  derived and/or modified sequence opt3 from neuraminidase__InfluenzaA__AGE89353
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacauuaccaucgagaaggaaauaugccccaaauuagcugaguacaggaauuggaguaagccucagugugacauuacuggguucgcaccauuuagcaaagauaacuccauccggcugucugccggaggugacauuuggguaacacgcgagcccuaugugucgugcgauccugacaaguguuaccaauucgcgcuaggccaggggaccacgcucaauaacguccauucaaauaacacugugcgagaucguaccccauauagaacacugcuuaugaaugaacugggaguucccuuucacuugggcacuaaacaggugugcaucgcuuggagcaguuccucuugucaugacgguaaggccuggcuccacgucugcaucaccggggaugacaagaacgcaacagccagcuucauuuacaauggaaggcugguggauuccguaguuucauggaguaaagagauacugcggacccaggaaagcgagugugugugcaucaacggcacguguacugucgugaugacagacggcucugcuuccgggaaggcagauaccaaaauucucuuuaucgaggaaggaaagauagugcauacuucaacauuaagcgguagugcccaacacgucgaggaaugcucuugcuauccucgcuacccaggcguuagaugugugugcagggacaacuggaagggguccaaucggccgauuguagauaucaacaucaaagaccacagcauugugucgucuuacgucuguuccggacuggugggcgacacccccaggaagaaugauucaaguagcuccucucauugccuugacccuaacaaugaggaaggugggcacggaguuaaaggcugggcuuucgaugacggcaacgauguguggauggggcgaacgaucaaugagaccagcagauugggauaugagacauuuaaggucauugaagguuggucaaacccaaaaaguaagcugcagauaaaucgccaggugaucguagacaaaggcaaccgguccggguacagcggaauuuucucuguugagggcaagucauguaucaaucguugcuuuuauguggaacuaauccgcgguagaaaggaggaaacugagguccucuggaccaguaacagcauuguggucuucugugggacauccggcacuuacggaaccggcucuuggcccgauggggccgaccugaaucuuaugccuauauga

SEQ ID NO: 145357 - RNA, 1410 nt, Artificial Sequence; identical to SEQ ID NO: 143010
  derived and/or modified sequence opt3 from neuraminidase__InfluenzaA__AGE89364

SEQ ID NO: 145358 - RNA, 1410 nt, Artificial Sequence; identical to SEQ ID NO: 143803
  derived and/or modified sequence opt3 from neuraminidase__InfluenzaA__AGE89374

SEQ ID NO: 145359 - RNA, 1410 nt, Artificial Sequence
  derived and/or modified sequence opt3 from neuraminidase__InfluenzaA__AGE89385
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagccucugugaaacuggcgggaaauucgucauugugcccugucagcggaugggcuauauacaguaaggacaacuccauuagaaucggcucuaaaggugauguguuuguuauuagggagccauucaucagcuguuccccguuagaaugccggaccuuuuuccugacacagggggcccuacucaaugacaagcauucaaacggaaccaucaaagaucgcagucccuaucgaacucugaugagcuguccuauuggcgaggugccaucucccuacaacucccguuuugaaucagucgcauggagcgccagugcuugccacgacggcauaaauuggcuuacaaucgggauuucuggaccugauaacggugcaguggccguacugaaguauaauggcaucauaaccgacacgauuaaguccuggagaaacaauaucuugaggacucaagagagcgagugugcuugcguuaacgggucguguuucaccaucaugacagauggaccaucugacggccaggccuccuacaaaauuuuucggaucgaaaaggguaaaauugugaagucagucgagaugaaugcgcccaacuaucauuacgaagagugcaguuguuacccugauagcuccgagauaacuugcgugugccgcgacaauuggcacgggucuaacagaccaugggugagcuucaaucagaaccucgaauaucagaucggauacauuuguucaggcaucuuuggcgauaauccgaggcccaacgacaaaaccgggaguugcggaccugucuccagcaauggugcaaacggcguuaagggguucucuuuuaaguauggaaacggcguguggaucggucggacaaaaucaauuaguagccgcaagggguucgagaugauaugggauccaaauggcuggaccggaacggacaacaauuuuuccaucaaacaagacauuguaggcaucaacgaauggucuggguacucggggagcuucgugcagcaucccgagcugacuggucuggauuguauucgaccuugcuucugggucgaacucaucagaggcaggccaaaggagaauacaauauggaccuccgggucaaguaucucuuuuuguggagugaacagcgacacuguuggcugguccuggcccgauggugccgaguuaccguucacaauugacaaauga

SEQ ID NO: 145360 - RNA, 1410 nt, Artificial Sequence
  derived and/or modified sequence opt3 from neuraminidase__InfluenzaA__AGE89395
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccauuaaugagacaagcagacuuggauaugagacuuuuaaggucaucgaagguuggucaaaccccaaaaguaaguugcagauuaauaggcaagugauaguagaccggggcaaccguuccggguacagcggaaucuucucuguugagggcaaaucauguauuaaucgcugcuuuuauguggaacugaucagagguaggaaggaggaaaccgagguccuauggacaaguaacagcaucguggucuucugugggacuuccggcaccuacggaacaggcucuuggccugauggggccgaccucaaucugaugccaauuuga

SEQ ID NO: 145361 - RNA, 1410 nt, Artificial Sequence; identical to SEQ ID NO: 140216
  derived and/or modified sequence opt3 from neuraminidase__InfluenzaA__AGE89425

SEQ ID NO: 145362 - RNA, 1410 nt, Artificial Sequence; identical to SEQ ID NO: 141534
  derived and/or modified sequence opt3 from neuraminidase__InfluenzaA__AGE89722

SEQ ID NO: 145363 - RNA, 1410 nt, Artificial Sequence
  derived and/or modified sequence opt3 from neuraminidase__InfluenzaA__AGE89733
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaaaugacggccaggcuucuuacaaaauuuuucggaucgaaaaggguaaaauugucaaguccguggagaugaacgcccccaauuaucauuacgaagagugcucauguuacccugauaguagcgagauaacuugcgugugccgcgacaacuggcacggguccaauagaccaugggucucuuucaaccagaaucucgaauaucagaucggauacauuuguagcggcaucuuuggcgauaacccgaggcccaaugacaaaaccgggucaugcggaccuguuaguuccaacggugcgaacggcgugaagggguucagcuuuaaguauggaaauggcguauggaucggucggacaaaaucuauuucaagucgcaagggguucgagaugauaugggauccaaacggcuggaccggaacggacaauaacuuuagcaucaaacaagacauugugggcaucaaugaaugguccggguacucuggaucguucguccagcaucccgagcugacuggucuggauuguauucgaccuugcuucuggguggaacucaucagaggcaggccaaaggagaacacaauauggaccagcggguccucaaucaguuuuuguggaguuaauucugacacugugggcuggagcuggcccgauggugcagaguuaccguucacaauugacaaauga

SEQ ID NO: 145364 - RNA, 1410 nt, Artificial Sequence
  derived and/or modified sequence opt3 from neuraminidase__InfluenzaA__AGE89743
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuaaugagacaagcagauugggauaugagacuuuuaaggucaucgaagguuggucaaacccaaaaaguaagcugcagauuaauaggcaagugauaguagacaaagauaaccgguccggcuacagcgggaucuucucuguugagggaaagucauguauuaaucguugcuuuuauguggaacuaauccgcggcagaaaggaggaaaccgagguccucuggacaaguaacagcaucguggucuucugugguacuuccgggaccuacggcacaggaucuuggcccgacggcgccgaucugaaucuuaugccuauuuga

SEQ ID NO: 145365 - RNA, 1410 nt, Artificial Sequence; identical to SEQ ID NO: 143803
  derived and/or modified sequence opt3 from neuraminidase__InfluenzaA__AGE89754

SEQ ID NO: 145366 - RNA, 1410 nt, Artificial Sequence; identical to SEQ ID NO: 143803
  derived and/or modified sequence opt3 from neuraminidase__InfluenzaA__AGE89765

SEQ ID NO: 145367 - RNA, 1410 nt, Artificial Sequence
  derived and/or modified sequence opt3 from neuraminidase__InfluenzaA__AGG13414
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauucaguccauagcaacaauaccgugcgagaucguacacccuauagaacucuccugaugaacgaacuuggaguuccuuuucaccugggcaccaaacaggugugcauugcuuggaguuccucuagcugucaugacgguaaggccugguugcacgucugcaucacaggggaugacaagaaugcaaccgccuccuucaucuacaacggaaggcucguggauucaguaguuaguuggagcaaagagauucugcggacgcaggaaucugagugugugugcauaaauggcacuuguacagucgugaugaccgacggcuccgcuucagggaaggcagauacuaaaauccuguuuauugaggaaggaaagaucgugcauacaagcacccucagugguucugcccaacacgucgaggaaugcuccugcuauccacgcuacccgggcguuagaugugugugcagggacaacuggaaggggagcaaccggcccauaguagauauuaauaucaaagaccacucgaucgugucucgcuacgucuguuccggauuagugggcgacacgccucgaaagaacgauucaaguagcuccucucauugccuggacccaaauaacgaggaaggugggcacggaguuaaaggcugggcuuucgaugacggcaaugauguguggauggggagaaccauuaacgagacaagcaggcuuggauaugagacuuuuaaggucaucgaagguuggucaaaucccaaaaguaaguugcagauuaacaaacaggugauaguagaccggggcgaucguuccggguacagcggaaucuucucuguugagggcaagucauguauuaaucgcugcuuuuauguggaacugaucagagguaggaaggaggaaaccgagguccuauggacaaguaacagcaucguggucuucugugggacuuccggcaccuacggaacaggcucuuggccugacggggccgaucucaaucugaugccaauuuga

SEQ ID NO: 145368 - RNA, 1410 nt, Artificial Sequence; identical to SEQ ID NO: 144162
  derived and/or modified sequence opt3 from neuraminidase__InfluenzaA__AGG13426

SEQ ID NO: 145369 - RNA, 1410 nt, Artificial Sequence; identical to SEQ ID NO: 144162
  derived and/or modified sequence opt3 from neuraminidase__InfluenzaA__AGG13438

SEQ ID NO: 145370 - RNA, 1410 nt, Artificial Sequence
  derived and/or modified sequence opt3 from neuraminidase__InfluenzaA__AGG13498
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagacauucugcggacgcaggagagcgaaugugugugcauaaacggcacuugugcugucgugaugacagauggcucugcauccgggaaggccgacaccaaaauccucuuuauugaggagggaaagaucgugcauacuucaacauuaagcgguagugcucaacacgucgaagagugcucuugcuauccucgcuacccaggcguuagaugugugugcagggauaacuggaagggguccaaucggccgauaguagacauuaacaucaaagaccacagcaucgugucgucuuacgucuguuccggacuggugggcgauacccccaggaagaaugacucaaguagcuccggucauugccuugauccuaacaaugaagaagggggacacggcguuaaaggcugggccuucgacgaugggaacgacguguggaugggacgaacgauuaaugagaccucuagauuggguuaugagacauuuaaggucaucgagggcuggagcaacccaaaaucaaagcugcagauuaaucgccaggugauaguagaucgggggaaccguaguggauacuccggcaucuucagcguugaagguaaaaauuguauuaaccgcugcuuuuauguggagcuaaucagagggaggaaggaagagacugaaguccucuggaccucuaauucaaucguggucuucuguggcacaaguggaacuuacggcaccgggagcuggcccgacggagcggaucugaaccuuaugccuauuuga

SEQ ID NO: 145371 - RNA, 1410 nt, Artificial Sequence; identical to SEQ ID NO: 144162
  derived and/or modified sequence opt3 from neuraminidase__InfluenzaA__AGG13510

SEQ ID NO: 145372 - RNA, 1410 nt, Artificial Sequence; identical to SEQ ID NO: 145370
  derived and/or modified sequence opt3 from neuraminidase__InfluenzaA__AGG13522

SEQ ID NO: 145373 - RNA, 1410 nt, Artificial Sequence
  derived and/or modified sequence opt3 from neuraminidase__InfluenzaA__AGG13534
augaaccccaaucagaagaucauuaccauaggcagcgugucccugacaaucucuacugucugcuucuuuaugcaaauugccauccucauuacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaaccugcugaguacaggaauuggaguaagccacagugugggaucacaggauucgcacccuuuagcaaagacaacuccauacgguuaucugccgguggcgauauuugggugacccgcgagccuuaugucucgugcgacccagauaaguguuaccaauucgcgcuggggcagggaacgacucuaaauaacgugcauucaaauaacaccguucgagaccguacacccuauagaacucuccugaugaaugaacuuggcgugccuuuucaccuggguaccaagcaggucugcaucgcuuggagcaguuccucuugucaugaugggaaagccugguugcacgugugcauuacaggagacgauaagaacgcaaccgccagcuucaucuacaauggcaggcucguagacuccguugugucauggaguaaagagauccugcggacgcaggaaagcgagugugucugcauuaacggcacuuguacaguggugaugaccgaugggucugcuuccggaaaggcagacacuaaaauacuguuuaucgaggaagguaagauuguccauacaucaacccucagcggcagugcccaacacguugaggaaugcucuugcuauccacgcuacccgggggugagauguguaugcagggauaacuggaagggauccaaucggcccaucguggacauaaacauuaaagaucacagcaucgucucgucuuacguguguuccggcuuaguuggugacacgccucgcaagaaugacucaaguagcuccucucauugccuggauccaaacaaugaggaagggggacacggcgugaaaggcugggcuuucgacgaugggaacgacgucuggaugggacgaaccaucaaugagacaagcagacuugguuaugagacuuuuaaggugauugaaggcuggucaaaccccaaaaguaaguugcagaucaauaggcagguaauuguugaucguggggaccgguccggauacagcggcauauucucuguggaggguaaaucauguaucaaccgcugcuuuuaugucgaacugauuagagggaggaaggaggaaaccgaggugcuauggacaaguaauagcaucgucguguucuguggcacuuccggaaccuacggcacagggucuuggccugauggagccgaccucaaccugaugccaaucuga

SEQ ID NO: 145374 - RNA, 1410 nt, Artificial Sequence
  derived and/or modified sequence opt3 from neuraminidase__InfluenzaA__AGG13546
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggcggggauccaaucgccccauaguagacauuaacaucaaggaucacagcaucgugucgucuuacgucuguuccggcuuagugggugacacgccucggaaaaaugacucaaguagcuccucucauugccuggauccaaacaaugaggaagggggacacggcguuaagggcugggcuuucgacgaugggaacgacguguggaugggaagaaccauuaaugagacaagcaggcuugguuaugagacuuuuaaagucaucgaaggcuggucaaaccccaagaguaaauugcagauuaaucgacaggugauaguagaucguuccgaccgcagcggguacucuggaaucuucucaguugagggcaagaguuguauuaacagaugcuuuuauguggaacugaucaggggucggaaagaggaaaccgagguccuauggacaagcaauuccaucguggucuucugugggacuucuggcaccuacggaacaggcucguggccugauggggccgaccucaaccugaugccaauuuga

SEQ ID NO: 145375 - RNA, 1410 nt, Artificial Sequence; identical to SEQ ID NO: 144162
  derived and/or modified sequence opt3 from neuraminidase__InfluenzaA__AGG13558

SEQ ID NO: 145376 - RNA, 1410 nt, Artificial Sequence; identical to SEQ ID NO: 144162
  derived and/or modified sequence opt3 from neuraminidase__InfluenzaA__AGG13570

SEQ ID NO: 145377 - RNA, 1410 nt, Artificial Sequence
  derived and/or modified sequence opt3 from neuraminidase__InfluenzaA__AGG13582
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagaggacaagaacgcaaccgccagcuucaucuacaauggcaggcucguggauuccguaguuucauggaguaaagaaacgcugcggacucaggagagcgagugugugugcauuaacggcacauguaccgucgugaugacugacgggucugcuuccggaaaggcagauacaaaaauacuguuuaucgaagaggguaagauugugcauaccucaacgcucagcggcagugcccaacacgucgaagagugcucuugcuauccacgcuacccggggguuagaugugugugcagggacaacuggaagggauccaaucggcccaucguagauauaaacauuaaagaccacagcaucgugucgucuuacgucuguuccggcuuagugggugauaccccucgcaagaaugacucaaguagcuccucucauugccuggacccaaacaaugaagaagggggacacggcguuaaaggcugggcuuucgaugacgggaacgauguguggaugggacgaacaaucaaugagacuagcagacuugguuaugagaccuuuaaggucauugagggcuggucaaaccccaaaaguaaguugcagaucaauaggcaagugauuguagaccguggggaucgguccggauacagcggcauauucucuguugaagguaaaucauguaucaaccgcugcuuuuauguggagcugauuagagggaggaaggaagagacagagguccuauggaccaguaauagcaucguggucuucuguggcacuuccggaacauacggcaccgggucuuggccugacggagccgaucucaaccugaugccaaucuga

SEQ ID NO: 145378 - RNA, 1410 nt, Artificial Sequence; identical to SEQ ID NO: 144162
  derived and/or modified sequence opt3 from neuraminidase__InfluenzaA__AGG13606

SEQ ID NO: 145379 - RNA, 1410 nt, Artificial Sequence
  derived and/or modified sequence opt3 from neuraminidase__InfluenzaA__AGG13618
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacuuauguuccggccuggucggugacacgccucgcaagaaugacgggucaaguagcucccauugccuugauccaaacaaugaggaaggaggccacggcgugaaagggugggcuuucgacgauggaaacgacguuuggaugggucgaaccauuaaugagacaucuagauugggcuaugagacuuuuaaggugaucgaaggguggagcaaccccaaaucaaagcugcagauuaauaggcagauaaucgucgaucggggagaccguaguggcuacuccgguauuuucagcguggaggggaaaucuuguaucaaccgcugcuuuuauguagaacuaaucagaggcaggaaggaggaaaccgagguucucuggacaucaaauaguauuguggucuucuguggaacuagcggcaccuacgggacaggauccuggccugauggugccgaccugaaccuuaugccaauauga

SEQ ID NO: 145380 - RNA, 1410 nt, Artificial Sequence
  derived and/or modified sequence opt3 from neuraminidase__InfluenzaA__AGG13630
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagaggacaagaacgcaaccgccagcuucaucuacaauggcaggcucguggauuccguaguuucauggaguaaagaaauucugcggacgcaggagagcgagugugugugcauaaacggcacuuguacagucgugaugaccgacgggucugcuuccggaaaggcagauacuaaaauccuguuuauugaagaggguaagaucgugcauacaucaacccucagcggcagugcccaacacgucgaagagugcucuugcuauccacgcuacccggggguuagaugugugugcagggacaacuggaagggauccaaucggcccauaguagauauuaacaucaaagaccacagcaucgugucgucuuacgucuguuccggcuuagugggugauacgccucgcaagaaugacucaaguagcuccucucauugccuggacccaaacaaugaagaagggggacacggcguuaaaggcugggcuuucgaugacgggaacgauguguggaugggacgaaccauuaaugagacaagcagacuugguuaugagacuuuuaaggucaucgagggcuggucaaaccccaaaaguaaguugcagauuaauaggcaagugauaguagaccguggggaucgguccggauacagcggcaucuucucuguugaagguaaaucauguauuaaccgcugcuuuuauguggagcugaucagagggaggaaggaagagaccgagguccuauggacaaguaauagcaucguggucuucuguggcacuuccggaaccuacggcacagggucuuggccugacggagccgaucucaaccugaugccaauuuga

SEQ ID NO: 145381 - RNA, 1410 nt, Artificial Sequence; identical to SEQ ID NO: 144162
  derived and/or modified sequence opt3 from neuraminidase__InfluenzaA__AGG13642

SEQ ID NO: 145382 - RNA, 1410 nt, Artificial Sequence
  derived and/or modified sequence opt3 from neuraminidase__InfluenzaA__AGG13654
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagacauucugcggacgcaggagagcgaaugugugugcauaaacggcacuugugcugucgugaugacagauggcucugcauccgggaaggccgacaccaaaauccucuuuauugaggagggaaagaucgugcaaacuucaacauuaagcgguagugcucagcaugucgaagagugcucuugcuauccucgcuacccaggcguuagaugugugugcagggauaacuggaagggguccaaucggccgauaguagacauuaacaucaaagaccacagcaucgugucgucuuacgucuguuccggacuggugggcgauacccccaggaagaaugacucaaguagcuccggucacugccuugauccuaacaaugaagaagggggacauggcguuaaaggcugggccuucgacgaugggaacgacguguggaugggacgaacgauuaaugagaccucuagauuggguuaugagacauuuaaggucaucgagggcuggagcaacccaaaaucaaagcugcagauuaaucgccaggugauaguagaucgggggaaccguaguggauacuccggcaucuucagcguugaagguaaaaauuguauuaaccgcugcuuuuauguggagcuaaucagagggaggaaggaagagaucgaaguccucuggacuucuaauucaauuguggucuucuguggcaccaguggaacauacggcacugggagcuggcccgacggagcggaucugaaccuuaugccuauauga

SEQ ID NO: 145383 - RNA, 1410 nt, Artificial Sequence; identical to SEQ ID NO: 145373
  derived and/or modified sequence opt3 from neuraminidase__InfluenzaA__AGG13666

SEQ ID NO: 145384 - RNA, 1410 nt, Artificial Sequence
  derived and/or modified sequence opt3 from neuraminidase__InfluenzaA__AGG13678
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuaagcaaagacaacuccauucggcugucugccgguggcgauaucuggguaacccgcgagccuuaugugucgugcgacccagauaaguguuaccaauuugcgcuagggcagggaacgacucucaauaacguccauucaaauaacaccgugcgagaccguacacccuauagaacucugcuuaugaaugaacugggcguuccuuuccacuuggguaccaaacaggugugcauugcuuggagcaguuccucuugucaugaugggaaggccuggcuccacgucugcaucacaggagacgauaagaacgcaaccgccagcuuuaucuacaauggcaggcugguggacuccguaguuucauggaguaaagagauucugcggacgcaggaaagcgagugugugugcauaaacggcacuuguacagucgugaugaccgaugggucugcuuccggaaaggcagacacuaaaauccucuucauugaggaagguaagaucgugcauacaucaaccuuaagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggccuggugggugacacgccucgcaagaaugacucaaguagcuccucucauugccuugggccaaacaaugaggaaggaggccacggcguuaaagggugggcuuuugaugacggaaacgauguguggaugggucgaaccauuaaugagacaagcagauugggcuaugagacuuucaaggucaucgaaggguggucaaaccccaaaaguaagcugcagauuaauaggcaagugauaguagaccggggagaucguuccggcuacagcgguaucuuuucuguugaggggaaaucauguauuaaccgcugcuucuauguggaacuaaucagaggcaggaaggaggaaaccgagguccucuggacaaguaauagcaucguggucuuuuguggaacugccggcaccuacgggacaggauccuggccugacggugcggaucugaaccuuaugccaauuuga

SEQ ID NO: 145385 - RNA, 1410 nt, Artificial Sequence; identical to SEQ ID NO: 144162
  derived and/or modified sequence opt3 from neuraminidase__InfluenzaA__AGG13690

SEQ ID NO: 145386 - RNA, 1410 nt, Artificial Sequence
  derived and/or modified sequence opt3 from neuraminidase__InfluenzaA__AGG13702
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguaacgcccaacacgucgaggaaugcaguugcuauccacgcuacccgggcguuagaugugugugcagggacaauuggaaggggucuaaccggcccauaguagauauuaauaucaaagaccacuccaucgugagccgcuacgucuguucgggauuagugggcgacacgccucgaaagaacgauucuuccucaaguagccauugccuggacccaaauaacgaggaaggugggcacggaguuaaaggcugggcuuucgaugacggcaaugauguguggauggggagaaccauuaacgagacauccaggcuuggauaugagacuuuuaaggucaucgaagguuggucuaaucccaaaagcaaguugcagauuaaccgucaggugauaguagaccggggcgaucgcucaggguacaguggaaucuucuccguugagggcaaaagcuguauuaauagaugcuuuuauguggaacugaucaggggucggaaggaggaaaccgagguccuauggacaucuaacucaaucguggucuucugugggaccaguggcacuuacggaacaggcagcuggccugacggggccgaucucaaucugaugccaauuuga

SEQ ID NO: 145387 - RNA, 1410 nt, Artificial Sequence; identical to SEQ ID NO: 145370
  derived and/or modified sequence opt3 from neuraminidase__InfluenzaA__AGG13714

SEQ ID NO: 145388 - RNA, 1410 nt, Artificial Sequence; identical to SEQ ID NO: 144162
  derived and/or modified sequence opt3 from neuraminidase__InfluenzaA__AGG13726

SEQ ID NO: 145389 - RNA, 1410 nt, Artificial Sequence; identical to SEQ ID NO: 144162
  derived and/or modified sequence opt3 from neuraminidase__InfluenzaA__AGG13738

SEQ ID NO: 145390 - RNA, 1410 nt, Artificial Sequence; identical to SEQ ID NO: 144162
  derived and/or modified sequence opt3 from neuraminidase__InfluenzaA__AGG13750

SEQ ID NO: 145391 - RNA, 1410 nt, Artificial Sequence
  derived and/or modified sequence opt3 from neuraminidase__InfluenzaA__AGG13762
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgcgcuacgucuguucuggauuagugggcgacacgccucgaaagaaugauuccucaaguagcucccauugccuggacccaaacaaugaggaaggugggcacggaguuaaaggcugggcuuucgaugacggcaacgauguguggauggggagaaccauuaaugagacaucuaggcuuggauaugagacuuuuaaggucaucgaagguuggagcaaccccaaaucaaaguugcagauuaaucgucaggugauaguagaccggggcgaucgcaguggguacuccggaaucuucagcguugagggcaaaucuuguauuaacagaugcuuuuauguggaacugaucaggggucggaaggaggaaaccgagguccuauggacaucaaauaguaucguggucuucugugggacuagcggcaccuacggaacaggcuccuggccugacggggccgaucucaaccugaugccaauuuga

SEQ ID NO: 145392 - RNA, 1410 nt, Artificial Sequence
  derived and/or modified sequence opt3 from neuraminidase__InfluenzaA__AGG13774
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuaccauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaauaacacagugcgagaucguacuccauauagaacccugcuuaugaaugaacugggaguucccuuucacuugggcacaaaacaggugugcaucgcuuggagcaguuccucuugucaugacgguaaggccuggcuccacgucugcauuaccggggaugacaagaacgcaacggccagcuucaucuacaauggaaggcugguggauuccguaguuucauggaguaaagacauccugcggacucaggagagcgaaugugugugcauuaacggcacaugugcugucgugaugaccgauggcucugcauccgggaaggccgacacuaaaauacucuuuaucgaggagggaaagauugugcauacaucaaccuuaagcgguagugcucaacacgucgaagagugcucuugcuauccucgcuacccaggcguuagaugugugugcagggauaacuggaagggguccaaucggccgaucguagacauaaacauuaaagaccacagcaucgugucgucuuacgucuguuccggacuggugggcgauacgccccgcaagaaugacucaaguagcuccggucauugccuugauccuaacaaugaagaagggggacacggcguuaaaggcugggccuucgacgaugggaacgacguguggaugggacgaaccaucaaugagacaucuagauuggguuaugagacuuuuaaggucauugagggcuggagcaacccaaaaucaaagcugcagaucaauaggcaagugauuguagaucgggggaaccguaguggauacuccggcauauucagcguugaagguaaaaauuguaucaaccgcugcuuuuauguggagcuaauuagagggaggaaggaagagaccgaaguccucuggacaucuaauucaaucguggucuucuguggcaccaguggaacuuacggcacagggagcuggcccgacggagcggaucugaaccuuaugccuaucuga

SEQ ID NO: 145393 - RNA, 1410 nt, Artificial Sequence
  derived and/or modified sequence opt3 from neuraminidase__InfluenzaA__AGG13786
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaaccuccauucaaauaacaccguccgagaccguacacccuauagaacucugcuuaugaaugaacugggcgugccuuuucacuuggguaccaagcagguuugcauugcuuggagcaguuccucuugucaugaugggaaagccuggcuccacgugugcaucacaggagacgauaagaacgcaaccgccagcuucaucuacaauggcaggcuggucgacuccgugguaucauggaguaaagagauucugcggacgcaggaaagcgaguguguuugcauaaacggcacuuguacaguggucaugaccgaugggucugcuuccggaaaggcagacacuaaaauccucuuuauugaggaagguaagaucgugcauacaucaaccuuaagcggcagugcccaacacguggaggaaugcucuugcuauccacgcuacccgggggucagauguguuugcagggauaacuggaagggauccaaucggcccauaguggacauuaacaucaaagaucacagcaucguaucgucuuacguguguuccggccuggucggugacacgccucgcaagaaugacucaaguagcuccucucauugccuugauccaaacaaugaggaagggggacacggcgugaaaggcugggcuuucgacgaugggaacgacguuuggaugggacgaaccauuaaugagacaagcagauuggguuaugagacuuuuaaggugaucgaaggcuggucaaaccccaaaaguaagcugcagauuaauaggcaggucauaguggaucguggggaccgguccggauacagcggcaucuucucuguagaggguaaaucauguauuaaccgcugcuuuuauguugaacuaaucagagggaggaaggaggaaaccgaggugcucuggacaaguaauagcaucgucguguucuguggcacuuccggaaccuacggcacagggucuuggccugauggagccgaccugaaccuuaugccaauuuga

SEQ ID NO: 145394 - RNA, 1410 nt, Artificial Sequence; identical to SEQ ID NO: 145370
  derived and/or modified sequence opt3 from neuraminidase__InfluenzaA__AGG13798

SEQ ID NO: 145395 - RNA, 1410 nt, Artificial Sequence
  derived and/or modified sequence opt3 from neuraminidase__InfluenzaA__AGG13810
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgcgcuacgucuguucuggauuagugggcgacacgccucgaaagaaugauuccucaaguagcucccauugccuggguccaaacaaugaggaagggggacacggcguuaaaggcugggcuuucgacgaugggaacgacguguggaugggaagaaccauuaaugagacaucuaggcuugguuaugagacuuuuaaggucaucgaaggcuggagcaaccccaaaucaaaguugcagauuaaucggcaagugauaguagaucguggggaccgcaguggauacuccggcaucuucagcguugaggguaaaucuuguauuaacagaugcuuuuauguggaacugaucagggggcggaaggaggaaaccgagguccuauggacaucaaauaguaucguggucuucuguggcacuagcggaaccuacggcacaggguccuggccugauggagccgaccucaaccugaugccaauuuga

SEQ ID NO: 145396 - RNA, 1410 nt, Artificial Sequence; identical to SEQ ID NO: 145370
  derived and/or modified sequence opt3 from neuraminidase__InfluenzaA__AGG13822

SEQ ID NO: 145397 - RNA, 1410 nt, Artificial Sequence; identical to SEQ ID NO: 145370
  derived and/or modified sequence opt3 from neuraminidase__InfluenzaA__AGG13834

SEQ ID NO: 145398 - RNA, 1410 nt, Artificial Sequence; identical to SEQ ID NO: 145391
  derived and/or modified sequence opt3 from neuraminidase__InfluenzaA__AGG13846

SEQ ID NO: 145399 - RNA, 1410 nt, Artificial Sequence; identical to SEQ ID NO: 144162
  derived and/or modified sequence opt3 from neuraminidase__InfluenzaA__AGG13858

SEQ ID NO: 145400 - RNA, 1410 nt, Artificial Sequence
  derived and/or modified sequence opt3 from neuraminidase__InfluenzaA__AGG13870
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagaucgauguuaccaauucgcgcuggggcagggaacgacucuaaauaacaugcauucaaauaacaccguccgugacagaacacccuauaggacucuccugaugaaugaacuuggcgugccuuuucaccuggguaccaagcagguuugcauugcuuggagcaguuccucuugucaugaugggaaggccugguugcacgugugcaucacaggagacgauaaaaacgcaaccgccagcuucaucuacaauggccggcucgucgacuccgugguaucauggaguaaggagauucugcgcacgcaggaaagcgaguguguuugcauaaacggcacuuguacaguggucaugaccgaugggucugcuuccggaaaagcagacacuaagauccuguuuauugaggaagguaaaaucgugcauacaucaacccucagcggcagugcccaacacguggaggaaugcucuugcuauccaagauacccgggggucagguguguuugccgggauaacuggaagggauccaaucgccccauaguggacauuaacaucaaggaucacagcaucguaucgucuuacguguguuccggcuuagucggugacacgccucgaaagaaugacucaaguagcuccucucauugccuggauccaaacaaugaggaagggggacacggcgugaaaggcugggcuuucgacgaugggaacgacguuuggaugggaagaaccauuaaugagacaagcaggcuugguuaugagacuuuuaaagugaucgaaggcuggucaaaccccaagaguaaauugcagauuaaucggcaggucauaguggaucguggggaccgcuccggauacagcggcaucuucucuguagaggguaccucauguauuaacagaugcuuuuauguugaacugaucagggggcggaaggaggaaacagaggugcuauggaccaguaauagcaucgucguguucuguggcacuuccggaacauacggcaccgggucuuggccugauggagccgaccucaaccugaugccaauuuga

SEQ ID NO: 145401 - RNA, 1410 nt, Artificial Sequence
  derived and/or modified sequence opt3 from neuraminidase__InfluenzaA__AGG13894
augaaccccaaucagaagaucauuaccauaggcagcgugucccugacaaucucuacugucugcuucuuuaugcaaauugccauccucauuacgaccguuacacuucacuucaaacaguacgaguuuaacucaccuccaaauaaccaggugaugcugugugaaccgacuaucauagagagaaauguaaccgaaaucguguauuugacaaacaccacuauugagaaggaaaucugccccaaaccugcugaguacaggaauuggaguaagccacagugugggauuacaggauucgcacccuuuagcaaagacaacuccauccgguuaucugccgguggcgauauaugggucacccgcgagccuuaugugucgugcgacccagauaaguguuaccaauucgcgcuggggcagggaacgacucuaaauaacguucauucaaauaacaccgugcgagaccguacacccuauagaacucuccugaugaaugaacuuggcgucccuuuucaccuggguaccaaacaggugugcauugcuuggagcaguuccucuugucaugaugggaaggccugguugcacguaugcaucacaggagacgauaagaacgcaaccgccagcuucauuuacaauggcaggcucguugacuccguggucucauggaguaaagagauccugcggacgcaggaaagcgagugugugugcaucaacggcacuuguacaguggucaugaccgaugggucugcuuccggaaaggcagacacuaaaauucuguuuauagaggaagguaagaucguucauacaucaacccucagcggcagugcccaacacguggaggaaugcucuugcuauccacgcuacccggggguaagaugugugugcagggauaacuggaagggauccaaucggcccauugucgacaucaacauaaaagaucacagcauugugucgucuuacguuuguuccggcuuagugggugacacgccucgcaagaaugacucaaguagcuccucucauugccuggauccaaacaaugaggaagggggacacggcgucaaaggcugggcuuucgacgaugggaacgacguguggaugggacgaaccaucaaugagacaagcagacuugguuaugagacuuuuaagguaaucgaaggcuggucaaaccccaaaaguaaguugcagauuaauaggcagguuaucguggaucguggggaccgguccggauacagcggcauuuucucugucgaggguaaaucauguauaaaccgcugcuuuuauguggaacugaucagagggaggaaggaggaaaccgagguccuauggacaaguaauagcauugugguuuucuguggcacuuccggaaccuacggcacagggucuuggccugauggagccgaccucaaccugaugccaaucuga

SEQ ID NO: 145402 - RNA, 1410 nt, Artificial Sequence; identical to SEQ ID NO: 145370
  derived and/or modified sequence opt3 from neuraminidase__InfluenzaA__AGG13906

SEQ ID NO: 145403 - RNA, 1410 nt, Artificial Sequence
  derived and/or modified sequence opt3 from neuraminidase__InfluenzaA__AGG13930
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugaccgaucaaguagcucccauugccuggauccaaacaaugaggaagggggacacggcguuaaaggcugggcuuucgacgaugggaacgacguguggaugggaagaaccauuaaugagacaucuaggcuugguuaugagacuuuuaaggucaucgaaggcuggagcaaccccaaaucaaaguugcagauuaaucggcaagugauaguagaucguggggaccgcaguggauacuccggcaucuucagcguugaggguaaaucuuguauuaacagaugcuuuuauguggaacugaucagggggcggaaggaggaaaccgagguccuauggacaucaaauaguaucguggucuucuguggcacuagcggaaccuacggcacaggguccuggccugauggagccgaccucaaccugaugccaauuuga

SEQ ID NO: 145404 - RNA, 1410 nt, Artificial Sequence; identical to SEQ ID NO: 145380
  derived and/or modified sequence opt3 from neuraminidase__InfluenzaA__AGG13942

SEQ ID NO: 145405 - RNA, 1410 nt, Artificial Sequence
  derived and/or modified sequence opt3 from neuraminidase__InfluenzaA__AGG13965
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuguuagaauuggcagcaaaggugauguguuugucaucagggagccauucauuuccuguucaccguuagaaugccggaccuuuuuccugacacagggggcucuacucaacgacaagcauaguaauggaaccaucaaagaucgcagccccuaucgaacucugaugucuuguccuaucggcgaggugccaucccccuacaacucacguuuugaaagcguagccuggagugcaucugccugccacgacggcauuaacuggcuuacaauagggaucuccggaccugauagcggugcuguugcagugcugaaguauaauggcauuaucaccgacacgauaaagucguggagaaacaauauuuugaggacucaagagucugagugugccugcgucaacggguccuguuucaccaucaugacagauggaccaucagacggccaggcuaguuacaaaaucuuucggauugaaaaggguaaaaucgugaagucaguggagaugaaugcccccaacuaucauuacgaagagugcuccuguuacccugauucuagcgagauuacuugcgucugccgcgacaauuggcacgggucaaacagaccauggguuaguuucaaucagaaccucgaauaucagauaggauacaucuguuccggcauuuuuggcgauaauccgaggcccaacgacaaaaccgggagcugcggaccugugucuucaaauggugcgaacggcguaaagggguucaguuuuaaguauggaaauggcguguggaucggucggacaaaaagcaucuccucucgcaagggguucgagaugauuugggauccaaacggcuggaccggaacggacaacaauuuuucgauaaaacaagacaucgucggcauuaacgaauggagcggguacuccggaucauucgugcagcaucccgagcugacuggucuggauuguauccgaccuugcuucuggguugaacucauuagaggcaggccaaaggagaauacaaucuggaccagugggucuagcauauccuuuuguggagugaacucagacacugucggcuggagcuggcccgauggugcagaguuaccguucacaaucgacaaauga

SEQ ID NO: 145406 - RNA, 1410 nt, Artificial Sequence; identical to SEQ ID NO: 145373
  derived and/or modified sequence opt3 from neuraminidase__InfluenzaA__AGG13976

SEQ ID NO: 145407 - RNA, 1410 nt, Artificial Sequence; identical to SEQ ID NO: 145373
  derived and/or modified sequence opt3 from neuraminidase__InfluenzaA__AGG13988

SEQ ID NO: 145408 - RNA, 1410 nt, Artificial Sequence; identical to SEQ ID NO: 145373
  derived and/or modified sequence opt3 from neuraminidase__InfluenzaA__AGG14000

SEQ ID NO: 145409 - RNA, 1410 nt, Artificial Sequence; identical to SEQ ID NO: 145373
  derived and/or modified sequence opt3 from neuraminidase__InfluenzaA__AGG14012

SEQ ID NO: 145410 - RNA, 1410 nt, Artificial Sequence; identical to SEQ ID NO: 145391
  derived and/or modified sequence opt3 from neuraminidase__InfluenzaA__AGG14024

SEQ ID NO: 145411 - RNA, 1410 nt, Artificial Sequence
  derived and/or modified sequence opt3 from neuraminidase__InfluenzaA__AGG14036
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagacauucugcggacgcaggagagcgaaugugugugcauaaacggcacuugugcugucgugaugacagauggcucugcauccgggaaggccgacaccaaaauccucuuuauugaggagggaaagaucgugcauacuucaacauuaagcgguagugcucaacacgucgaagagugcucuugcuauccucgcuacccaggcguuagaugugugugcagggauaacuggaagggguccaaucggccgauaguagacauuaacaucaaagaccacagcaucgugucgucuuacauguguuccggacuggucggcgauacgccccgcaagaaugacucaaguagcuccggucauugccuugauccuaacaaugaagaagggggacacggcgugaaaggcugggccuucgacgaugggaacgacguuuggaugggacgaaccauuaaugagaccucuagauuggguuaugagacauuuaaggugaucgagggcuggagcaacccaaaaucaaagcugcagauuaauaggcaggucauaguggaucgggggaaccguaguggauacuccggcaucuucagcguagaagguaaaaauuguauuaaccgcugcuuuuauguugagcuaaucagagggaggaaggaagagacugaagugcucuggaccucuaauucaaucgucguguucuguggcacaaguggaacuuacggcaccgggagcuggcccgacggagcggaucugaaccuuaugccuauuuga

SEQ ID NO: 145412 - RNA, 1410 nt, Artificial Sequence; identical to SEQ ID NO: 145391
  derived and/or modified sequence opt3 from neuraminidase__InfluenzaA__AGG14321

SEQ ID NO: 145413 - RNA, 1410 nt, Artificial Sequence; identical to SEQ ID NO: 144162
  derived and/or modified sequence opt3 from neuraminidase__InfluenzaA__AGG14333

SEQ ID NO: 145414 - RNA, 1410 nt, Artificial Sequence; identical to SEQ ID NO: 143803
  derived and/or modified sequence opt3 from neuraminidase__InfluenzaA__AGG84182

SEQ ID NO: 145415 - RNA, 1398 nt, Artificial Sequence
  derived and/or modified sequence opt3 from neuraminidase__InfluenzaA__AGJ51955
augaaccccaaucagaagauccugugcaccagcgccacagcuauuauaaucggcgcaauugccgugcucaucgggauugcgaaccuuggacugaauaucgguuugcacuuaaaaccuggcuguaacugcucccauucucaaccagagacuacgaauaccucacagacaauaaucaacaauuacuauaacgaaacuaauauuaccaacauccagauggaggaaagaacaaguaggaauuucaacaaucugaccaaggggcuauguacuauuaacagcuggcacaucuacggaaaagacaaugcuguccggauaggcgaguccucugauguucucgugacacgcgaaccguauguaucgugcgaccccgaugagugucgauuuuacgcccugucacaggguaccacgauucgugggaagcauagcaacggaacuauccacgacagaagucaauauagggcacuuauuuccuggccucugucuagcccacccaccguguacaacucccgggucgagugcaucggcuggucaaguacaagcugucaugauggcaaaucucgcauguccaucugcauuucagggccuaauaacaaugccagcgcugugguuugguauaacagaaggccaguggcagaaauaaauacuugggcccggaacaucuugcgcacccaggagagugaaugugucugccacaauggagugugucccguaguuuucacagacgguucugcuaccggcccugccgauacgcgaauuuacuacuuuaaggaggggaagauccucaaaugggagucccugacuggaacagcgaagcacauagaagagugcagcugcuauggcgaaagaaccgguauuacuuguacaugcagggacaacuggcaggggucgaaucggccagugauccagaucgauccggucgcaaugacccauacgucucaauacauuuguucccccgugcugaccgacaacccucguccaaaugaucccaacaucggaaaaugcaaugacccuuauccaggcaacaauaacaacggcgugaagggguucucauaccucgauggagccaauacaugguuaggucgcacuauuaguaccgcuagcagauccggcuaugagaugcugaaaguccccaacgcccuuacagacgacaggucuaagccgauacaggggcagacuaucguuuugaaugcagauuggagcggauacucaggcaguuuuauggacuauugggcugaaggugauuguuaccgggccugcuucuacguggagcugauucgagggcgcccuaaggaggacaaaguacuauggaccggcgauuccaucgugagcauguguucuucaacagaauuucucggacaguggaacuggcccgacggcgcgaagaucgaguauuuccuguga

SEQ ID NO: 145416 - RNA, 1398 nt, Artificial Sequence
  derived and/or modified sequence opt3 from neuraminidase__InfluenzaA__AGJ72863
augaaccccaaucagaagauccugugcaccagcgccacagcuauuauaaucggcgcaauugccgugcucaucgggauugcgaaccuuggacugaauaucgguuugcacuuaaaaccuggcuguaacugcucccauucucaaccagagacuacgaauaccucacagacaauaaucaacaauuacuauaacgaaacuaauauuaccaacauccagauggaggaaagaacaaguaggaauuucaacaaucugaccaaggggcuauguacuauuaacagcuggcacaucuacggaaaagacaaugcuguccggauaggcgaguccucugauguucucgugacacgcgaaccguauguaucgugcgaccccgaugagugucgauuuuacgcccugucacaggguaccacgauucgugggaagcauagcaacggaacuauccacgacagaagucaauauagggcacuuauuuccuggccucugucuagcccacccaccguguacaacucccgggucgagugcaucggcuggucaaguacaagcugucaugauggcaaaucucgcauguccaucugcauuucagggccuaauaacaaugccagcgcugugguuugguauaacagaaggccaguggcagaaauaaauacuugggcccggaacaucuugcgcacccaggagagugaaugugucugccacaauggagugugucccguaguuuucacagacgguucugcuaccggcccugccgauacgcgaauuuacuacuuuaaggaggggaagauccucaaaugggagucccugacuggaacagcgaagcacauagaagagugcagcugcuauggcgaaagaaccgguauuacuuguacaugcagggacaacuggcaggggucgaaucggccagugauccagaucgauccggucgcaaugacccauacgucucaauacauuuguucccccgugcugaccgacaacccucguccaaaugaucccaacaucggaaaaugcaaugacccuuauccaggcaacaauaacaacggcgugaagggguucucauaccucgauggagccaauacaugguuaggucgcacuauuaguaccgcuagcagauccggcuaugagaugcugaaaguccccaacgcccuuacagacgacaggucuaagccgauacaggggcagacuaucguuuugaaugcagauuggagcggauacucaggcaguuuuauggacuauugggcugaaggugauuguuaccgggccugcuucuacguggagguaauucgagggcgcccuaaggaggacaaaguguggugggcgggcaacuccaucgucagcauguguucuucaaccgaauuucugggacaguggaauuggcccgauggcgccaagaucgaguauuuccuauga

SEQ ID NO: 145417 - RNA, 1410 nt, Artificial Sequence
  derived and/or modified sequence opt3 from neuraminidase__InfluenzaA__AGJ73328
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacucaucauugugcccugugaguggaugggcgauauacuccaaggacaauucuguuagaauuggcagcaaaggugauguguuugucaucagggagccauucauuuccuguucaccguuagaaugccggaccuuuuuccugacacagggggcucuacucaacgacaagcauaguaauggaaccaucaaagaucgcagccccuaucgaacucugaugucuuguccuaucggcgaggugccaucccccuacaacucacguuuugaaagcguagccuggagugcaucugccugccacgacggcauuaacuggcuuacaauagggaucuccggaccugauagcggugcuguugcagugcugaaguauaauggcauuaucaccgacacgauaaagucguggagaaacaauauuuugaggacucaagagucugagugugccugcgucaacggguccuguuucaccaucaugacagauggaccaucagacggccaggcuaguuacaaaaucuuucggauugaaaaggguaaaaucgucaagagcguggagaugaaugcccccaacuaucauuacgaagagugcuccuguuacccugauucuagcgagauuacuugcgugugccgcgacaauuggcacgggucaaacagaccauggguuaguuucaaucagaaccucgaauaucagauaggauacaucuguuccggcauuuuuggcgauaauccgaggcccaacgacaaaaccgggagcugcggaccugugucuucaaauggugcgaacggcguaaagggguucaguuuuaaguauggaaauggcguguggaucggucggacaaaaagcaucuccucucgcaagggguucgagaugauuugggauccaaacggcuggaacggaaccgacaauaacuuuucgauaaaacaagacaucgucggcauuaaugaauggagcggguacuccggaucauucgugcagcaucccgagcugacgggucuggauuguauccgaccuugcuucuggguugaacucauuagaggcaggccaaaggagaacacuaucuggacaagugggucuagcauauccuuuuguggagugaauagcgacaccgucggcuggagcuggcccgauggugcagaguuaccguucacuaucgacaaauga

SEQ ID NO: 145418 - RNA, 1410 nt, Artificial Sequence; identical to SEQ ID NO: 142273
  derived and/or modified sequence opt3 from neuraminidase__InfluenzaA__AGJ73330

SEQ ID NO: 145419 - RNA, 1410 nt, Artificial Sequence
  derived and/or modified sequence opt3 from neuraminidase__InfluenzaA__AGJ73332
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucauaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaggacaucauuggcaucaaugaauggucuggguacucggggagcuucguccaacaccccgagcugacuggucuggauuguauucgaccuugcuucuggguggaacucaucagaggcaggccaaaagagaacacaauauggaccuccgggucaaguaucucuuuuuguggaguuaauagcgacacugugggcugguccuggcccgauggugcagaguuaccguucacaauugacaaguga

SEQ ID NO: 145420 - RNA, 1410 nt, Artificial Sequence; identical to SEQ ID NO: 142273
  derived and/or modified sequence opt3 from neuraminidase__InfluenzaA__AGJ73334

SEQ ID NO: 145421 - RNA, 1410 nt, Artificial Sequence; identical to SEQ ID NO: 142273
  derived and/or modified sequence opt3 from neuraminidase__InfluenzaA__AGJ73336

SEQ ID NO: 145422 - RNA, 1410 nt, Artificial Sequence; identical to SEQ ID NO: 142273
  derived and/or modified sequence opt3 from neuraminidase__InfluenzaA__AGJ73338

SEQ ID NO: 145423 - RNA, 1410 nt, Artificial Sequence
  derived and/or modified sequence opt3 from neuraminidase__InfluenzaA__AGJ73340
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacucauccuugugcccugcgaguggaugggcuauauacuccaaggacaauucuauuagaaucggcagcaaaggugauguguuuguuauuagggagccauucaucuccuguucaccguuagaaugccggaccuuuuuccugacacagggggcccuacucaacgacaagcauaguaauggaaccaucaaagaucgcagccccuaucgaacucugaugucuuguccuauuggcgaggugccaucccccuacaacucacguuuugaaagcgucgcauggagugccucugcuugccacgacggcauaaacuggcuuacaaucgggauuuccggaccugauaauggugcaguggccguacugaaguauaacggcaucauaaccgacacgauuaagagcuggagaaauaacaucuugaggacucaagagucggagugugcuugcguuaaugggucuuguuucaccaucaugacagauggaccauccgacggccaggccucauacaaaauuuuucggaucgaaaaggguaaaauugugaagagugucgagaugaacgcgcccaauuaucauuacgaagagugcagcuguuacccugauuccucugagauaacuugcgugugccgcgacaacuggcacgggagcaauagaccaugggugucauucaaccagaaucucgaauaucagaucggauacauuuguaguggcaucuuuggcgauaacccgaggcccaaugacaaaaccggguccugcggaccugucagcucuaacggugcaaauggcguuaagggguucucauuuaaguauggaaacggcguguggaucggucggacaaaaaguauuagcucccgcaagggguucgagaugauaugggauccaaacggcuggaccggaacggacaauaacuuuucuaucaaacaagacauuguaggcaucaaugaauggucgggguacagcggauccuucgugcagcaucccgagcugacuggucuggauuguauucgaccuugcuucugggucgaacucaucagaggcaggccaaaggagaacacaauauggaccucagggaguucuaucagcuuuuguggagugaauagcgacacuguuggcuggucauggcccgauggugccgaguuaccguucacaauugacaaauga

SEQ ID NO: 145424 - RNA, 1410 nt, Artificial Sequence
  derived and/or modified sequence opt3 from neuraminidase__InfluenzaA__AGJ73342
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucggucggacaaaaaguauuagcucccgcaagggguucgagaugauaugggauccaaacggcuggaccggaacggacaauaacuuuucuaucaaacaagacauugugggcaucaaugaauggucgggguacagcggauccuucguccagcaucccgagcugacuggucuggauuguauucgaccuugcuucuggguggaacucaucagaggcaggccaaaggagaacacaauauggaccucagggaguucuaucagcuuuuguggaguuaauuccggcacuguggguuggucauggcccgacggggcagaguuaccguucacaauugauaaauga

SEQ ID NO: 145425 - RNA, 1410 nt, Artificial Sequence; identical to SEQ ID NO: 142725
  derived and/or modified sequence opt3 from neuraminidase__InfluenzaA__AGJ73344

SEQ ID NO: 145426 - RNA, 1410 nt, Artificial Sequence
  derived and/or modified sequence opt3 from neuraminidase__InfluenzaA__AGJ73346
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagaaauguaaccaaagugucauuacuuacgaaaauaacacguggguuaaucagaccuaugugaacaucagcaauacaaacuucgcugcaggccaguccguagugucugucaagcuggccggaaauucgucauugugcccugugagcggaugggcgauauacaguaaagacaacuccauuagaaucggcucuaagggugauguuuuugugauuagggagccauucaucagcuguuccccguuagaaugccggaccuuuuuccugacucagggggcucuacucaaugacaaacauucaaacggaacaaucaaggaucgcagucccuaucgaacccugaugagcuguccuauuggcgaggucccaucucccuacaacucccguuuugaaucaguggccuggagcgcaagugccugccacgacggcauaaauuggcuuacuaucgggauuucuggaccugauaacggugcuguagcaguucugaaguauaauggcaucauaacagacaccauuaaauccuggagaaacaauaucuugaggacgcaagagagcgagugugccugcgugaacgggucguguuucacuaucaugaccgauggaccaucugacggccaggcuuccuacaagauuuuucggaucgaaaaagguaagauugucaaaucaguggagaugaaugcccccaacuaucauuacgaagagugcaguuguuacccugauagcuccgagauaacaugcgugugccgcgacaauuggcacgggucuaacagaccaugggucagcuucaaucagaaccucgaauaucagaucggauacauuuguucaggcaucuuuggcgauaauccgaggcccaacgacaagacugggaguugcggaccuguuuccagcaauggugcgaacggcgugaagggguucucuuuuaaauauggaaacggcguauggaucggucggaccaagucaauuaguagccgcaaaggguucgagaugauaugggauccaaauggcuggacaggaaccgacaacaauuuuuccaucaagcaagacauugugggcaucaacgaauggucuggguacucggggagcuucguccagcaucccgagcugacgggucuggauuguauucgaccuugcuucuggguggaacucaucagaggcaggccaaaagaguccacuauauggacaucagggaguucuaucagcuuuuguggaguuaauuccgacaccgugggcuggucauggcccgauggugcagaguuaccguucacuauugacaaguga

SEQ ID NO: 145427 - RNA, 1410 nt, Artificial Sequence
  derived and/or modified sequence opt3 from neuraminidase__InfluenzaA__AGJ73348
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguaauaucugugaaacuggccggaaauucgucauugugcccugucagcggaugggcgauuuacaguaaggacaacuccaucagaauuggcucuaaaggugauguguuuguuaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggugccaucucccuacaacucccguuuugaaucagucgccuggagcgcaagugccugccacgacggcaucaauuggcuuacaauugggaucucuggaccugauaacggugcuguggcaguacugaaguauaauggcauaauuaccgacacgaucaaguccuggagaaacaauaucuugaggacucaagagagcgagugugccugcguuaacgggucguguuucaccauuaugacagauggaccaucugacggccaggcuuccuacaaaaucuuucggauugaaaaggguaaaauagugaagucagucgagaugaaugcccccaacuaucauuacgaagagugcaguuguuacccugauagcuccgagaucacuugcgugugccgcgacaauuggcacgggucuaacagaccaugggugagcuucaaucagaaccucgaauaucagauuggauacaucuguucaggcaucuuuggcgauaauccgaggcccaacgacaaaaccgggaguugcggaccugucuccagcaauggugcgaacggcguuaagggguucucuuuuaaguauggaaacggcguguggauuggucggacaaaaucaauaaguagccgcaagggguucgagaugaucugggauccaaauggcuggaccggaacggacaacaauuuuuccauuaaacaagacaucguaggcauuaacgaauggucuggguacucggggagcuucgugcagcaucccgagcugacuggucuggauuguauccgaccuugcuucugggucgaacucauaagaggcaggccaaaggagaauacaaucuggaccuccgggucaaguauuucuuuuuguggagugaacagcgacacuguuggcugguccuggcccgauggugcagaguuaccguucacaaucgacaaauga

SEQ ID NO: 145428 - RNA, 1410 nt, Artificial Sequence
  derived and/or modified sequence opt3 from neuraminidase__InfluenzaA__AGJ73350
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacgagcauucaaacggaaccaucaaggaucgcagucccuaucgaacucugaugagcuguccuauuggcgaagucccaucucccuacaacucccguuuugagucaguggccuggagcgcaagugccugccacgacggcauaaauuggcuuacaaucgggauuucuggaccugauaacggugcuguagcaguucugaaauauaauggcaucauaaccgacacgauuaaguccuggagaaacaauaucuugaggacucaagagagcgaaugugccugcgugaacgggucguguuucaccaucaugacagauggaccaucugacggccaggcuuccuacaagauuuuucggaucgagaaagguaagauugucaaaucaguggugaugaaugcccccaacuaucauuacgaagagugcaguuguuacccugauagcuccgagauaacuugcgucugccgcgacaauuggcacgggucuaacagaccauggguuagcuucaaucagaaccucgaauaucagaucggauacauuuguucaggcaucuuuggcgauaauccgaggcccaacgacaagaccgggaguugcggaccuguguccagcaauggugcgaacggcguaaaaggguucucuuuuaaguauggaaacggcguguggaucggucggacaaagucaauuaguagccgcaaaggguucgagaugauaugggauccaaauggcuggaccggaacggacaacaauuuuuccaucaagcaagacauugucggcaucaacgaauggucuggguacucggggagcuucgugcagcaucccgagcugacuggucuggauuguauucgaccuugcuucuggguugaacucaucagaggcaggccaaaagagaauacaauauggaccuccgggucaaguaucucuuuuuguggagugaacagcgacacugucggcugguccuggcccgauggugcagaguuaccguucacaauugacaaguga

SEQ ID NO: 145429 - RNA, 1410 nt, Artificial Sequence
  derived and/or modified sequence opt3 from neuraminidase__InfluenzaA__AGJ73352
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacugguggggaacagcucauugugcccuguuaguggaugggccauauacuccaaggacaauucuauuagaaucggcagcaaaggugauguguuugucauuagggagccauucaucuccuguucaccguuagaaugccggaccuuuuuccugacacagggggcgcuacucaacgacaagcauaguaauggaaccaucaaagaucgcagccccuaucgaacucugaugucuuguccuauuggcgaggugccaucccccuacaacucacguuuugaaagcguagcuuggagugccucugcaugccacgacggcauaaacuggcuuacaaucgggauuuccggaccugauaauggugccguugcugugcugaaguauaacggcaucauaaccgacacgauuaagagcuggagaaauaacaucuugaggacucaagagucggagugugcaugcgucaaugggucuuguuucaccaucaugacagauggaccauccgacggccaggccucauacaaaauuuuucggaucgaaaaggguaaaauugugaagaguguggagaugaacgcucccaauuaucauuacgaagagugcagcuguuacccugauuccucugagauaacuugcgucugccgcgacaacuggcacgggagcaauagaccauggguuucauucaaccagaaucucgaauaucagaucggauacauuuguaguggcaucuuuggcgauuccccgaggcccaacgacaaaaccgggagcugcggaccugugucuucaaauggugccaacggcguaaagggguucaguuuuaaguauggaaauggcguguggaucggucggacaaaaagcauuuccucucgcaagggguucgagaugauaugggauccaaacggcuggaccggaacggacaacaauuuuucgaucaaacaagacauugucggcaucaacgaauggagcggguacuccggaucauucgugcagcaucccgagcugacuggucuggauuguauucgaccuugcuucuggguugaacucaucagaggcaggccaaaggagaauacaauauggaccagugggucuagcaucuccuuuuguggagugaacucagacacugucggcuggagcuggcccgauggugcggaguuaccguucacaauugacaaauga

SEQ ID NO: 145430 - RNA, 1410 nt, Artificial Sequence; identical to SEQ ID NO: 142725
  derived and/or modified sequence opt3 from neuraminidase__InfluenzaA__AGJ73354

SEQ ID NO: 145431 - RNA, 1410 nt, Artificial Sequence
  derived and/or modified sequence opt3 from neuraminidase__InfluenzaA__AGJ73356
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauauuucaauaucuccaacacuaauuuugcugcaggccagucugugguaucggugaaacuggccgggaacucauccuugugcccugucaguggaugggcgauauacuccaaggacaauucuauuagaaucggcagcaaaggugauguguucguuauuagggagccauuuaucuccuguucaccguuagaaugccggaccuucuuucugacacagggggcucuacucaacgacaagcauaguaauggaaccaucaaagaucgcagccccuaucgaacucugaugucuuguccuauuggcgaggugccaucccccuacaacucacguuucgaaagcgucgccuggagugcaucugccugccacgacggcauaaacuggcuuacaaucgggauuuccggaccugauaauggugcuguggcaguacugaaguauaacggcaucauaaccgacacgauuaagagcuggagaaauaacaucuugaggacucaagagucggagugugccugcguuaaugggucuuguuuuaccaucaugacagauggaccauccgacggccaggcuucauacaaaauuuuccggaucgaaaaggguaaaauugugaagagugucgagaugaacgcccccaauuaucauuacgaagagugcagcuguuacccugauuccucugagauaacuugcgugugccgcgacaacuggcacgggagcaauagaccaugggugucauuuaaccagaaucucgaauaucagaucggauacauuuguaguggcaucuucggcgauaacccgaggcccaaugacaaaaccggguccugcggaccugucagcucuaacggugcgaauggcguuaagggguuuucauucaaguauggaaacggcguguggaucggucggacaaaaaguauuagcucccgcaagggguuugagaugauaugggauccaaacggcuggaccggaacggacaauaacuucucuaucaaacaagacauuguaggcaucaaugaauggucgggguacagcggauccuucgugcagcaucccgagcugacuggucuggauuguauucgaccuugcuuuugggucgaacucaucagaggcaggccaaaggagaacacaauauggaccucagggaguucuaucagcuucuguggagugaauagcgacacuguuggcuggucauggcccgauggugcagaguuaccguuuacaauugacaaauga

SEQ ID NO: 145432 - RNA, 1410 nt, Artificial Sequence; identical to SEQ ID NO: 142725
  derived and/or modified sequence opt3 from neuraminidase__InfluenzaA__AGJ73358

SEQ ID NO: 145433 - RNA, 1410 nt, Artificial Sequence; identical to SEQ ID NO: 142725
  derived and/or modified sequence opt3 from neuraminidase__InfluenzaA__AGJ73360

SEQ ID NO: 145434 - RNA, 1410 nt, Artificial Sequence
  derived and/or modified sequence opt3 from neuraminidase__InfluenzaA__AGJ73362
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugacggccagucuguagugucggucaaacuggcagggaacagcucauugugcccugugaguggaugggccauauacuccaaggauaauucuauuagaaucggcagcaaaggugacguuuuugugauuagggagccauucaucuccuguucaccguuagaaugccggaccuuuuuccugacacagggggcgcuacucaacgauaagcauaguaauggaaccaucaaagaccgcagccccuaucgaacucugaugucuuguccuauuggcgaggucccaucccccuacaacucacguuuugaaagcguggcuuggagugccucugcaugccacgauggcauaaacuggcuuacaaucgggauuuccggaccugacaauggugccguagcuguucugaaguauaacggcaucauaaccgauacgauuaagagcuggagaaauaacaucuugaggacucaagagucggagugugcaugcgugaaugggucuuguuucaccaucaugacagacggaccauccgauggccaggccucauacaaaauuuuucggaucgaaaaggguaaaauugucaagaguguggagaugaacgcucccaauuaucauuacgaagagugcagcuguuacccugacuccucugagauaacuugcgugugccgcgauaacuggcacgggagcaauagaccaugggucucauucaaccagaaucucgaauaucagaucggauacauuuguaguggcaucuuuggcgacaacccgaggcccaaugauaaaaccggguccugcggaccuguuagcucuaacggugccaauggcgugaagggguucucauuuaaguauggaaacggcguauggaucggucggacaaaaaguauuagcucccgcaagggguucgagaugauaugggacccaaacggcuggaccggaacggacaauaacuuuucuaucaaacaagauauugugggcaucaaugaauggucgggguacagcggauccuucguccagcaucccgagcugacuggucuggacuguauucgaccuugcuucuggguggaacucaucagaggcaggccaaaggagaacacaauauggaccucagggaguucuaucagcuuuuguggaguuaauuccgauacugugggcuggucauggcccgacggugcggaguuaccguucacaauugauaaauga

SEQ ID NO: 145435 - RNA, 1410 nt, Artificial Sequence; identical to SEQ ID NO: 143848
  derived and/or modified sequence opt3 from neuraminidase__InfluenzaA__AGJ73364

SEQ ID NO: 145436 - RNA, 1410 nt, Artificial Sequence; identical to SEQ ID NO: 142725
  derived and/or modified sequence opt3 from neuraminidase__InfluenzaA__AGJ73366

SEQ ID NO: 145437 - RNA, 1410 nt, Artificial Sequence; identical to SEQ ID NO: 142273
  derived and/or modified sequence opt3 from neuraminidase__InfluenzaA__AGJ73370

SEQ ID NO: 145438 - RNA, 1410 nt, Artificial Sequence
  derived and/or modified sequence opt3 from neuraminidase__InfluenzaA__AGJ73372
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucauaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcaagggguucgagaugauaugggauccaaauggcuggaccggaacggacaacaauuuuuccaucaaacaggacauugugggcaucaacgaauggucuggguacucggggagcuucguccaacaccccgagcugacuggucuggauuguauucgaccuugcuucuggguggaacucaucagaggcaggccaaaggagaauacaauauggaccuccgggucaaguaucucuuuuuguggaguuaacagcgacacugugggcugguccuggcccgauggugcagaguuaccguucacaauugacaaauga

SEQ ID NO: 145439 - RNA, 1410 nt, Artificial Sequence; identical to SEQ ID NO: 142273
  derived and/or modified sequence opt3 from neuraminidase__InfluenzaA__AGJ73374

SEQ ID NO: 145440 - RNA, 1410 nt, Artificial Sequence
  derived and/or modified sequence opt3 from neuraminidase__InfluenzaA__AGJ73376
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacaguagcuugugcccugugaguggaugggcgauauacuccaaggacaauucuguuagaauuggcagcaaaggugauguguuugucaucagggagccauucauuuccuguucaccguuagaaugccggaccuuuuuccugacacagggggcucuacucaacgacaagcauaguaauggaaccaucaaagaucgcagccccuaucgaacucugaugucuuguccuaucggcgaggugccaucccccuacaacucacguuuugaaagcguagccuggagugcaucugccugccacgacggcauuaacuggcuuacaauagggaucuccggaccugauagcggugcuguugcagugcugaaguauaauggcauuaucaccgacacgauaaagucguggagaaacaauauuuugaggacucaagagucugagugugccugcgucaacggguccuguuucaccaucaugacagauggaccaucagacggccaggcuaguuacaaaauccuccggauugaaaaggguaaaaucgucaagagcguggagaugaaugcccccaacuaucauuacgaagagugcuccuguuacccugauucuagcgagauuacuugcgugugccgcgacaauuggcacgggucaaacagaccauggguuaguuuuaaucagaaccuggaauaucagauaggauacaucuguuccggcauuuucggcgauaauccgaggcccaacgacaaaaccgggagcugcggaccugugucuucaaauggugcgaacggcguaaagggguuuaguuucaaguauggaaauggcguguggaucggucggacaaaaagcaucuccucucgcaagggguuugagaugauuugggauccaaacggcuggaccggaacggacaacaauuucucgacuaaacaagacauagucggcaucaacgaauggagcggguacuccggaucauuugugcagcaucccgagcugacaggucucgauuguauucgaccuugcuucuggguugaauuaaucagaggcaggccaaaggagaauaccauuuggacuucagggucuagcaucuccuucuguggagugaacucagacacagucggcuggagcuggcccgauggugcagagcugccguuuaccauagacaaauga

SEQ ID NO: 145441 - RNA, 1410 nt, Artificial Sequence
  derived and/or modified sequence opt3 from neuraminidase__InfluenzaA__AGJ73379
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuguuagaauuggcagcaaaggugauguguuugucaucagggagccauucauuuccuguucaccguuagaaugccggaccuuuuuccugacacagggggcucuacucaacgacaagcauaguaauggaaccaucaaagaucgcagccccuaucgaacucugaugucuuguccuaucggcgaggugccaucccccuacaacucacguuuugaaagcguagccuggagugcaucugccugccacgacggcauuaacuggcuuacaauagggaucuccggaccugauagcggugcuguugcagugcugaaguauaauggcauuaucaccgacacgauaaagucguggagaaacaauauuuugaggacucaagagucugagugugccugcgucaacggguccuguuucaccaucaugacagauggaccaucagacggccaggcuaguuacaaaaucuuucggauugaaaaggguaaaaucgugaagucaguggagaugaaugcccccaacuaucauuacgaagagugcuccuguuacccugauucuagcgagauuacuugcgucugccgcgacaauuggcacgggucaaacagaccauggguuaguuucaaucagaaccucgaauaucagauaggauacaucuguuccggcauuuuuggcgauaauccgaggcccaacgacaaaaccgggagcugcggaccugugucuucaaauggugcgaacggcguaaagggguucaguuuuaaguauggaaauggcguguggaucggucggacaaaaagcaucuccucucgcaagggguucgagaugauuugggauccaaacggcuggaccggaacggacaacaauuuuucgauaaaacaagacaucauuggcaucaacgaauggagcggguacuccggaucauucguccagcaucccgagcugacuggucuggauuguauucgaccuugcuucuggguggaacucaucagaggcaggccaaaggagaauacaauauggaccagugggucuagcaucuccuuuuguggaguuaacucagacacugugggcuggagcuggcccgauggugcagaguuaccguucacaauugacaaauga

SEQ ID NO: 145442 - RNA, 1410 nt, Artificial Sequence
  derived and/or modified sequence opt3 from neuraminidase__InfluenzaA__AGJ73381
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuguuagaauuggcagcaaaggugauguguuugucaucagggagccauucauuuccuguucaccguuagaaugccggaccuuuuuccugacacagggggcucuacucaacgacgagcauaguaauggaaccaucaaggaucgcagccccuaucgaacucugaugucuuguccuaucggcgaagugccaucccccuacaacucacguuuugagagcguagccuggagugcaucugccugccacgacggcauuaacuggcuuacaauagggaucuccggaccugauagcggugcuguugcagugcugaaauauaauggcauuaucaccgacacgauaaagucguggagaaacaauauuuugaggacucaagagucugaaugugccugcgucaacggguccuguuucaccaucaugacagauggaccaucagacggccaggcuaguuacaagaucuuucggauugagaaagguaagaucgugaaaagcguggaaaugaaugcccccaacuaucauuacgaggagugcuccuguuacccugauucuagcgaaauuacuugcgucugccgcgacaauuggcacgggucaaacagaccauggguuaguuucaaucagaaccucgaguaucagauaggauacaucuguuccggcauuuuuggcgauaauccgaggcccaacgacaagaccgggagcugcggaccugugucuucaaauggugcgaacggcguaaaaggguucaguuuuaaguauggaaauggcguguggaucggucggacaaagagcaucuccucucgcaaaggguucgaaaugauuugggauccaaacggcuggaccggaacggacaacaauuuuucgauaaagcaagacaucgucggcauuaacgaguggagcggguacuccggaucauucgugcagcaucccgaacugacuggucuggauuguauccgaccuugcuucuggguugagcucauuagaggcaggccaaaagagaauacaaucuggaccagugggucuagcauauccuuuuguggagugaacucagacacugucggcuggagcuggcccgauggugcagaauuaccguucacaaucgacaaguga

SEQ ID NO: 145443 - RNA, 1410 nt, Artificial Sequence
  derived and/or modified sequence opt3 from neuraminidase__InfluenzaA__AGK62992
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccauuaaugagacaagcagacuuggauaugagacuuuuaaggucaucgaagguuggucaaaccccaaaaguaaguugcagauuaauaggcaagugauaguagaccggggcgaucguuccggguacagcggaaucuucucuguugaggugaaaucauguauuaaccgcugcuuuuaugucgaacugaucagaggcaggaaggaggaaaccgaggugcuauggacaaguaauagcaucgucguguucugugguacuuccgggaccuacggcacaggaucuuggccugacggcgccgauauuaaccucaugccaauauga

SEQ ID NO: 145444 - RNA, 1410 nt, Artificial Sequence
  derived and/or modified sequence opt3 from neuraminidase__InfluenzaA__AGK62996
augaaccccaaucagaagaucauuaccauaggcagcgugucccugaucauuucuacaaucugcuucuuuaugcagauugccauccucauaacuacggucacccuucacuucaaacaguacgaguuuaacucaccuccaaauaaccagguuaugcugugugaaccgacaaucauugagagaaauaucacugaaauuguguauuugaccaacacaaccaucgagaaggaaauaugccccaaaccugcugaguacaggaauuggaguaagccacagugugacauuacuggguucgcacccuuuagcaaagauaacuccauccgguuaucugccggaggugacauuuggguaacacgcgagccuuaugugucgugcgauccagacaaguguuaccaauucgcgcugggccaggggaccacgcuaaauaacguccauucaaauaacacugugcgagaucguacccccuauagaacacuccugaugaaugaacuuggaguuccuuuucaccugggcacuaaacaggugugcaucgcuuggagcaguuccucuugucaugacgguaaggccugguugcacgucugcaucaccggggaugacaagaacgcaacagccagcuucauuuacaauggaaggcucguggauuccguaguuucauggaguaaagagauacugcggacccaggaaagcgagugugugugcaucaacggcacguguacugucgugaugacagacggcucugcuuccgggaaggcagauaccaaaauucuguuuaucgaggaaggaaagauagugcauacuucaacacucagcgguagugcccaacacgucgaggaaugcucuugcuauccacgcuacccgggcguuagaugugugugcagggacaacuggaagggguccaaucggcccauuguagauaucaacaucaaagaccacagcauugugucgucuuacgucuguuccggauuagugggcgacaccccucgcaagaaugauucaaguagcuccucucauugccuggacccaaacaaugaggaaggugggcacggaguuaaaggcugggcuuucgaugacggcaacgauguguggauggggcgaacgaucaaugagaccagcagacuuggauaugagacauuuaaggucauugaagguuggucaaaccccaaaaguaaguugcagauaaauaggcaagugaucguagaccggggcgaucguuccggguacagcggaauuuucucuguugagucaaaaaguuguaucaaccgcugcuuuuauguggaacugaucagaggcaggaaggaggaaacugagguccuauggaccagcaauuccauuguggucuucugugguacaucugggacuuacggcaccggaucguggccugacggcgccgauauaaaccucaugccaaucuga

SEQ ID NO: 145445 - RNA, 1410 nt, Artificial Sequence
  derived and/or modified sequence opt3 from neuraminidase__InfluenzaA__AGK62998
augaaccccaaucagaagaucauuaccauaggcagcgugucccugacaaucgccacuauuugcuucuuuaugcaaaucgcuauucucaucacgaccgucacacuucacuucaaacagugugaguuuaacucuccuccaaauaaccagguuaugcugugcgaaccgacuauaaucgagagaaauauuaccgaaaucguguacuugacaaacaccacuauugagaaggaaaucugucccaaauuagcagaguauaggaauuggucaaagccucagugcgacauaacaggguucgccccauuuaguaaagauaacagcauucggcuguccgcgggaggugacaucuggguaacccgcgagcccuacgugucuugugauccugacaagugcuaucaauucgcucuaggccaggggacgacucucaauaacguccauucgaauaacaccgugcgagaucguacaccauacagaacucugcuuaugaaugaacugggaguucccuuucacuugggcaccaaacagguguguauggccuggucaagcaguuccugccaugacgguaaggcauggcuccacgucuguauuacaggggaugacaagaacgccaccgcuucuuucaucuauaauggaaggcugguggauagcguaguuuccuggucaaaagagauccugcggacgcaggaaagugagugcguguguauuaacggcacuugcacagucgugaugaccgacggcagcgcaucugggaaggccgauacuaaaauacucuuuaucgaggaaggaaagauugugcauacauccaccuuaucagguagcgcucaacacgucgaggaaugcaguuguuacccucgcuauccaggcguuagaugcguguguagggacaacuggaaggggucuaaucggccgaucguagauauaaacauuaaagaccacuccaucgugagcucguacgucugcucuggacugcuuggcgacacgccccgcaagaaugauuccucaaguagcucccauuguuuggacccuaacaaugaggaaggugggcacggagugaaaggcugggccuucgaugacggcaacgauguuuggauggggcgaaccaucucugaaaagagcagacugggauacgagacauuuaaagugauugaggguuggucaaauccaaagaguaaacuacagaucaacaggcaggucauuguggaccggggcgaucguuccggguauagcggaauauucucuguagagucaaagaguugcaucaaucgcuguuuuuacguugaacucauuagaggcaggaaggaggaaacugaggugcuguggaccagcaacuccaucgucguguucugcgguacaucugggacuuauggcaccggaucguggcccgacggcgcggauaucaaucuuaugccuauuuga

SEQ ID NO: 145446 - RNA, 1410 nt, Artificial Sequence
  derived and/or modified sequence opt3 from neuraminidase__InfluenzaA__AGK63000
augaaccccaaucagaagaucauuaccauaggcagcgugucccugacaaucgccacuauuugcuucuuuaugcaaaucgcuauucucaucacgaccgucacacuucacuucaaacagugugacuuuaacucuccuccaaauaaccagguuaugcugugcgagccgacuauaaucgaaagaaauauuaccgagaucguguacuugacaaacaccacuauugaaaaggagaucugucccaaauuagcagaauauaggaauuggucaaagccucagugcgauauaacaggguucgccccauuuaguaaagacaacagcauucggcuguccgcgggaggugauaucuggguaacccgcgagcccuacgugucuugugacccugauaagugcuaucaauucgcucuaggccaggggacgacucucaauaacguccauucgaauaacaccgugcgagaccguacaccauacagaacucugcuuaugaaugagcugggaguucccuuucacuugggcaccaaacagguguguauggccuggucaagcaguuccugccaugaugguaaggcauggcuccacgucuguauuacaggggacgauaagaacgccaccgcuucuuucaucuauaauggaaaacugguggacagcguaguuuccuggucaaaggaaauccugaggacgcaggagagugaaugcguguguauuaacggcacuugcacagucgugaugaccgauggcagcgcaucugggaaagccgacacuaagauacucuuuaucgaggagggaaagauugugcauacauccaccuuaucagguagcgcucaacacgucgaagagugcaguuguuacccucgguauccaggcguucgcugcguguguagagauaacuggaaagggucuaauaggccgaucguagacauaaacauuaaggaccacuccaucgugagcucguacgucugcucuggacuggugggcgauacgccccggaaaaaugacuccucaaguagcucccauugucuugauccuaacaaugaagagggugggcacggaguuaagggcugggccuucgacgauggcaacgacguguggauggggcgcaccaucaaugaaacaucucgauugggauacgagacuuuuaaagucauugaggguuggagcaacccaaagucaaaacugcagaucaauagacaggugauuguagauaggggcgaccggaguggguauuccggaauauucagcguugaaggcaagucuugcaucaaccguuguuuuuacguggagcuaauucgcgguagaaaggaagagaccgaaguccucuggacaucaaauaguaucguggucuucugcgggacuagcggcaccuauggaacaggcuccuggcccgauggggcggacaucaaccugaugccuauuuga

SEQ ID NO: 145447 - RNA, 1410 nt, Artificial Sequence
  derived and/or modified sequence opt3 from neuraminidase__InfluenzaA__AGK63002
augaaccccaaucagaagaucauuaccauaggcagcgugucccugacaaucucuacuauuugcuucuuuaugcagaucgccauucucaugacgaccgucacacuucacuucaaacagugugaguuuaacucaccuccaaauaaccagguuaugcugugcgaaccgacuaucauagagagaaauaucaccgaaauuguguacuugacaaacaccacuaucgagaaggaaauuugucccaaauuagcugaguauaggaauuggaguaagccucagugcgacaucacaggguucgcaccauuuagcaaagauaacuccauacggcugucugccggaggugacauuuggguaacccgcgagcccuacgugucgugugauccugacaagugcuaucaauucgcgcuaggccaggggacgacucucaauaacguccauucaaauaacaccgugcgagaucguacaccauacagaacucugcuuaugaaugaacugggaguucccuuucacuugggcaccaaacagguguguauggcuuggagcaguuccucuugccaugacgguaaggccuggcuccacgucuguaucacagggaacgauaagaaugcaaccgccagcuucauuuauaacggaaggcugguggacuccguaguuucauggaguaaagagauccugcggacgcaggaaagcgagugcguguguaucaacggcacuugcacagucgugaugaccgauggcucugcuuccgggaaggcagacacuaaaauucucuuuauagaggaaggaaagaucgugcauacaucaaccuuaagcgguagugcccaacacgucgaggaaugcucuuguuacccucgcuauccaggcguuagaugcguguguagggauaauuggaagggguccaaccggccgauuguagacaucaauauaaaagaucacagcauugugucgucuuacgucugcuccggacuggugggcgacacgccccgcaagaacgacucaaguagcuccucucauugucuugauccuaauaacgaggaaggugggcacggaguuaaaggcugggcuuucgacgauggcaaugacguguggauggggcgaaccaucacagagacuagcagauugggauacgagaccuuuaaggucaucgaagguuggucaaacccaaaaaguaagcugcagauuaauaggcaagugaucguagaucggggcgaccguuccggguauagcggaauuuucucuguugagggcaaaucaugcauaaaccgcuguuuuuacguggaacuaaucagagguaggaaggaggaaacagagguccucuggaccaguaauagcauuguggucuucugcgggacuuccggcacauauggaaccggcucuuggcccgauggggccgacaucaaccugaugccuaucuga

SEQ ID NO: 145448 - RNA, 1410 nt, Artificial Sequence
  derived and/or modified sequence opt3 from neuraminidase__InfluenzaA__AGK63004
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguaguucucaacacgucgaggaaugcuccugcuauccacgcuacccgggcguuagaugugugugcagggacaacuggaaggggagcaaucggcccauaguagauauuaacaucaaagaccacucgaucgugucuuccuacgucuguucaggauuagugggcgacacgccucgcaagaaugauaguagcuccucuagccauugccuggacccaaacaaugaggaaggugggcacggaguuaaaggcugggccuucgaugacggcaacgauguguggauggggcgaaccauuaaugagacaucaagacuuggauaugagacuuuuaaggucaucgaagguuggaguaaccccaaauccaaguugcagauuaauaggcaagugauaguagaccggggcgaucguagcggguacucuggaaucuucucaguugagggcaaaaguuguauuaaccgcugcuuuuauguggaacugaucagagguaggaaggaggaaaccgagguccuauggacaagcaauuccaucguggucuucugugggacuucuggcaccuacggaacaggcucguggccugacggggcugauauuaaccucaugccaauauga

SEQ ID NO: 145449 - RNA, 1410 nt, Artificial Sequence
  derived and/or modified sequence opt3 from neuraminidase__InfluenzaA__AGK63006
augaaccccaaucagaagaucauuaccauaggcagcgugucccugacaaucgccacuauuugcuucuuuaugcagaucgcuauucucaucacgaccgucacacuucacuucaaacaguacgaguuuaacucuccuccaaauaaccagguuaugcugugugaaccgacuauaaucgagagaaauauuaccgaaaucguguauuugacaaacaccacuauugagaaggaaaucugccccaaaccugcagaguacaggaauuggucaaagccacagugugacauaacaggguucgcccccuuuaguaaagauaacagcauucgguuauccgcgggaggugacaucuggguaacccgcgagccuuaugugucuugcgauccagacaaguguuaccaauucgcucugggccaggggacgacucuaaauaacguccauucgaauaacaccgugcgagaucguacacccuauagaacucuccugaugaaugaacuuggaguuccuuuucaccugggcaccaaacaggugugcauugccuggucaagcaguuccugucaugacgguaaggcaugguugcacgucugcaucacaggggaugacaagaacgccaccgcuucuuucaucuacaauggaaggcucguggauagcguaguuuccuggucaaaagagauucugcggacgcaggaaagugagugugugugcauaaacggcacuuguacagucgugaugaccgacggcagcgcaucugccaaggcugauacuaaaauccuguuuauugaggaagggaagaucgugcauacauccacccucucaggaagcgcccaacacgucgaggaaugcaguugcuauccacgcuacucugguguuagaugugugugcagggacaacuggaagggcuccaaucggccgauaguagauauuaacaucaaagaccacagcaucgugucgucuuacgucuguuccggguuagugggagacacgccccgcaagaaugauucaaguagcuccucucauugccuggacccuaacaaugaggaaggcggucacgggguuaaaggaugggcguucgaugacggcaacgauguguggaugggccgaaccauuaaugagacaagcagacuuggguaugagacuuuuaaggucaucgaaggauggucaaacccaaaaagucaguugcagauuaauaggcaagugauaguagaccggggugaucguuccggcuacagcgggaucuucucuguugagucaaagaguuguauuaaccgcugcuuuuauguggaacugaucagaggaaggaaagaggaaaccgagguccuauggacaagcaauuccaucguggucuucuguggcacuucugguaccuacgggacaggcucguggcccgacggagcagauauuaaccucaugccuauauga

SEQ ID NO: 145450 - RNA, 1410 nt, Artificial Sequence
  derived and/or modified sequence opt3 from neuraminidase__InfluenzaA__AGK63008
augaaccccaaucagaagaucauuaccauaggcagcgugucccugacaaucgccacuauuugcuucuuuaugcaaaucgcuauucucaucacgaccgucacacuucacuucaaacagugugaguuuaacucuccuccaaauaaccagguuaugcugugcgaaccgacuauaaucgagagaaauauuaccgaaaucguguacuugacaaacaccacuauugagaaggaaaucugucccaaauuagcagaguauaggaauuggucaaagccucagugcgacauaacaggguucgccccauuuaguaaagauaacagcauucggcuguccgcgggaggugacaucuggguaacccgcgagcccuacgugucuugugauccugacaagugcuaucaauucgcucuaggccaggggacgacucucaauaacguccauucgaauaacaccgugcgagaucguacaccauacagaacucugcuuaugaaugaacugggaguucccuuucacuugggcaccaaacagguguguauggccuggucaagcaguuccugccaugacgguaaggcauggcuccacgucuguauuacaggggaugacaagaacgccaccgcuucuuucaucuauaauggaaaacugguggauagcguaguuuccuggucaaaggagauccugaggacgcaggaaagugagugcguguguauuaacggcacuugcacagucgugaugaccgacggcagcgcaucugggaaagccgauacuaagauacucuuuaucgaggaaggaaagauugugcauacauccaccuuaucagguagcgcucaacacgucgaggaaugcaguuguuacccucgguauccaggcguucgcugcguguguagagacaacuggaaagggucuaauaggccgaucguagauauaaacauuaaggaccacuccaucgugagcucguacgucugcucuggacuggugggcgacacgccccggaaaaaugauuccucaaguagcucccauugucuugacccuaacaaugaggaaggugggcacggaguuaagggcugggccuucgaugacggcaacgauguguggauggggcgcaccaucaaugagacaucucgauugggauacgagacuuuuaaagucauugaagguuggagcaacccaaagucaaaacugcagaugaauagacaggugaucguagacaggggcgaucggaguggguauuccggaauuuucagcguugagggcaagucuugcauaaaccguuguuuuuacguggaacuaauccgcgguagaaaggaggaaaccgagguccucuggacaucaaauaguauuguggucuucugcgggacuagcggcaccuauggaacaggcuccuggcccgacggggcggauaucaaccugaugccuaucuga

SEQ ID NO: 145451 - RNA, 1410 nt, Artificial Sequence
  derived and/or modified sequence opt3 from neuraminidase__InfluenzaA__AGK63010
augaaccccaaucagaagaucauuaccauaggcagcgugucccugacaaucgccacuauuugcuucuuuaugcaaaucgcuauucucaucacgaccgucacacuucacuucaaacagugugaguuuaacucuccuccaaauaaccagguuaugcugugcgaaccgacuauaaucgagagaaauauuaccgaaaucguguacuugacaaacaccacuauugagaaggaaaucugucccaaauuagcagaguauaggaauuggucaaagccucagugcgacauaacaggguucgccccauuuaguaaagauaacagcauucggcuguccgcgggaggugacaucuggguaacccgcgagcccuacgugucuugugauccugacaagugcuaucaauucgcucuaggccaggggacgacucucaauaacguccauucgaauaacaccgugcgagaucguacaccauacagaacucugcuuaugaaugaacugggaguucccuuucacuugggcaccaaacagguguguauggccuggucaagcaguuccugccaugacgguaaggcauggcuccacgucuguauuacaggggaugacaagaacgccaccgcuucuuucaucuauaauggaaaacugguggauagcguaguuuccuggucaaaggagauccugaggacgcaggaaagugagugcguguguauuaacggcacuugcacagucgugaugaccgacggcagcgcaucugggaaagccgauacuaagauacucuuuaucgaggaaggaaagauugugcauacauccaccuuaucagguagcgcucaacacgucgaggaaugcaguuguuacccucgguauccaggcguucgcugcguguguagagacaacuggaaagggucuaauaggccgaucguagauauaaacauuaaggaccacuccaucgugagcucguacgucugcucuggacuggugggcgacacgccccggaaaaaugauuccucaaguagcucccauugucuugacccuaacaaugaggaaggugggcacggaguuaagggcugggccuucgaugacggcaacgauguguggauggggcgcaccaucaaugagacaucucgauugggauacgagacuuuuaaagucauugaagguuggagcgacccaaagucaaaacugcagaucaacagacaggugauuguagauaggggcgaccggaguggguauuccggaauauucagcguugagggcaagucuugcaucaaucguuguuuuuacguggaacuaauucgcgguagaaaggaggaaaccgagguccucuggacaucaaacaguaucguggucuucugcgggacuagcggcaccuauggaacaggcuccuggcccgauggggcggacaucaaucugaugccuauuuga

SEQ ID NO: 145452 - RNA, 1410 nt, Artificial Sequence
  derived and/or modified sequence opt3 from neuraminidase__InfluenzaA__AGK63012
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccauuaaugagacaagcagacuuggauaugagacuuuuaaggucaucgaagguuggucaaaccccaaaaguaaguugcagauuaauaggcaagugauaguagaccggggcuaccguuccggguauagcggaaucuucucuguugagggcaaaucauguauuaaccgcugcuuuuacguggaucugaucagagguaggaaggaagagaccgaaguccuauggacaaguaauagcaucguggucuucugugggacuuccggcaccuauggaacaggcucuuggccugacggggccgauauuaaccucaugccaauauga

SEQ ID NO: 145453 - RNA, 1410 nt, Artificial Sequence
  derived and/or modified sequence opt3 from neuraminidase__InfluenzaA__AGK63014
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuuccacugggcaccaaacaggugugcauugcuuggagcaguuccucuugucacgacgguaaggccugguugcaugucugcaucacaggggaugacaagaacgcaaccgccagcuucaucuacaauggaaggcucguggauuccguaguuucauggaguaaagagauucaccggacgcaggaaagcgagugugugugcauaaacggcacuuguacagucgugaugaccgacggcucugcuuccgggaaggcagauacuaaaauccuguuuauugaggaaggaaagaucgugcauacaucaacccugagcgguagugcccaacacgucgaggaaugcucuugcuauccgcgcuaccccggcguuagaugugugugcagggacaacuggaagggguccaaucggccuauaguagauauuaacaucaaagaccacagcaucgugucgucuuacgucuguuccggacucgugggcgacacgccacgcaagaaugauucaaguagcuccucucauugcuuagaccccaacaaugaggaaggugggcacggaguuaaaggcugggcuuucgaugacggcaacgauguguggauggggcgaaccauuagcgagaagucaagacugggauaugagacauuuaaagucaucgaagguuggaguaauccuaaguccaaacuucagauuaacaggcaagugauaguagaccggggcaaucguagcggguacucuggaaucuucucaguugagggcaagaguuguauuaaccgcugcuuuuauguggaauugaucagagguaggaaggaggaaacugagguccuguggaccagcaauuccaucguggucuucugugggacaucuggcacuuacggaaccggcucguggccagauggggccgacauuaaccuaaugcccauauga

SEQ ID NO: 145454 - RNA, 1410 nt, Artificial Sequence
  derived and/or modified sequence opt3 from neuraminidase__InfluenzaA__AGK63018
augaaccccaaucagaagaucauuaccauaggcagcgugucccugacaaucucuacuauuugcuucuuuaugcaaaucgccauucucaucacgaccgucacacuucacuucaaacagugugaguuuaacucaccuccaaauaaccagguuaugcugugcgaaccgacuauaaucgagagaaauauuaccgaaaucguguacuugacaaacaccacuauugagaaggaaaucugucccaaauuagcugaguauaggaauuggaguaagccucagugcgacauaacaggguucgcaccauuuagcaaagauaacuccauucggcugucugccggaggugacaucuggguaacccgcgagcccuacgugucgugugauccugacaagugcuaucaauucgcgcuaggccaggggacgacucucaauaacguccauucaaauaacaccgugcgagaucguacaccauacagaacucugcuuaugaaugaacugggaguucccuuucacuugggcaccaaacagguguguauggcuuggagcaguuccucuugccaugacgguaaggccuggcuccacgucuguauuacaggggaugacaagaacgcaaccgccagcuucaucuauaauggaaaacugguggauuccguaguuucauggaguaaggagauccugaggacgcaggaaagcgagugcguguguauuaacggcacuugcacagucgugaugaccgacggcucugcuuccgggaaagcagauacuaagauacucuuuaucgaggaaggaaagauugugcauacaucaaccuuaagcgguagugcccaacacgucgaggaaugcucuuguuacccucgguauccaggcguucgcugcguguguagagacaacuggaaaggguccaauaggccgaucguagauauaaacauuaaggaccacagcaucgugucgucuuacgucugcuccggacuggugggcgacacgccccggaaaaaugauucaaguagcuccucucauugucuugacccuaacaaugaggaaggugggcacggaguuaagggcugggcuuucgaugacggcaacgauguguggauggggcgcaccaucaaugagacaagccgauugggauacgagacuuuuaaagucauugaagguuggucaaacccaaagaguaaacugcagaucaauagacaggugauuguagacaggggcgaucgguccggguauagcggaauauucucuguugagggcaagucaugcaucaaccguuguuuuuacguggaacuaauucgcgguagaaaggaggaaaccgagguccucuggacaaguaauagcaucguggucuucugcgggacuuccggcaccuauggaacaggcucuuggcccgacggggccgauaucaaccugaugccuauuuga

SEQ ID NO: 145455 - RNA, 1410 nt, Artificial Sequence
  derived and/or modified sequence opt3 from neuraminidase__InfluenzaA__AGK63020
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccauuaaugagacaagcagacuuggauaugagacuuuuaaggucaucgaagguuggucaaaccccaaaaguaaguugcagauuaauaggcaagugauaguagaccggggcgaucguuccggguacagcggaaucuucucuguugagggcaaaucauguauuaaccgcugcuuuuauguggaacugaucagagguaggaaggaggaaaccgagguccuauggacaaguaauagcaucguggucuucugugggacuuccggcaccuacggaacaggcucuuggccugacggggccgauauuaaccucaugccaauauga

SEQ ID NO: 145456 - RNA, 1410 nt, Artificial Sequence
  derived and/or modified sequence opt3 from neuraminidase__InfluenzaA__AGK63022
augaaccccaaucagaagaucauuaccauaggcagcgugucccugacaaucucuacuauuugcuucuuuaugcaaaucgccauucucaucacgaccgucacacuucacuucaaacagugugaguuuaacucaccuccaaauaaccagguuaugcugugcgaaccgacuauaaucgagagaaauauuaccgaaaucguguacuugacaaacaccacuauugagaaggaaaucugucccaaauuagcugaguauaggaauuggaguaagccucagugcgacauaacaggguucgcaccauuuagcaaagauaacuccauucggcugucugccggaggugacaucuggguaacccgcgagcccuacgugucgugugauccugacaagugcuaucaauucgcgcuaggccaggggacgacucucaauaacguccauucaaauaacaccgugcgagaucguacaccauacagaacucugcuuaugaaugaacugggaguucccuuucacuugggcaccaaacagguguguauggcuuggagcaguuccucuugccaugacgguaaggccuggcuccacgucuguauuacaggggaugacaagaacgcaaccgccagcuucaucuauaauggaaaacugguggauuccguaguuucauggaguaaggagauccugaggacgcaggaaagcgagugcguguguauuaacggcacuugcacagucgugaugaccgacggcucugcuuccgggaaagcagauacuaagauacucuuuaucgaggaaggaaagauugugcauacaucaaccuuaagcgguagugcccaacacgucgaggaaugcucuuguuacccucgguauccaggcguucgcugcguguguagagacaacuggaaaggguccaauaggccgaucguagauauaaacauuaaggaccacagcaucgugucgucuuacgucugcuccggacuggugggcgacacgccccggaaaaaugauucaaguagcuccucucauugucuugacccuaacaaugaggaaggugggcacggaguuaagggcugggcuuucgaugacggcaacgauguguggauggggcgcaccaucaaugagacaagccgauugggauacgagacuuuuaaagucauugaagguuggucaaacccaaagaguaaacugcagaucaauagacaggugauuguagacaggggcgaucgguccggguauagcggaauauucucuguugagggcaagucaugcaucaaccguuguuuuuacguggaccuaauucgcgguagaaaggaagagaccgaaguccucuggacaaguaauagcaucguggucuucugcgggacuuccggcaccuauggaacaggcucuuggcccgauggggccgacaucaaccugaugccuauuuga

SEQ ID NO: 145457 - RNA, 1410 nt, Artificial Sequence; identical to SEQ ID NO: 145455
  derived and/or modified sequence opt3 from neuraminidase__InfluenzaA__AGK63024

SEQ ID NO: 145458 - RNA, 1410 nt, Artificial Sequence; identical to SEQ ID NO: 145455
  derived and/or modified sequence opt3 from neuraminidase__InfluenzaA__AGK63026

SEQ ID NO: 145459 - RNA, 1410 nt, Artificial Sequence
  derived and/or modified sequence opt3 from neuraminidase__InfluenzaA__AGK63028
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauaagaccgaaauuguguauuugacaaacaccacuaucgagaaagaaauuugccccaagccugcugaguacaggaauuggaguaaaccacagugugacaucacaggguucgcacccuuuagcaaggauaacuccauacgguuaucugccggaggugacauuuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcaucgcuuggagcaguuccucuugucaugacgguaaggccugguugcacgucugcauuacaggggaugacaaaaacgcaaccgccagcuucaucuacaauggaaggcucguggauuccguaguuucauggaguaaggagauccugcggacgcaggaaagcgagugugugugcauuaacggcacuuguacagucgugaugaccgacggcucugcuuccgggaaagcagauacuaagauacuguuuaucgaggaaggaaaggugguccauacaucaacccucagcgguagugcccaacacguugaggaaugcucuugcuauccacgcuacccgggcgugagauguguaugcagggacaacuggaaaggguccaaucggcccauuguggauaucaacauaaaggaccacagcauugucucgucuuacguguguuccggauuaguuggcgacacgccucgcaaaaaugauucaaguagcuccucucauugccuggacccaaacaaugaggaaggugggcacggagugaagggcugggcuuucgaugacggcaacgaugucuggauggggcgaaccaucaaugagacaagcagacuuggauaugagacuuuuaaagugaucgaagguuggucaaaccccaagaguaaauugcagauuaauaggcagguaaucguugaccggggcgaucguuccggguacagcggaauuuucucuguggaggccaagucauguauaauccgcugcuuuuaugucgaacugauuagaggcaggaaggaggaaaccgaggugcuauggacaaguaacagcaucgucguguucugugguacuuccgggaccuacggcacaggaucuuggccugacggcgcggauaucaaucucaugccaauuuga

SEQ ID NO: 145460 - RNA, 1410 nt, Artificial Sequence; identical to SEQ ID NO: 145454
  derived and/or modified sequence opt3 from neuraminidase__InfluenzaA__AGK63030

SEQ ID NO: 145461 - RNA, 1410 nt, Artificial Sequence
  derived and/or modified sequence opt3 from neuraminidase__InfluenzaA__AGK63032
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauggcuuggagcaguuccucuugucaugacgguaaggccuggcuccacgucugcauuacaggggaugacaagaacgcaaccgccagcuucaucuacaauggaaaacugguggauuccguaguuucauggaguaaggagauccugaggacgcaggaaagcgagugugugugcauuaacggcacuuguacagucgugaugaccgacggcucugcuuccgggaaagcagauacuaagauacucuuuaucgaggaaggaaagauugugcauacaucaaccuuaagcgguagugcccaacacgucgaggaaugcucuugcuauccucgguacccaggcguucgcugugugugcagagacaacuggaaaggguccaauaggccgaucguagauauaaacauuaaggaccacagcaucgugucgucuuacgucuguuccggacuggugggcgacacgccccggaaaaaugauucaaguagcuccucucauugccuugacccuaacaaugaggaaggugggcacggaguuaagggcugggcuuucgaugacggcaacgauguguggauggggcgcaccaucacagagacuagccgauugggauaugagaccuuuaaagucauugaagguuggucaaauccaaagaguaaacugcagaucaacagacaggugauuguagacaggggcaaucgguccggguacagcggaauauucucuguugagggcaagucauguaucaaccguugcuuuuauguggaacuaauucgcgguagaaaggaggaaacagagguccucuggaccaguaauagcaucguggucuucugugggacuuccggcacauacggaaccggcucuuggcccgauggggccgacaucaaccugaugccuauuuga

SEQ ID NO: 145462 - RNA, 1410 nt, Artificial Sequence
  derived and/or modified sequence opt3 from neuraminidase__InfluenzaA__AGK63034
augaaccccaaucagaagaucauuaccauaggcagcgugucccugacaaucucuacuauuugcuucuuuaugcaaaucgccauucucaucacgaccgucacacuucacuucaaacagugugaguuuaacucaccuccaaauaaccagguuaugcugugcgaaccgacuauaaucgagagaaauauuaccgaaaucguguacuugacaaacaccacuauugagaaggaaaucugucccaaauuagcugaguauaggaauuggaguaagccucagugcgacauaacaggguucgcaccauuuagcaaagauaacuccauucggcugucugccggaggugacaucuggguaacccgcgagcccuacgugucgugugauccugacaagugcuaucaauucgcgcuaggccaggggacgacucucaauaacguccauucaaauaacaccgugcgagaucguacaccauacagaacucugcuuaugaaugaacugggaguucccuuucacuugggcaccaaacagguguguauggcuuggagcaguuccucuugccaugacgguaaggccuggcuccacgucuguauuacaggggaugacaagaacgcaaccgccagcuucaucuauaauggaaaacugguggauuccguaguuucauggaguaaggagauccugaggacgcaggaaagcgagugcguguguauuaacggcacuugcacagucgugaugaccgacggcucugcuuccgggaaagcagauacuaagauacucuuuaucgaggaaggaaagauugugcauacaucaaccuuaagcgguagugcccaacacgucgaggaaugcucuuguuacccucgguauccaggcguucgcugcguguguagagacaacuggaaaggguccaauaggccgaucguagauauaaacauuaaggugcacagcaucgucucgucuuacgugugcuccggacugguuggcgacacgccccggaaaaaugacucaaguagcuccucucauugucuugauccuaacaaugaggaaggugggcacggagugaagggcugggcuuucgacgauggcaacgacgucuggauggggcgcaccaucaaugagacaagccgauugggauacgagacuuuuaaagugauugaagguuggucaaacccaaagaguaaacugcagaucaauagacagguaauuguugauaggggcgaccgguccggguauagcggaauauucucuguggagggcaagucaugcaucaaccguuguuuuuacgucgaacuaauucgcgguagaaagaaagagaccgaagugcucuggacaaguaauagcaucgucguguucugcgggacuuccggcaccuauggaacaggcucuuggcccgauggggccgacaucaaccugaugccuauuuga

SEQ ID NO: 145463 - RNA, 1410 nt, Artificial Sequence
  derived and/or modified sequence opt3 from neuraminidase__InfluenzaA__AGK63036
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccauuaaugagacaagcagauuuggauaugagacuaucaaggucauugaagguuggucaaaccccaaaaguaaucuucagauaaacaggcaagugaucguagaccggggcaaucguuccggguacagcggaauuuucucuguugagggcaagucauguaucaaccgcugcuuuuauguggaauugaucagagguaggaaagaggaaaccgagguccuguggacaaguaauagcauuguggucuucugugggacuuccggcaccuacggaacaggcucuuggccugauggggccgacauaaaccuaaugccaaucuga

SEQ ID NO: 145464 - RNA, 1410 nt, Artificial Sequence
  derived and/or modified sequence opt3 from neuraminidase__InfluenzaA__AGK63038
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauggcuuggagcaguuccucuugucaugacgguaaggccuggcuccacgucugcauuacaggggaugacaagaacgcaaccgccagcuucaucuacaauggaaaacugguggauuccguaguuucauggaguaaggagauccugaggacgcaggaaagcgagugugugugcauuaacggcacuuguacagucgugaugaccgacggcucugcuuccgggaaagcagauacuaagauacucuuuaucgaggaaggaaagauugugcauacaucaaccuuaagcgguagugcccaacacgucgaggaaugcucuugcuauccucgguacccaggcguucgcugugugugcagagacaacuggaaaggguccaauaggccgaucguagauauaaacauuaaggaccacagcaucgugucgucuuacgucuguuccggacuggugggcgacacgccccggaaaaaugauucaaguagcuccucucauugccuugacccuaacaaugaggaaggugaucacgggguuaagggaugggcuuucgacgauggcaacgacguguggaugggccgcaccaucaaugagacaagccgauugggguaugagacuuuuaaagucauugaaggauggucaaacccaaagaguaaacugcagaucaauagacaggugauuguagauagggguaaccgguccggcuacagcgggauauucucuguugagucaaagaguuguaucaaucguugcuuuuauguggaacuaauucgcggaagaaaggaggaaaccgagguccucuggacaagcaacuccaucguggucuucuguggcacuucugguaccuacgggacaggcucguggcccgacggagccgauaucaaucugaugccuauuuga

SEQ ID NO: 145465 - RNA, 1410 nt, Artificial Sequence
  derived and/or modified sequence opt3 from neuraminidase__InfluenzaA__AGK63040
augaaccccaaucagaagaucauuaccauaggcagcgugucccugacaaucucuacuauuugcuucuuuaugcaaaucgccauucucaucacgaccgucacacuucacuucaaacagugugaguuuaacucaccuccaaauaaccagguuaugcugugcgaaccgacuauaaucgagagaaauauuaccgaaaucguguacuugacaaacaccacuauugagaaggaaaucugucccaaauuagcugaguauaggaauuggaguaagccucagugcaacauaacaggguucgcaccauuuagcaaagacaauuccauucggcugucugccggaggugauaucuggguaacccgcgagcccuacgugucgugugacccugauaagugcuaucaauucgcgcuaggccaggggacgacucucaacaauguccauucaaacaauaccgugcgagaccguacaccauacagaacucugcuuaugaacgaacugggaguucccuuucacuugggcaccaaacagguguguauggcuuggagcaguuccucuugccaugaugguaaggccuggcuccacgucuguauuacaggggacgauaagaaugcaaccgccagcuucaucuauaacggaaaacugguggacuccguaguuucauggaguaaggagauccugaggacgcaggaaagcgagugcguguguauuaacggcacuugcacagucgugaugaccgauggcucugcuuccgggaaagcagacacuaagauacucuuuaucgaggaaggaaagauugugcauacaucaaccuuaagcgguagugcccaacacgucgaggaaugcucuuguuacccucgguauccaggcguucgcugcguguguagagauaauuggaaaggguccaacaggccgaucguagacauaaauauuaaggaucacagcaucgugucgucuuacgucugcuccggacuggugggcgacacgccccggaaaaacgacucaaguagcuccucucauugucuugauccuaauaacgaggaaggugggcacggaguuaagggcugggcuuucgacgauggcaaugacguguggauggggcgcaccaucaacgagacaagccgauugggauacgagacuuuuaaagucauugaagguuggucaaauccaaagaguaaacugcagaucaacagacaggugauuguagauaggggcgaccgguccggguauagcggaauauucucuguugagggcaagucaugcaucaaucguuguuuuuacguggaacuaauucgcgguagaaaggaggaaaccgagguccucuggacaaguaacagcaucguggucuucugcgggacuuccggcaccuauggaacaggcucuuggcccgauggggccgacaucaaucugaugccuauuuga

SEQ ID NO: 145466 - RNA, 1410 nt, Artificial Sequence
  derived and/or modified sequence opt3 from neuraminidase__InfluenzaA__AGK63042
augaaccccaaucagaagaucauuaccauaggcagcgugucccugacaaucucuacuauuugcuucuuuaugcaaaucgccauucucaucacgaccgucacacuucacuucaaacagugugaguuuaacccuccaccgaauaaccagguuaugcugugcgaacccacuauaaucgagagaaauauuaccgaaaucguguacuugacaaacaccacuauugagaaggaaaucuguccuaaauuagcugaguauaggaauuggucaaagccacagugcgacauaacaggguucgcacccuuuaguaaagauaacagcauucggcuguccgccggaggugacaucuggguaacccgcgagccuuacgugucuugugauccagacaagugcuaucaauucgcgcuaggccaggggacgacucucaauaacguccauucgaauaacaccgugcgagaucguacacccuacagaacucugcuuaugaaugaacugggaguuccuuuucacuugggcaccaaacagguguguauggcuuggucaagcaguuccugccaugacgguaaggccuggcuccacgucuguauuacaggggaugacaagaacgcaaccgccucuuucaucuauaauggaaaacugguggauagcguaguuuccuggucaaaggagauccugaggacgcaggaaagugagugcguguguauuaacggcacuugcacagucgugaugaccgacggcagcgcuucugggaaagcagauacuaagauacucuuuaucgaggaaggaaagauugugcauacauccaccuuaucagguagcgcccaacacgucgaggaaugcaguuguuacccacgguauccgggcguucgcugcguguguagagacaacuggaaagggucuaauaggcccaucguagauauaaacauuaaggaccacuccaucgugagcucguacgucugcucuggacuggugggcgacacgccucggaaaaaugauuccucaaguagcucccauugucuugacccaaacaaugaggaaggugggcacggaguuaagggcugggcuuucgaugacggcaacgauguguggauggggcgcaccaucaaugagacaucucgauugggauacgagacuuuuaaagucauugaagguuggagcaaccccaagucaaaacugcagaucaauagacaggugauuguagacaggggcgaucggaguggguauuccggaauauucagcguugagggcaagucuugcaucaaccguuguuuuuacguggaacuaauucgcgguagaaaggaggaaaccgagguccucuggacaucaaauaguaucguggucuucugcgggacuagcggcaccuauggaacaggcuccuggccugacggggccgauaucaaccugaugccaauuuga

SEQ ID NO: 145467 - RNA, 1410 nt, Artificial Sequence
  derived and/or modified sequence opt3 from neuraminidase__InfluenzaA__AGK63044
augaaccccaaucagaagaucauuaccauaggcagcgugucccugacaaucucuacuauuugcuucuuuaugcaaaucgccauucucaucacgaccgucacacuucacuucaaacagugugaguuuaacucaccuccaaauaaccagguuaugcugugcgaaccgacuauaaucgagagaaauauuaccgaaaucguguacuugacaaacaccacuauugagaaggaaaucugucccaaauuagcugaguauaggaauuggaguaagccucagugcgacauaacaggguucgcaccauuuagcaaagauaacuccauucggcugucugccggaggugacaucuggguaacccgcgagcccuacgugucgugugauccugacaagugcuaucaauucgcgcuaggccaggggacgacucucaauaacguccauucaaauaacaccgugcgagaucguacaccauacagaacucugcuuaugaaugaacugggaguucccuuucacuugggcaccaaacagguguguauggcuuggagcaguuccucuugccaugacgguaaggccuggcuccacgucuguauuacaggggaugacaagaacgcaaccgccagcuucaucuauaauggaaaacugguggauuccguaguuucauggaguaaggagauccugaggacgcaggaaagcgagugcguguguauuaacggcacuugcacagucgugaugaccgacggcucugcuuccgggaaagcagauacuaagauacucuuuaucgaggaaggaaagauugugcauacaucaaccuuaagcgguagugcccaacacgucgaggaaugcucuuguuacccucgguauccaggcguucgcugcguguguagagacaacuggaaaggguccaauaggccgaucguagauauaaacauuaaggaccacagcaucgugucgucuuacgucugcuccggacuggugggcgacacgccccggaaaaaugauucaaguagcuccucucauugucuugacccuaacaaugaggaaggugggcacggaguuaagggcugggcuuucgaugacggcaacgauguguggauggggcgcaccaucaaugagacaagccgauugggauacgagacuuuuaaagucauugaagguuggucaaacccaaagaguaaacugcagaucaauagacaggugauuguagacaggggcuaucgguccggguacagcggaauauucucuguugagucaaagaguugcaucaaccguuguuuuuauguggaacuacuccgcggcagaaaggaggaaaccgagguccuguggacaagcaauuccauuguggucuucugcgguacuucugggaccuacggcacaggaucguggcccgauggcgccgacaucaaccuuaugccuaucuga

SEQ ID NO: 145468 - RNA, 1410 nt, Artificial Sequence
  derived and/or modified sequence opt3 from neuraminidase__InfluenzaA__AGK63046
augaaccccaaucagaagaucauuaccauaggcagcgugucccugacaaucucuacuauuugcuucuuuaugcagaucgccauucucaucacgaccgucacacuucacuucaaacauuacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaguucgcgcugggccaagggacgacucuaaauaacguccacucaaauaacaccgugcgagaucguacacccuauagaacucuccugaugaaugaacuuggaguuccuuuucaucugggcaccaaacaggugugcauugcuuggagcaguuccucuugucacgacgguaaggccugguugcaugucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcacacaucaacccucagcgguagugcccagcacgucgaggaaugcucuugcuauccacgcuacccgggcguuagaugugugugcagggacaacuggaagggguccaaucggcccauaguagauauuaacaucaaagaccauagcaucgugucgucuuacgucuguuccggauuagugggcgacacgccucgcaagaaugauucaaguagcuccucucacugccuggacccaaacaaugaggaaggugggcauggaguuaaaggcugggcuuucgaugacggcaacgauguguggauggggcgaaccauuaaugagacaagcagacuuggauaugagacuuuuaaggucaucgaagguuggucaaaccccaaaaguaaguugcaaauuaauaggcaagugauaguagaccggggcgaucguuccggguacagcggaaucuucucuguugagggcaaaucauguauuaaccgcugcuuuuauguggaccugaucagagguaggaaggaagagaccgaaguccuauggacaaguaauagcaucguggucuucugugggacuuccggcaccuacggaacaggcucuuggccugauggggccgacauuaaccucaugccaauauga

SEQ ID NO: 145469 - RNA, 1398 nt, Artificial Sequence
  derived and/or modified sequence opt3 from neuraminidase__InfluenzaA__AGK82159
augaaccccaaucagaagauccugugcaccagcgccacagcuauuauaaucggcgcaauugccgugcucaucgggauugcgaaccuuggacugaauaucgguuugcacuuaaaaccuggcuguaacugcucccauucucaaccagagacuacgaauaccucacagacaauaaucaacaauuacuauaacgaaacuaauauuaccaacauccagauggaggaaagaacaaguaggaauuucaacaaucugaccaaggggcuauguacuauuaacagcuggcacaucuacggaaaagacaaugcuguccggauaggcgaguccucugauguucucgugacacgcgaaccguauguaucgugcgaccccgaugagugucgauuuuacgcccugucacaggguaccacgauucgugggaagcauagcaacgagacuauccacgacagaagucaauauagggcacuuauuuccuggccucugucuagcccacccaccguguacaacucccgggucgaaugcaucggauggucaaguacaagcugucaugauggcaaaucucgcauguccaucugcauuucaggcccuaauaacaaugccagcgcugugguuugguauaacagaaggccaguggcagagauaaauacuugggcccggaacaucuugcgcacccaggaaagugagugugucugccacaauggggugugucccguaguuuucacagacggaucugcuaccgguccugccgauacgcgaauuuacuacuuuaaggagggcaagauccucaaaugggaaucccugacugggacagcgaagcacauagaggaaugcagcugcuauggagagagaaccggcauuacuuguacaugcagggacaacuggcaggguucgaaucggccagugauccagaucgauccggucgcaaugacccauacgucucaauacauuuguucccccgugcugaccgacaacccucguccaaaugaucccaacaucgggaaaugcaaugacccuuauccaggaaacaauaacaacggcgugaagggcuucucauaccucgauggggccaauacaugguuaggacgcacuauuaguaccgcuagcagauccgguuaugaaaugcugaaaguccccaacgcccuuacagacgacaggucuaagccgauacagggccagacuaucguuuugaaugcagauuggagcggguacucaggaaguuuuauggacuauugggcugagggcgauuguuaccgggccugcuucuacguggagcugauucgaggucgcccuaaggaagacaaaguaugguggaccuccaacagcaucgugucuauguguucaaguacagaguuucuagggcaguggaauuggcccgauggcgcgaagaucgaauauuuccucuga

SEQ ID NO: 145470 - RNA, 1398 nt, Artificial Sequence
  derived and/or modified sequence opt3 from neuraminidase__InfluenzaA__AGK84858
augaaccccaaucagaagauccugugcaccagcgccacagcuauuauaaucggcgcaauugccgugcucaucgggauugcgaaccuuggacugaauaucgguuugcacuuaaaaccuggcuguaacugcucccauucucaaccagagacuacgaauaccucacagacaauaaucaacaauuacuauaacgaaacuaauauuaccaacauccagauggaggaaagaacaaguaggaauuucaacaaucugaccaaggggcuauguacuauuaacagcuggcacaucuacggaaaagacaaugcuguccggauaggcgaguccucugauguucucgugacacgcgaaccguauguaucgugcgaccccgaugagugucgauuuuacgcccugucacaggguaccacgauucgugggaagcauagcaacggaacuauccacgacagaagucaauauagggcacuuauuuccuggccucugucuagcccacccaccguguacaacucccgggucgagugcaucggcuggucaaguacaagcugucaugauggcaaaucucgcauguccaucugcauuucagggccuaauaacaaugccagcgcugugguuugguauaacagaaggccaguggcagaaauaaauacuugggcccggaacaucuugcgcacccaggagagugaaugugucugccacaauggagugugucccguaguuuucacagacgguucugcuaccggcccugccgauacgcgaauuuacuacuuuaaggaggggaagauccucaaaugggagucccugacuggaacagcgaagcacauagaagagugcagcugcuauggcgaaagaaccgguauuacuuguacaugcagggacaacuggcaggggucgaaucggccagugauccagaucgauccggucgcaaugacccauacgucucaauacauuuguucccccgugcugaccgacaacccucguccaaaugaucccaacaucggaaaaugcaaugacccuuauccaggcaacaauaacaacggcgugaagggguucucauaccucgauggagccaauacaugguuaggucgcacuauuaguaccgcuagcagauccggcuaugagaugcugaaaguccccaacgcccuuacagacgacaggucuaagccgauacaggggcagacuaucguuuugaaugcagauuggagcggauacucaggcaguuuuauggacuauugggcugaaggugauuguuaccgggccugcuucuacguggagcugauucgagggcgcccuaaggaggacaaaguaugguggaccuccaacagcaucgugucuauguguucaaguacagaauuucuaggccaguggaauuggcccgauggagcgaagaucgaguauuuccucuga

SEQ ID NO: 145471 - RNA, 1398 nt, Artificial Sequence
  derived and/or modified sequence opt3 from neuraminidase__InfluenzaA__AGK84861
augaaccccaaucagaagauccugugcaccagcgccacagcuauuauaaucggcgcaauugccgugcucaucgggauugcgaaccuuggacugaauaucgguuugcacuuaaaaccuuccuguaacugcucucauucacaaccagagacuacgaauaccagucagacaauaaucaacaauuacuauaacgaaacuaauauuaccaacauccagauggaggaaagaacaagcaggaauuucaacaaucugaccaagggccuauguacuauuaacuccuggcacaucuacgggaaagacaaugcuguccggauaggagagucuucggauguucucgugacacgcgaaccguauguaucaugcgaccccgaugagugucgauuuuacgcccugagccagggcaccacgauucgugguaagcauaguaacgggacuauccacgacagaucccaauauagggcacuuauuucuuggccucugagcuccccacccaccguguacaacucacgggucgagugcaucggauggaguagcacaucuugucaugauggcaaaucccgcaugucaaucugcauuagcggcccuaauaacaaugccagugcugugguuugguauaacagaaggccaguggcagaaauaaauacuugggcccggaacaucuugcgcacccaggagucugaaugugucugccacaauggggugugucccguaguuuucacagacggauccgcuaccgguccugccgauacgcgaauuuacuacuuuaaggagggcaagauccucaaaugggagagccugacugggacagcgaagcacauagaagagugcucgugcuauggagaaagaaccggcauuacuuguacaugcagggacaacuggcaggguucuaaucggccagugguccagaucgauccgguggcaaugacccauacgucccaauacaucuguucacccgugcugaccgacaacccucguccaaaugaucccaacauugggaaaugcaaugacccuuauccaggaaucaacaauaacggcgucaagggcuucaguuaccucgauggggccaacacaugguuaggacgcacuauuagcaccgcuuccagaucugguuaugagaugcugaaaguucccaaugcccuuacagacgacaggagcaagccgauacagggccagacuaucguguugaacgcagauuggucaggguacaguggauccuuuauggacuauugggcugaaggcgauuguuaccgggccugcuucuacguagagcugauucgaggucgcccuaaggaggacaaagugugguggaccagcaauucuaucgucucaauguguaguagcacagaauuucuagggcaguggaacuggcccgauggcgcgaagaucgaguauuuccucuga

SEQ ID NO: 145472 - RNA, 1398 nt, Artificial Sequence; identical to SEQ ID NO: 145470
  derived and/or modified sequence opt3 from neuraminidase__InfluenzaA__AGK84864

SEQ ID NO: 145473 - RNA, 1398 nt, Artificial Sequence
  derived and/or modified sequence opt3 from neuraminidase__InfluenzaA__AGL95090
augaaccccaaucagaagauccugugcaccagcgccacagcuauuauaaucggcgcaauugccgugcucaucgggauugcgaaccuuggacugaauaucgguuugcacuuaaaaccuggcuguaacugcucccauucucaaccagagacuacgaauaccucacagacaauaaucaacaauuacuauaacgaaacuaauauuaacaauauccagauggaggaaagaaccaguaggaacuucaauaaccugacaaaggggcuauguaccauuaauagcuggcacaucuacggaaaagacaacgcuguccggauaggcgaguccucugauguucucgugacucgcgaaccguauguaucgugcgaccccgaugagugucgauuuuacgcccugucacaggguacaaccauucgugggaagcauagcaacggaacgauccacgacagaagucaauauagggcacuuauuuccuggccucugucuagcccacccacuguguacaauucccgggucgagugcaucggcuggucaaguaccagcugucaugauggcaaaucucgcauguccaucugcauuucagggccuaacaauaacgccagcgcugugguuugguauaauagaaggccaguggcagaaauaaacacaugggcccggaauaucuugcgcacucaggagagugaaugugucugccacaacggagugugucccguaguuuucaccgacgguucugcuacaggcccugccgauacccgaauuuacuacuuuaaggaggggaagauccucaaaugggagucccugacgggaacugcgaagcacauagaagagugcagcugcuauggcgaaagaacagguauuaccuguacuugcaaagacaauuggcaggggucgaacaggccagugauccagaucgauccggucgcaaugacacauaccucucaauacauuuguucccccgugcugacggacaauccucggccaaacgaucccaauaucggaaagugcaacgacccuuauccaggcaauaacaacaauggcgugaaaggguucucauaccucgauggagccaacaccugguuaggucguacaauuaguacugcuagccgcuccggcuaugagaugcugaagguccccaaugcccuuaccgacgacagaucuaagccgauacaggggcagacaaucguuuugaacgcagauuggagcggauacucaggcaguuuuauggacuauugggcugaaggugauuguuacagggccugcuucuacguggagcugauucgggggcgaccuaaagaggacaagguaugguggacuuccaauagcaucgugucuauguguucaaguaccgaauuucuaggccaguggaacuggcccgauggagcgaaaaucgaguauuuccucuga

SEQ ID NO: 145474 - RNA, 1413 nt, Artificial Sequence; identical to SEQ ID NO: 138648
  derived and/or modified sequence opt3 from neuraminidase__InfluenzaA__AGL96802

SEQ ID NO: 145475 - RNA, 1413 nt, Artificial Sequence; identical to SEQ ID NO: 138648
  derived and/or modified sequence opt3 from neuraminidase__InfluenzaA__AGL96807

SEQ ID NO: 145476 - RNA, 1413 nt, Artificial Sequence
  derived and/or modified sequence opt3 from neuraminidase__InfluenzaA__AGL96808
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuucauuaugaagaguguagcugcuacccagacaccggcaucguuaugugugugugcagggauaacuggcacggcuccaaucggcccugggucucuuucaaccagaaucuggacuaccaaauuggguauaucugcagcggaguguuuggugauaacccucgcccagaggacggcgaagggucauguaauccggugacggucgauggagccaacggcguuaaagguuucaguuacaaguaugacaaugggguguggaucggcagaacuaaauccaacaggcugcggaagggauuugagaugauuugggaccccaauggcuggacaaacaccgauagcuucuuuucuguaaaacaggacguggucgcuauaacugauuggucaggguacagugguagcuucgugcagcacccugaacucacaggauuagacugcauccgcccauguuucuggguugagcuggugcgaggccuucccagagaaaacaccacgauuuggaccuccgggucuucgaucagcuuuugcggagucaauuccgauacagccaacuggucauggccugacggcgcagaguugccauucacuauugauaaguga

SEQ ID NO: 145477 - RNA, 1413 nt, Artificial Sequence
  derived and/or modified sequence opt3 from neuraminidase__InfluenzaA__AGL96809
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaagacagccucauacaaaaucuucaagauugaaaagggaaaaguaaccaagaguauagagcucaacgcgccuaauuuucauuaugaagaguguagcugcuacccagacacgggcaucguuaugugugugugcagggauaacuggcacggcuccaaucggcccugggucucuuucaaccagaaucuggacuaccaaauuggguauaucugcagcggaguguuuggugauaacccucgcccagaggacggcgaagggucauguaauccggugacugucgauggagcaaacggcguuaaagguuucaguuacaaguaugacaaugggguguggaucggcagaacaaaauccaacaggcugcggaagggauuugagaugauuugggaccccaauggcuggaccaacacugauagcgacuucucuguaaaacaggauguggucgccauaacagacuggucaggguacagugguagcuuugugcagcacccugaacucaccggauuagauugcauccgcccauguuucuggguugagcuggugcgaggccuucccagagaaaacacgaccauuuggacauccgggucuucgaucagcuucugcggagucaauuccgacacugcuaacuggucauggccugauggcgccgaguugccauuuaccauugacaaguga

SEQ ID NO: 145478 - RNA, 1413 nt, Artificial Sequence; identical to SEQ ID NO: 138648
  derived and/or modified sequence opt3 from neuraminidase__InfluenzaA__AGL96818

SEQ ID NO: 145479 - RNA, 1413 nt, Artificial Sequence
  derived and/or modified sequence opt3 from neuraminidase__InfluenzaA__AGL96820
augaaccccaaucagaagaucauuaccacaggcagcauauccaucgccauugggaucauuucucugaugcuccaaaucggaaacauaaucucaauuugggcuagucacagcauccagacugguucccagaauaacacgggcauuugcaaucagagaaucauaaccuacgagaacucuacaugggugaaucauacuuaugucaacauuaauaacaccaauguuguggcaggggaagacaaaacaucgguaacccuugccggaaacucaagccuguguaguaucuccggcugggcgauuuacacuaaggauaauucuaucaggaucgguagcaaaggggacguguucgucauucgggagccuuuuauauccugcucacacuuggaaugucgcacauucuuuuuaacccaaggagcucugcuaaacgauaagcauaguaauggcacggugaaagaccgaagcccauaucgugcccucaugucuugcccgcugggcgaggcacccuccccuuacaacucaaaguucgaaagcguugccuggagugcuucugcaugucacgaugggaugggauggcuuacuaucgguauuuccggcccagacaacggggccguggcuguccugaaguauaauggaaucauaaccggcacaauuaaaagcuggaagaaacagaucuugagaacucaggagucggagugcguguguaugaacgguucuugcuuuaccaucaugacagaugggcccuccaauaaggccgcgucauacaaaauuuucaagaucgaaaagggaaaaguaaccaagaguauugagcucaacgcaccuaauuuucauuaugaagaguguagcugcuacccagacacgggcauaguuaugugugugugcagggauaacuggcacggcuccaaucggcccugggucucuuucaaccagaaucuggacuaccaaaucggguauauuugcagcggaguguuuggugauaacccucgcccagaggacggcgaagggucauguaauccggugacugucgauggagccaacggcguuaaagguuucaguuacaaguaugacaaugggguguggaucggcagaacaaaauccaacaggcugcggaagggauuugagaugaucugggaccccaauggcuggaccaacacugauagcgacuucucuguaaaacaggauguggucgcuauuacagacuggucaggguacagugguagcuuugugcagcacccugaacucaccggauuagauugcauacgcccauguuucuggguugagcuggugcgaggccuucccagagaaaacacgaccaucuggacauccgggucuucgauuagcuucugcggagucaauuccgacacugccaacuggucauggccugauggcgcagaguugccauuuaccaucgacaaguga

SEQ ID NO: 145480 - RNA, 1413 nt, Artificial Sequence
  derived and/or modified sequence opt3 from neuraminidase__InfluenzaA__AGL96821
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuucauuaugaagaguguagcugcuacccagacaccggcaucguuaugugugugugcagggauaacuggcacggcuccaaucggcccugggucucuuucaaccagaaucuggacuaccaaauuggguauaucugcagcggaguguuuggugauaacccucgcccagaggacggcgaagggucauguaauccggugagugucgauggagccaacggcguuaaagguuucuccuacaaguaugacaaugggguguggaucggcagaacgaaaagcaacaggcugcggaagggauuugagaugauuugggaccccaauggcuggacuaacacagauucugacuucucaguaaaacaggauguggucgcuauaaccgacuggaguggguacagcggauccuuugugcagcacccugaacucacugguuuagauugcauccgcccauguuucuggguugagcuggugcgaggccuucccagagaaaacacaaccauuuggacgucugggucgagcaucuccuucugcggagucaauucagacaccgccaacuggaguuggccugauggcgcagaguugccauuuacaauugacaaguga

SEQ ID NO: 145481 - RNA, 1410 nt, Artificial Sequence
  derived and/or modified sequence opt3 from neuraminidase__InfluenzaA__AGN69269
augaucaccaaccagagaauuauaacaaucggcacugugugccugauugucgggaucguuagccuccuucugcaaauuggaaauaucguguccuuguggauaucucacucaauccagacgggugagaagaaccauagugaaauuuguaaucagaacaccaucacauacgagaauaacacuuggguaaaucagaccuaugugaacauuagcaauacaaacaucgccgacggccaaggggucaccuccauaauuuuagcuggaaauucuucgcugugccccaucucaggcugggcaauuuacagcaaagauaacaguaucaggaucgguuccaagggggacauuuucgugauacgggaaccuuuuaucucuuguagccaccuagagugccgcacuuucuuucucacacagggagcccugcuuaaugaucgacauuccaacggcaccguuaaagaccguucaccauauagaacgcugaugaguuguccgauuggcgaagcgcccagcccuuacaauucuagguucgaguccguggcuuggucagccagcgcaugccacgaugggaugggauggaucacuauagguauuaguggcccagacaacggggccgucgcuguguugaaguauaacggaaucaucaccgauacaauuaaaucuuggcggaauaagauccuccgcacucaggaguccgaauguguaugcauuaacggcagcuguuuuaccauaaugacagacggucccucgaaugggcaggcaucuuacaagaucuucaaaauggagaagggaaaaauuaucaaguccguugaacuggaugccccuaacuaucauuacgaggagugcucauguuacccagacaccggcaaaguggucugcgugugcagagauaauuggcacgcuaguaacaggcccugggugagcuuugaccaaaaucuggauuaucagaucggcuacauuuguuccggggucuucggagacaacccucggucuaaugacgguaagggcaacugcgggccagcccucagcaauggagcgaacggcguuaaggguuuuucauuccgcuaugggaauggcguguggauaggacgaacgaaaaguaucuccagcagaucuggcuuugaaaugauuugggauccgaacggguggacugagacagacucaaguuucagcaugaagcaggauaucauugcauuaaccgacugguccggauacucugguucguuuguacagcaccccgaacugacuggcaugaauuguaucaggccuugcuucuggguggagcuuauacgggggcaaccaaaagaaagcacaaucuggaccuccggaucaaguauuucuuucuguggcgucgauagcgagacggccuccuggucauggcccgacggugcugauuugccuuuuaccaucgacaaguga

SEQ ID NO: 145482 - RNA, 1410 nt, Artificial Sequence
  derived and/or modified sequence opt3 from neuraminidase__InfluenzaA__AGN69280
augaacaccaaucagagaaucauuacaauaggcacugugugccugaucgucgggauuguuagccuccuucugcaaaucggaaacauuguguccuuguggaucucucacucaauacagacgggugagaagaaucauagugaaaucuguaaccagaauaccauuacauacgagaacaauacuuggguaaaccagaccuaugugaauaucagcaacacaaauauugccgacggccaaggggucaccuccaucauauuagcuggaaacucuucgcugugccccauuucaggcugggcaaucuacagcaaagauaauaguauuaggaucgguuccaagggggacaucuucgugauucgggaaccuuuuauaucuuguagccaccuagagugccgcacuuucuuucucacacagggagcccugcuuaacgaucgacauuccaauggcaccguuaaagaccguucaccauauagaacgcugaugaguuguccgaucggcgaagcgcccagcccuuacaacucuagguucgaguccguggcuuggucagccagcgcaugccacgaugggaugggaugguugacuauugguaucaguggcccagacaacggggccgucgcugugcucaaguauaauggaauaauuaccgauacaaucaaaucuuggcggaacaagauccugcgcacucaggaguccgaauguguaugcauuaauggcagcuguuuuaccaucaugacagacggucccucgaacgggcaggcaucuuacaagauuuucaaaauggagaagggaaaaauaaucaaguccguugaacuggaugccccuaauuaucauuacgaggagugcucauguuacccagacaccggcaaaguggucugcgugugcagagauaacuggcacgcuaguaauaggcccugggugagcuuugaccaaaaccucgauuaucagauuggcuacaucuguuccggggucuucggagacaauccucggucuaacgacgguaagggcaauugcgggccaguuuuaagcaacggagccaauggcgugaaggguuuuucauuccgcuaugggaacggcguauggaucggacgaacgaaaaguauuuccagcagaucuggcuuugaaaugauaugggauccgaauggguggacugagacagacucaaguuucagcaugaagcaggauaucauugcgcugaccgacugguccggauacucugguucguuugugcagcaccccgaacuuacuggcaugaacuguaucaggccuugcuucugggucgaguugauucgggggcaaccaaaagaaagcacaaucuggaccggaggcuccucaauaaguuucugugguguggauucugagacggcaagcugguccuggcccgacggggccgaucugccuuuuaccaucgacaaguga

SEQ ID NO: 145483 - RNA, 1410 nt, Artificial Sequence
  derived and/or modified sequence opt3 from neuraminidase__InfluenzaA__AGN69292
augaaccccaaucagaagaucauuaccauaggcagcaucugcaugacaauugggaucgccucccugauucuccaaaucggaaacauaaucucuauuuggaucucacacaguauucagacugagaaucagaaccagccugaaaucuguaaucaaaacgugauaacguacgagaauaacaccugggucaaucagacauauguuaacauuagcaauacuaacuucguggcugaacaggcaguagccuccgugaaacuugcggguaauucuucgcugugcccagucucaggcugggcuaucuacagcaaggacaacagugugagaauuggguccaaaggagauguuuuugugaucagggagccguucaucucuuguagccauuuggaaugccggaccuuuuucuuaacacagggcgcccugcuaaaugacaagcacuccaacgguaccauuaaagaucgcucacccuaucgaacucucaugaguuguccuauaggggaggucccaagccccuacaacucucguuuugaguccguggcauggucagccagcgcuugccaugacggaacaaguuggcugaccaucggcauuucuggcccugauaauggggcaguagccguucuuaaguauaacggaaucauaacggacacuauuaaguccuggaggaaaaauauccugagaacccaagaaagcgagugugcuugcgugaacgguucguguuucacagucaugacugauggcccaucuaaugggcaggccuccuacaagguguuuaaaaucgaaaagggaaaaguggucaagucaguugaguugaacgcgcccaauuaucacuacgaggaaugcaguuguuacccugagagcggcgaaauuaccugcgugugccgggacaacuggcaugguuccaaucgcccauggguaucuuucaaccagaaucucgaguaucagaugggguacaucuguagcggaauuuuuggcgauaacccgagacccaaugacaagacaggcucaugcgggccuguguucaguaacggagcaaauggugucaaaggcuuuuccuucaaguaugggaacggaguguggauaggcaggaccaaaagcaucucuucacggauggguuuugaaaugauuugggauccagacggguggacgaagacugaugacaaauucaguguuaagcaagacaucaucggcauuaacgauuggagcggauacuccggcucuuucgugcagcaccccgagcugacagggcuggacuguaugcgcccuugcuuuugggucgagcucauacgaggaagaccaaaagaaaauaccaucuggacuucggguagcuccauuucauucuguggcgugaacagugauacaguaggguggucuuggcccgacggagccgaguuaccguuuaccaucgauaaguga

SEQ ID NO: 145484 - RNA, 1410 nt, Artificial Sequence
  derived and/or modified sequence opt3 from neuraminidase__InfluenzaA__AGN69316
augaaccccaaucagaagaucauuaccauaggcagcaucugcaugacaauugggaucgccucccugauucuccaaaucggaaacauaaucucuauuuggaucucacacaguauucagacugagaaucagaaccagccugaaaucuguaaucaaaacgugauaacguacgagaauaacaccugggucaaucagacauauguuaacauuagcaauacuaacuucguggcugaacaggcaguagccuccgugaaacuugcggguaauucuucgcugugcccagucucaggcugggcuaucuacagcaaggacaacagugugagaauuggguccaaaggagauguuuuugugaucagggagccguucaucucuuguagccauuuggaaugccggaccuuuuucuuaacacagggcgcccugcuaaaugacaagcacuccaacgguaccauuaaagaucgcucacccuaucgaacucucaugaguuguccuauaggggaggucccaagccccuacaacucucguuuugaguccguggcauggucagccagcgcuugccaugacggaacaaguuggcugaccaucggcauuucuggcccugauaauggggcaguagccguucuuaaguauaacggaaucauaacggacacuauuaaguccuggaggaaaaauauccugagaacccaagaaagcgagugugcuugcgugaacgguucguguuucacagucaugacugauggcccaucuaaugggcaggccuccuacaagguguuuaaaaucgaaaagggaaaaguggucaagaccguugaguugaacgcgcccaauuaucacuacgaggaaugcucauguuacccugagaguggcgaaauuacaugcgugugccgggacaacuggcaugguagcaaucgcccauggguauccuucaaccagaaucucgaguaucagaugggguacaucuguucuggaauuuuuggcgauaacccgagacccaaugacaagaccggcagcugcgggccuguguucucaaacggagcaaauggugucaaaggcuuuaguuucaaguaugggaacggaguguggauaggcaggacgaaauccaucagcucucggauggguuuugaaaugauuugggauccagacggguggacuaagacagaugacaaauucucaguuaagcaagacaucaucggcauuaacgauuggaguggauacagcggcuccuucgugcagcaccccgagcugaccgggcuggacuguaugcgcccuugcuuuugggucgagcucauacgaggaagaccaaaagaaaauacuaucuggacaucugguucgagcauuuccuucuguggcgugaacucagauaccguaggguggaguuggcccgacggagccgaguuaccguuuacgaucgauaaguga

SEQ ID NO: 145485 - RNA, 1410 nt, Artificial Sequence; identical to SEQ ID NO: 145484
  derived and/or modified sequence opt3 from neuraminidase__InfluenzaA__AGN69328

SEQ ID NO: 145486 - RNA, 1410 nt, Artificial Sequence
  derived and/or modified sequence opt3 from neuraminidase__InfluenzaA__AGN69340
augaaccccaaucagaagaucauuaccauaggccugaucugcaugacaauugggaucgccagccucauucuucaaaucggaaacauaaucuccauuuggaucucucacucaauucagacugagaaucagaacaaaccugaaaucuguaaucagaacgugauaacguacgagaauaacaccugggucaaucaaacauauguuaacgugaguaauacuaacuucguagcugaacaggcaguggccagcgucaagcugguggguaauuccucuuugugcccaguuucgggcugggcgauuuacucaaaagacaacagcgugagaaucgggaguaagggagaugucuuugugauuagggagccguucaucuccuguucucauuuagaaugccggaccuuuuuccugacacagggcgcucuacucaaugacaaacacagcaacgguaccaucaaggaucgcucccccuaucgaacucugaugucauguccuauuggggagguaccaagucccuacaacagccguuuugagucuguugccugguccgcaucagccugccaugacggaacaagcuggcuuaccauaggcaucaguggcccugauaauggggcuguggcaguccugaaguauaacggaauuaucacggacacuauaaaaucuuggagaaagaauauuuugaggacccaggaauccgagugugccugcgugaacgguagcuguuucacagugaugacugauggcccaucgaaugggcaggcuucuuacaaagucuuuaagaucgaacggggaaaaguugugaaguccguagagcucaacgcccccaauuaucacuacgaggaaugcucauguuacccugagaguagcgaaauuaccugcgugugccgcgacaacuggcauggcuccaauagaccaugggucucuuucaaccaaaaucuggaguaucagauggguuacaucuguagcgggguguuuggagauaacccgaggcccaaugacaagacaggcucaugcggcccuguuuucaguaacggggcgaauggagugaaagguuuuuccuucaaguauggcaacggggucuggaucggacggaccaaaagcacgucuucacgcaugggcuuugaaaugauuugggauccagacgguuggacuaagacagaugacaaauucagugugaagcaggacauaaucgggauuaccgauuggagcggcuacuccggaucuuucguacaacaccccgagcugacuggccucgacuguaugcgaccuugcuuuuggguugaguuaaucagagggaggccaaaagaaaacacaaucuggaccucgggaagcuccauuucauucuguggugugaauagugauacggucggcuggucuuggcccgacggggcagagcugccguuuaccauagauaaguga

SEQ ID NO: 145487 - RNA, 1410 nt, Artificial Sequence
  derived and/or modified sequence opt3 from neuraminidase__InfluenzaA__AGO00268
augaaccccaaucagaagaucauuaccauaggcagcaucugcaugguggucgggauuaucucccugauucuccaaaucggaaacauaaucucuauuuggaucucacacaguauucagacagguagccagaaucauacuggcaucuguaaccaguccauaauuacguacaaaaauucuaccuggguuaaccaaacauaugugaauaucucgaacacuaauguaguggccgggaaggacaccacaucaaugauucuugcuggaaacagcagucugugcccuaucagaggcugggcaaucuacuccaaagauaaugguauuaggauagggucuaagggagacgucuucgugauccgggagccauuuauuagcuguucccacuuggaaugccgcaccuucuuuuuaacucagggcgcccugcuaaacgauaaacauucaaauggcacaguuaaggaccgaaguccguaucgugcgcucaugagcugucccgugggggaggcuccuucuccauacaacuccagauucgaaucagucgccuggagcgcaagugccugccacgauggaauggguuggcugaccaucggcauaucugggcccgacgauggagcuguggcaguacuuaaguauaauggcauuaucacggagacuaucaaauccuggaagaaaaagauucugaggacccaggaaagcgaguguguuugcgugaacgguucguguuuuacaaucaugacugacgggccuucugauggaccagccuccuacaaaauuuucaagauagagaagggcaaagucaccaagucaaucgaauuggacgcucccaacagucauuaugaggaaugcagcuguuacccugauacaggcaaagugaugugcgugugccgggacaauuggcacggguccaaccgcccaugggucucuuuugaucagaaucucgacuaccaaauuggauauaucuguagcgguguuuucggcgacaacccgagacccaaggaugggaaaggaucaugcggcccuguguacguagacggugccaauggggugaagggcuuuaguuauagguacggagauggcgucuggaucgggcggaccaaauccaacagcucucgccagggauucgagaugauuugggacccaaaugguuggacggagacugauucaaguuucuuugugaagcaggacguuguggcgaugacagauuggagcggcuauuccgggucuuuuguccagcaccccgaacugaccggacugaacuguaugcgaccuugcuucuggguggagcucauaagaggcaggccaaaggagaaaacuaucuggacaucggguagcuccauuucauucugugggguaaauagugacaccguugauuggucuuggcccgacggcgcagaauuaccguuuacgaucgauaaguga

SEQ ID NO: 145488 - RNA, 1410 nt, Artificial Sequence
  derived and/or modified sequence opt3 from neuraminidase__InfluenzaA__AGO00280
augaaccccaaucagaagaucauuaccauaggcagcaucugcaugguggucgggauuaucucccugauucuccaaaucggaaacauaguuucuaucuggauuucacacaguauccagacagguaaucagaaccauacuggcacguguaaucagagcauuaucaccuacaaaaacuccacaugggugaaucaaacuuauguaaacauaucuaauaccaacguggucgccgggaaggacacaaccucggugauucuugcuggaaauucaagccugugcccuaucagaggcugggcaauuuacaguaaagauaacgguguuaggaucggguccaagggagacguguucgucauccgggagccauuuauuucuuguagccacuuggaaugccgcacuuucuuuuuaacacagggcgcccugcuaaaugauaaacauuccaacggcaccgugaaggaccgaucaccguaucgugcgcucaugaguugucccguaggggaggcuccuagcccauacaauucuagauucgaauccguugccuggucagcaagcgccugccacgauggaauggguuggcugacgauaggcaucagugggcccgacgauggagcuguggcaguccuuaaguauaacggcauuaucacugagaccauaaaaucuuggaggaaggaaauucugcggacacaggaguccgagugugugugcgugaacgguagcuguuuuacuaucaugaccgacgggccuucgggaggcccagccucuuacaaaaucuucaagauugaaaaaggcaaggucacaaaguccaucgaguuggaugcucccaauucacauuaugaagagugcaguuguuacccugacaccagcaaaguuaugugcgugugccgcgauaacuggcacggguccaauagaccauggguaucuuuugaccagaaccucgauuaccaaaugggauauauuuguagcgguguguucggcgacaauccgaggcccaaggacgggaaaggaucaugcggcccugucuacguggauggugccaacgggguuaagggcuuuaguuaucgguacggaaauggcguguggauagggcgcacgaaauccaacagcucucgacagggauucgagaugaucugggacccaaaugguuggacugaaacagauucaaacuuuuucaugaagcaggacgucguggcgguaaccgauuggaguggcuauagcggguccuuuguucagcaccccgagcugacuggacuggacuguaugagaccuugcuucuggguggaacucauuaggggccggccaaaagagaauacaaucuggaccucugguucgagcaucuccuucuguggggucaacucagauacgguggacuggaguuggcccgauggcgcagaauuaccguuuaccauugacaaguga

SEQ ID NO: 145489 - RNA, 1413 nt, Artificial Sequence
  derived and/or modified sequence opt3 from neuraminidase__InfluenzaA__AGO00292
augaaccccaaucagaagaucauuaccauaggcagcaucugcaugacaauugggacuaucucccugauucuccaaaucggaaacauaaucucuauuuggaucucacacaguauucagacggguagccagaaucauaccggcaucuguaaccagagaauaauuacauacgagaauaacacuugggugaaucaaaccuaugucaacaucuccaauacaaacguuguggccgggaaagacaccacuucuaugauucuugcuggaaauucgucacugugcccuaucaggggcugggcaaucuacagcaaggauaacaguauucggauagguuccaaaggggacguauucgugauccgcgaaccauuuauuucuuguagccacuuggagugccgaacauucuuuuuaacccagggagcccugcuaaaugauaagcauuccaacggcacggucaaagaccguucaccguauagagcgcucaugaguugucccaucggcgaagcuccuagcccauacaauucuagguucgaguccguggccuggucagcaagcgccugccacgaugggaugggauggcugacuauagguauuaguggccccgacgauggggcuguugcagugcuuaaguauaacggaaucaucaccgaaauuaucaagucuuggcggaaacagauucugcgcacacaggaguccgagugugucugcgugaacggcagcuguuuuacuauaaugaccgacgguccuucggaugggccagccucuuacagaaucuucaagauugaaaaaggaaagaucacaaaauccaucgaguuggacgcucccaauucacauuaugaagagugcaguuguuacccugauaccggcaagguaaugugcguuugcagggacaacuggcacggcagcaaucggccauggguguccuuuaaccaaaaucucgauuaccagauuggguauauauguucuggagucuucggugacaacccgcgccccaaggacggcaaagggagcugcgauccugugaauguggacggagccgauggcgucaaggguuuuucauaccgauauggggacggcguuuggaucggaagaacgaaaaguaacuccagcaggaagggcuucgagaugauuugggauccaaauggguggacugacacagaugacaacuuucuggugaaacaggauguaguggcgaugaccgacuggucuggauacucagguaguuucguccagcaccccgaacugacuggccucgauuguauccggccuugcuuuuggguggaguuaauucgugggcgcccaagagaaaagacaaccaucuggacgagcggauccucuauaucguucuguggcguuaauagcgacaccgugaacugguccuggcccgacggugcagagcugccguucacaaucgauauguga

SEQ ID NO: 145490 - RNA, 1413 nt, Artificial Sequence
  derived and/or modified sequence opt3 from neuraminidase__InfluenzaA__AGO00304
augaaccccaaucagaagaucauuaccauaggcagcaucugcauggccauugggacaaucucccugauucuccaaaucggaaacauaaucucuauuuggaucucacacaguauucagacugguagccagaaucauacgggcaucuguaaccagagaauaauuaccuacgagaauaacacaugggugaaucaaacuuaugucaacaucuccaauaccaacguuguggcugggaaagacacaaccucuaugauucuugcaggaaauacuucgcugugcccuaucaggggcugggccaucuacucaaaggauaacagcauucggauagguaguaaaggggacguauucgugauccgcgaaccauuuauuuccuguucucacuuggagugccgaacauucuuuuuaacccagggagcgcugcuaaaugauaagcauagcaacggcacggucaaagaccguuccccguauagagcucucaugucaugucccaucggcgaagccccuaguccauacaauagcagguucgagucuguggcaugguccgccucagcuugccacgaugggaugggauggcugacuauagguauuagcggccccgacgauggggcaguugccgugcuuaaguauaacggaaucaucaccgaaauuaucaagaguuggcggaaacagauucugcgcacacaggagucugagugugucugcgugaacggcuccuguuuuacuauaaugaccgacgguccuagcaaugggccagcuucguacagaaucuucaagauugaaaaaggaaagaucacaaaaucuaucgaguuggaugcccccaacucccauuaugaagagugcucauguuacccugacaccggcaagguaaugugcguuugcagggauaauuggcacggcaguaaccggccaugggugagcuuuaaucaaaaccucgacuaccagauuggguauauauguuccggagucuucggugauaauccgcgccccaaggacggcaaagggucuugcgacccugugaacguggauggagcggacggcgucaaggguuuuagcuaccgauaugggaauggcguuuggaucggaagaacgaaaucaaacaguuccaggaagggcuucgagaugauuugggauccaaauggguggacuaacacagacggaaauuuuagcgugaaacaggauguaguggcaaugaccgacuggucugguuacucaggcaguuucguccagcaccccgaacugacugggcuggauuguaugcggccuugcuuuuggguggagcucauccguggacgcccaagagaaaagacaaccauuuggacgagcggcuccucuaucucguucugugguguuaacagcgacaccgugaauugguccuggcccgauggggccgaguuaccguucacaauagacaaauga

SEQ ID NO: 145491 - RNA, 1410 nt, Artificial Sequence; identical to SEQ ID NO: 144560
  derived and/or modified sequence opt3 from neuraminidase__InfluenzaA__AGO00316

SEQ ID NO: 145492 - RNA, 1410 nt, Artificial Sequence; identical to SEQ ID NO: 144004
  derived and/or modified sequence opt3 from neuraminidase__InfluenzaA__AGO00328

SEQ ID NO: 145493 - RNA, 1410 nt, Artificial Sequence; identical to SEQ ID NO: 136111
  derived and/or modified sequence opt3 from neuraminidase__InfluenzaA__AGO00340

SEQ ID NO: 145494 - RNA, 1365 nt, Artificial Sequence; identical to SEQ ID NO: 137735
  derived and/or modified sequence opt3 from neuraminidase__InfluenzaA__AGO00352

SEQ ID NO: 145495 - RNA, 1365 nt, Artificial Sequence; identical to SEQ ID NO: 137735
  derived and/or modified sequence opt3 from neuraminidase__InfluenzaA__AGO00376

SEQ ID NO: 145496 - RNA, 1365 nt, Artificial Sequence; identical to SEQ ID NO: 137735
  derived and/or modified sequence opt3 from neuraminidase__InfluenzaA__AGO00388

SEQ ID NO: 145497 - RNA, 1365 nt, Artificial Sequence; identical to SEQ ID NO: 137735
  derived and/or modified sequence opt3 from neuraminidase__InfluenzaA__AGO00400

SEQ ID NO: 145498 - RNA, 1365 nt, Artificial Sequence; identical to SEQ ID NO: 137735
  derived and/or modified sequence opt3 from neuraminidase__InfluenzaA__AGO00412

SEQ ID NO: 145499 - RNA, 1365 nt, Artificial Sequence; identical to SEQ ID NO: 137735
  derived and/or modified sequence opt3 from neuraminidase__InfluenzaA__AGO00424

SEQ ID NO: 145500 - RNA, 1365 nt, Artificial Sequence
  derived and/or modified sequence opt3 from neuraminidase__InfluenzaA__AGO00436
augaaccccaaucagaagaucauuaccauaggcagcaucugccugguggucgggcucauuucccuuauccugcaaauuggaaacaucauaucuaucuggauuucacacaguauccagacagguagccagaaucauacuggcauuuguaaccagaauaucauaacguacaaaaacuccaccuggguuaaggacacaacuucugugauuuugaccggaaauucgucauuaugcccuaucagagggugggccauuuauagcaaagauaacaguaucaggaucggcuccaagggugacguauucgugauucgggagccauuuauaucuuguagccaccuggaaugccgcacauucuuucuaacccaaggggcucuccugaaugauaaacauuccucaggaacugucaaggaccgaaguccguaccgugcacuuaugagcugucccgugggcgaggccccuucuccauauaacuccagauucgaaucaguugcguggagcgcuagugccugccacgauggcaugggguggcugacaaucggaauuucuggucccgacaauggcgcaguggccgucuugaaguacaacgggaucauaaccgagacgauuaaauccuggaggaagaaaauccuccggacucaggaaagcgagugugcuugcgugaauggaucguguuuuaccaucaugacagauggcccuucugacggucuggcauccuauaagauuuucaaaaucgagaaggggaagguaacuaaaucaauugaacugaacgccccaaauaguaacuacgaggaaugcagcuguuaucccgauaccggaaagguuaugugcgugugccgcgacaacuggcauggcuccaauagaccuugggucucuuuugaucagaaccucgacuaccagauaggcuacaucuguagcgggguguucggagauaauccaaggccggaggacgguacaggcucaugcgggcccguguaugucgacggagcuaacggcguuaaagguuuuaguuaccgguaugggaauggcguguggauuggacgcaccaagucccacagcucucgacacggcuucgagaugaucugggauccuaacggguggacggaaacugacucaaaauuuaguguaagacaagauguggucgccaugacagacuggagcggauacuccgguucuuucgugcagcauccagaguuaaccggccuggauuguaugaggcccugcuuuuggguugaacuuauccgggggcguccuaaggagaaaacuauuuggacaucggcgagcuccauaucauucuguggagugaauagugacaccgucgauuggucuuggccagacggcgcagaauugcccuucagcaucgauaaguga

SEQ ID NO: 145501 - RNA, 1365 nt, Artificial Sequence
  derived and/or modified sequence opt3 from neuraminidase__InfluenzaA__AGO00448
augaaccccaaucagaagaucauuaccauaggcagcaucugccugguggucgggcucauuucccuuauccugcaaauuggaaacaucauaucuaucuggauuucacacaguauccagacagguagccagaaucauacuggcauuuguaaccagaauaucauaacguacaaaaacuccaccuggguuaaggacacaacuucugugauuuugaccggaaauucgucauuaugcccuaucagagggugggccauuuauagcaaagauaacaguaucaggaucggcuccaagggugacguauucgugauucgggagccauuuauaucuuguagccaccuggaaugccgcacauucuuucuaacccaaggggcucuccugaaugauaaacauuccucaggaacugucaaggaccgaaguccguaccgugcacuuaugagcugucccgugggcgaggccccuucuccauauaacuccagauucgaaucaguugcguggagcgcuagugccugccacgauggcaugggguggcugacaaucggaauuucuggucccgacaauggcgcaguggccgucuugaaguacaacgggaucauaaccgagacgauuaaauccuggaggaagaaaauccuccggacucaggaaagcgagugugcuugcgugaauggaucguguuuuaccaucaugacagauggcccuucugacggucuggcauccuaucgcauuuucaagaucgagaaagggaagguaacuaagucaauugaacugaacgccccaaauagucauuacgaggaaugcagcuguuaucccgauaccggaaaaguuaugugcgugugcagagacaacuggcacggcuccaacaggccuugggucucuuuugaucagaaucucgacuaccagauaggcuacaucuguagcgggguguucggagauaacccacggccggaggacgguacaggcucaugcgggcccguguaugucgacggagcuaauggcguuaaggguuuuaguuaccgcuaugggaacggcguguggauuggacgaaccaaaucccacagcucuagacauggcuucgagaugaucugggauccuaauggguggacggaaacugacucaaaguuuaguguaaggcaagauguggucgccaugacagacuggagcggauacuccgguucuuucgugcagcacccagaguuaaccggccuggauuguaugcggcccugcuuuuggguugaacuuauccgugggcgcccuaaagagaagacuauuuggacaucggcgagcuccauaucauucuguggagugaacagugacaccgucgauuggucuuggccagacggcgcagaauugcccuucagcaucgauaaauga

SEQ ID NO: 145502 - RNA, 1410 nt, Artificial Sequence
  derived and/or modified sequence opt3 from neuraminidase__InfluenzaA__AGQ47722
augaacaccaaucagagaaucauuacaauaggcacuaucugccugauuguggggaucauuagccuccuucugcaaaucggaaacauaaucuccuuguggauuucucacucaauccagacgggugagaagagucaucccgaaauuuguaaucagagcgucaucaccuacgagaacaauacauggguuaaccagacuuaugugaauauauccaacaccaauauugccgcuggccaagggguaacaccuaucauuuuagcaggaaacucuucgcugugcccaaucucaggcugggccaucuacagcaaagacaauaguauuaggauagguuccaagggggauaucuucgugaugcgggaaccguuuauuucuuguagccaccuagagugccgcaccuucuuucucacucagggagcgcugcuuaacgaccgacauuccaauggcacagucaaagaucguucacccuauagaacccugaugaguuguccuaucggcgaagcuccaagccccuacaacucuagguucgaguccguggccuggucagcaagcgccugccacgacgggaugggaugguugacgauagguauuaguggcccugauaauggggcuguugcagugcucaaguauaacggaaucaucacugacaccauuaaaucuuggcggaacaagauccugcgcacacaggaguccgaaugugucugcauuaauggcagcuguuuuacuauaaugaccgaugguccaucgaacgggcaggccucuuacaagaucuucaaaauggagaagggaaaaauuaucaaguccaucgaacuggacgcucccaauuaucauuacgaggagugcucauguuacccugauacaggcaaagugaugugcguaugcagagacaacuggcacgccaguaauaggccauggguuagcuuugaucaaaaccucgacuaucagauuggcuacauauguuccgggguguucggagauaauccgcggucuaacgacgguaagggcaauugcgggcccgucuuaagcaacggagcgaauggcgugaaggguuuuucauuccgcuaugggaacggcguguggaucggacgaaccaaaaguauuuccagcagaucuggcuuugaaauggucugggacccuaauggguggacggagacugauucaaguuucagcaugaagcaggacaucauugcacugacagauugguccggauacucugguucguuuguucagcacccagaacuuaccggcaugaacuguaucaggcccugcuucuggguggaguugauacgggggcaaccuaaagaaagcacuaucuggacauccggaucaaguauuucuuucuguggcguaaauagcgguaccgccuccuggucauggccagacggggcugaucugcccuuuacgaucgacaaguga

SEQ ID NO: 145503 - RNA, 1413 nt, Artificial Sequence; identical to SEQ ID NO: 138469
  derived and/or modified sequence opt3 from neuraminidase__InfluenzaA__AGQ47731

SEQ ID NO: 145504 - RNA, 1377 nt, Artificial Sequence
  derived and/or modified sequence opt3 from neuraminidase__InfluenzaA__AGQ47743
augaaccccaaucagaagaucauuaccauaggcagcaucugcaugguggucgggauuaucucccugauucuccaaaucggaaacauaaucucuauuuggaucucacacaguauucagacagguaaucagaaccauaaaaauagcacuuggaugaaccagacguacaucaauauauccaacaccaauguuguggccggccaagacucuacaucgguaauucuuacugggaacucaagccuguguccuaucagaggaugggcuauuaauaguaaggauaacggcaucaggaucgguuccaaaggggacguguucgucauucgggagccauuuauaucuugcagccacuuggaaugucgcaccuucuuuuuaacacagggagcacugcuaaaugauaagcauuccaacggcaccgugaaagaccgaucaccguaucgugcccucaugaguugccccguuggcgaggcgccuagcccauacaauucuagauucgaauccguggcuuggucagccagcgcaugucacgaugggaugggauggcugacuaucgguauuaguggccccgacaacggggccgucgcugugcuuaaguauaacggaaucauaacagagaccauuaagucuuggaggaaaaagauccugcggacgcaggaauccgagugcacuuguguaaauggcagcugcuuuaccaucaugacagaugguccuucgaacggguuggcaucuuacaaaauuuucaagaucgagaaaggaaagguuacuaaguccauugaacucaaugccccaaacucacauuaugaggaauguaguugcuaccccgacaccggcaaagugaugugugucugccgcgauaauuggcacggcagcaacagaccuuggguguccuuugaccagaaucuggauuaucaaauaggguacaucugcucuggaguguucggugacaacccaaggccgaaggauggcacagggagcuguggacccgucucagcugacggcgccaaugguguuaaaggguuuaguuaccgguauggcaacggaguguggauuggccgcaccaaguccaauagcucucgacacggguucgagaugaucugggacccuaacggauggacggagacugauucaagauuuaguguaaggcaggacguggucgcgaugacagaucggagcgguuacuccggcucuuucgugcagcauccagaacugaccgggcucgacugcaugcgucccuguuuuuggguugaguuaauccgcggaagaccugaagaggaaacuauuuggacaucgggcagcauaaucuccuucugcggugucaauucagauaccguggacuggaguuggccagauggggcagagcugcccuucacgauugacaaauga

SEQ ID NO: 145505 - RNA, 1413 nt, Artificial Sequence
  derived and/or modified sequence opt3 from neuraminidase__InfluenzaA__AGQ47755
augaaccccaaucagaagaucauuaccauaggcagcaucugcauggccauugggacaaucucccugauucuccaaaucggaaacauaaucucuauuuggaucucacacaguauucagacugguagccagaaucauacgggcaucuguaacagaaggauagugaccuacgagaauaacacaugggucaaucagacuuauguuaacauuuccaauaccaacgugguagcugaaaaagacacaaccucuaugauccuugcaggaaauucgucacugugcccuauucgggggugggccaucuacagcaaggauaacaguauccgcauuggcuccaaaggugacguguucgucauacgagagccauuuaucucuuguagccacuuggaaugccguacuuucuuuuuaacacaaggggcgcugcuaaaugauaagcauuccaacggaaccgugaaagacagaucaccguauagggcucucaugaguugucccauuggcgaggccccuagcccauacaauucucgguucgaauccguugcauggucagccagcgcuugccacgauggcaugggguggcugacgaucggaauaaguggucccgacgauggcgcaguggccguccuuaaguauaacgggauuaucacugagaucauuaagucuuggcgcaaacagauccugagaacccaggaguccgaaugugugugcguaaacggaagcuguuuuacaauuaugacugacggcccuucgaaugguccagcuucuuacaggauauucaagaucaaaaaggggaaaauuaccaaguccaucgaguuggaugcccccaacucacauuaugaagagugcaguuguuacccugacacaggaaagguuaugugcgugugccgggauaauuggcacggcagcaaccgcccaugggucuccuuuaaucagaaccucgacuaccaaaucggcuauauuuguucugggguguucggagauaauccgcgacccaaagacgguaagggcagcugcgacccugugaacgucgauggggcggacggaguuaaaggcuuuucauacagauaugguaaugggguguggauaggcaggaccaagaguacguccagccggaaaggauucgagaugaucugggauccaaacggcuggacugacacagaugggaauuuucugguaaagcaggacguggucgcaaugaccgauuggucuggauacucagguaguuucgugcagcaccccgaacugacuggccucgacuguaugcguccuugcuuuuggguugaguuaauucgcgggagaccaagggagaaaacaaccaucuggacgagcggauccucuauuucguucuguggcgugaacagcgauaccgucaauugguccuggcccgacggugccgaacugccguucacaaucgauaaguga

SEQ ID NO: 145506 - RNA, 1410 nt, Artificial Sequence
  derived and/or modified sequence opt3 from neuraminidase__InfluenzaA__AGQ47767
augaaccccaaucagaagaucauuaccauaggcagcaucugcaugguggucgggauuaucucccugauucuccaaaucggaaacauaguuucuaucuggauuucacacaguauccagacagguaaucagaaccauacuggcacgugugaccagagcauuaucaccuacaaaaauuccacaugggugaaccaaacuuauguaaauauaucuaacaccaauguggucgccgggaaggauacaaccucggugauucuugcuggaaacucaagccugugcccuaucagaggcugggcaauuuacaguaaagacaaugguguuaggaucggguccaagggagauguguucgucauccgggagccauuuauuucuuguagccacuuggaaugccgcacuuucuuuuuaacacagggcgcccugcuaaacgacaaacauuccaauggcaccgugaaggaucgaucaccguaucgugcgcucaugaguugucccguaggggaggcuccuagcccauacaacucuagauucgaauccguugccuggucagcaagcgccugccacgacggaauggguuggcugacgauaggcaucagugggcccgaugacggagcuguggcaguccuuaaguauaauggcauuaucacugagaccauaaaaucuuggaggaaggaaauucugcggacacaggaguccgagugugugugcgugaacgguagcuguuuuacuaucaugaccgaugggccuucgggaggcccagccucuuacaaaaucuucaagauugaaaaaggcaaggucacaaaguccaucgaguuggacgcucccaacucacauuaugaagagugcaguuguuacccugauaccagcaaaguuaugugcgugugccgcgacaauuggcacggguccaacagaccauggguaucuuuugaucagaaucucgacuaccaaaugggauauauuuguagcgguguguucggcgacaacccgaggcccaaggaugggaaaggaucaugcggcccugucuacguggacggugccaaugggguuaagggcuuuaguuauaaauacggaaacggcguguggauagggcggacgaaguccaauagcucucgccagggauucgagaugaucugggauccaaacgguuggacugaaacagacucaaacuuuuucaccaaacaggaugucguggcgguaacugacuggaguggcuauagcggguccuuuguucagcaccccgagcugacaggacuggauuguaugcgaccuugcuucuggguggaacucauuagaggcaggccaaaggagaauaccaucuggacgucugguucgagcaucuccuucuguggggucaauucagacaccguggauuggaguuggcccgacggcgcagaauuaccguuuacaauugauaaguga

SEQ ID NO: 145507 - RNA, 1410 nt, Artificial Sequence; identical to SEQ ID NO: 145488
  derived and/or modified sequence opt3 from neuraminidase__InfluenzaA__AGQ47779

SEQ ID NO: 145508 - RNA, 1413 nt, Artificial Sequence
  derived and/or modified sequence opt3 from neuraminidase__InfluenzaA__AGQ47791
augaaccccaaucagaagaucauuaccauaggcagcaucugcauggccauugggaucauuucccugauccuccaaauaggaaacaucauuucuaucugggugucacacaguauucagacagguagccagaaucauacuggcaucuguaaccagagaauaauuacguacgagaauaacaccugggucaaucaaacacacguuaacaucuccaauacuaacgugguagcugggaaagacaccacaucuaugauucuugcaggaaauucgucacugugcccuaucaggggcugggccaucuauagcaaggauaacaguauucggauagguuccaaaggggacguguucgucauccgcgaaccauuuauuucuuguagccauuuggagugccgaaccuucuuuuuaacucagggagcgcugcuaaaugauaagcacuccaacggcacagugaaagaccguucaccguacagagcucucaugaguugucccaucggcgaagccccuagcccauauaauucuagguucgaguccguugcauggucagccagcgcuugccaugaugggaugggauggcugaccauagguauuaguggccccgacgauggggcaguggccguccuuaaguacaacggaaucaucacggaaacuauuaagucuuggaaaaagcagauccugcggacccaggaguccgagugugugugcguaaacggcagcuguuuuacaauuaugacugacgguccuucggaugggccagcuucuuaucgcauauucaaaaucgaaaagggaaaaauuaccaaguccaucgaguuggacgcccccaauucacacuacgaagagugcaguuguuauccugauacaggcaccguuaugugcgugugcagagacaacuggcacggcagcaauaggccaugggucuccuuuaaccaaaaucucgauuaccagaucggguacauuuguucuggaguguucggugacaacccgcggcccaaggacggcaaagggagcugcgauccugugaaugucgacggagcggauggcguuaaggguuuuucauaucgcuacgggaacggcguguggauaggacgaacgaaaaguaauuccagcagaaagggcuucgagaugaucugggacccaaacggguggacugauacagacggaaauuuucugguaaaacaggauguggucgcaaugaccgacuggucugguuauucaggcaguuucgugcagcaucccgaacugacugggcucgauuguaugaggccuugcuuuuggguugaguuaauucggggacguccacgcgaaaagacaaccaucuggacgagcggcuccucuauuucguucuguggugugaacagcgacaccgucaauugguccuggcccgauggggccgagcugccguucacaaucgacaaauga

SEQ ID NO: 145509 - RNA, 1410 nt, Artificial Sequence
  derived and/or modified sequence opt3 from neuraminidase__InfluenzaA__AGQ47803
augaaccccaaucagaagaucauuaccauaggcagcaucugcaugguggucgggauuaucucccugauucuccaaaucggaaacauaaucucuauuuggaucucacacaguauucagacagguagccagaaucauacuggcaucuguaaccaguccauaauuacguacaaaaauucuaccuggguuaaccaaacauaugugaauaucucgaacacuaauguaguggccgggaagggaaccacaucagucauucuugcuggcaacagcagucugugcccuaucagagguugggcaaucuacuccaaagacaaugggauuaggauaggaucuaagggcgauguguucguuauccgggagccauuuauuagcuguucccacuuggaaugccgcaccuucuuuuuaacucagggcgcccugcuaaacgacaaacauucaaaugggacagugaaggaucgaaguccguaucgugcgcucaugagcugucccgucggagaggcuccuucuccauacaacuccagauucgaaucaguggccuggagcgcaugcgccugucacgacgguaugggcuggcugaccaucgggauaaguggacccgaugacgaggcuguagcaguucuuaaguauaauggcauuaucacggaaacuaucaaaucuuggaggaagaaaauucugcggacccaggaguccgagugcgugugugucaacgguagcugcuuuacaaucaugacugaugggccuucggacggaccagccucuuacaagauuuucaaaauagaaaagggcaaggugaccaaauccaucgaguuggaugcucccaacucacauuaugaagaguguaguugcuacccugacacaggcaaggugaugugcgucugucgcgauaauuggcacgggagcaacagaccauggguuuccuuugaccagaaucucgauuaccaaauuggauauaucugcucugguguguucggcgacaacccgaggcccaaagacgggaagggaagcuguggcccuguauacguggauggugccaauggggucaaaggcuuuucauaucgguacggaaacggcguguggaucgggcgcaccaagagugacuccagccgacagggauucgagaugauuugggauccaaaugguuggacggaaacugacucuaacuuuuucguuaaacaggauauaguggcgaugacagacuggucaggcuauagugggagcuuuguccagcaccccgagcugaccggacuggauugcaugagaccuuguuucuggguggaacucaucaggggccggccaaaggagaagacuauuuggacauccgguucuucgaucagcuucugcgggguaaauuccgacaccguugauuggucauggcccgacggcgcagaauuaccguuuacgauugauaaauga

SEQ ID NO: 145510 - RNA, 1368 nt, Artificial Sequence
  derived and/or modified sequence opt3 from neuraminidase__InfluenzaA__AGQ47814
augaaccccaaucagaagaucauuaccauaggcagcaucugcauggccauugggaucauuucccugauccuccaaauaggaaacaucauuucuaucugggugucacacaguauucagacagguagccagaaucauacuggcaucuguaaccagagaauaauuacguacgagaauaacaccugggucaaagacacaacuuccaugacccuugcugggaauagcucgcugugcccuaucaggggaugggcaauuuauucaaaggauaacagcauccggaucggcaguaaaggugacguuuucgugauucgcgaaccauuuauauccuguucucacuuggagugccgaacauucuuuuuaacccaaggggcccugcuaaaugauaagcauagcaacggaacuguaaaagaccguuccccguacagagcgcucaugucaugucccaucggcgaagcuccuaguccauauaauagcagguucgagucuguggccugguccgcaucagccugccacgauggcaugggguggcugacaauuggaaucagcggucccgacgauggcgcugucgcagugcuuaaguacaacgggauaauuaccgaaacgaucaagaguuggaaaaagcagauccugcggacucaggagucugaguguguuugcgugaauggauccuguuuuaccauuaugacagacggcccuagcgaugguccagccucguaucgcaucuucaaaauugaaaaggggaaaauaacuaagucuaucgaguuggacgcucccaacucccauuacgaagagugcucauguuauccugauaccggaacagucaugugcgugugcagagacaauuggcacggcaguaacaggccauggguaucuuuuaaccagaaucucgauuaccaaauuggcuacaucuguuccgggguuuucggagacaacccgcggcccaaggacgguaaaggcucuugcgauccugugaaugucgacggggccgauggagugaagggcuuuagcuaucgcuacgguaacgggguguggaucggccgaaccaaaucaaauaguuccagaaagggauucgagaugauuugggacccaaacggcuggacggauacugacgggaauuuucuggucaaacaggauguuguggcgaugacagacuggagcggauauucugguucauucguacagcaccccgaacugaccggccucgauuguaugaggccuugcuuuuggguggaguuaauacgggggcguccacgcgaaaagacuacaaucuggaccaguggaagcuccauuucuuucuguggcgucaacucggacacggugaauuggagcuggcccgauggugcagagcugccguucaccaucgacaaauga

SEQ ID NO: 145511 - RNA, 1413 nt, Artificial Sequence; identical to SEQ ID NO: 138473
  derived and/or modified sequence opt3 from neuraminidase__InfluenzaA__AGQ47826

SEQ ID NO: 145512 - RNA, 1410 nt, Artificial Sequence
  derived and/or modified sequence opt3 from neuraminidase__InfluenzaA__AGQ47838
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuagugggguacaggaacuggucaaagccucagugcaaaauaacuggauucgccccauuuaguaaggauaauagcauucggcuguccgcggguggcgacaucugggucacacgcgagcccuaugugucuugugauccugggaagugcuaccaauucgcucuaggacagggcaccacgcucgacaacaaacauucgaaugauacuauucacgaccgaaccccacaucguacacugcuuaugaacgagcuggguguucccuuucacuuggggacuaaacagguguguaucgccuggucaagcaguuccugccaugauggaaaggcauggcuccacgucugugugaccggcuaugacaagaaugccacagcuucuuucaucuacgauggcagacugguagacagcauuggguccuggucacagaacauacugaggacccaagaaagugagugcguuuguaucaauggaacgugcacuguggucaugacagaugguagcgcaucuggccgggccgacaccaaaauucucuuuaucgaagaggggaagauagugcacauuuccccuuuaucaggaagcgcucagcauguggaggaaugcaguuguuauccacgcuacccgggcgucagaugcaucuguagggauaacuggaaggguucuaaucggcccguuguggacaucaacguaaaagacuacuccauugauagcucguaugugugcucugggcuggucggagacacuccucgcaacaaugaucgauccucaaguagcuacuguagaaacccaaauaacgagaagggcaaucacggcgugaaagggugggccuucgacgauggaaacgacguuuggauggguaggacaaucuccgaagauucucggagcggcuaugagaccuuuaaggugauugggggauggucaacgcccaauaguaaacuucagauaaaccgucaggucaucguggacuccgauaaucgcagcggcuacucugguauuuucucaguagaagggaagaguugcaucaacagauguuuuuauguugaguugaucaggggccgggagcaagaaacccgagugugguggacaagcaauuccauugucguguucugcggaacuucuggcaccuacgggacaggaucguggccugacggugcggauauaaaccugaugccaaucuga

SEQ ID NO: 145513 - RNA, 1362 nt, Artificial Sequence
  derived and/or modified sequence opt3 from neuraminidase__InfluenzaA__AGQ47850
augaaccccaaucagaagaucauuaccauaggcagcaucugcaugguggucgggauuaucucccugauucuccaaaucggaaacauaaucucuauuuggaucucacacaguauucaggccgguagcuccacauggguuaaucagacuuacgugaacaucucuaauacgaacguaguggcuggcccugacgcaaccucggucauacuuacaggaaauucaagccuguguccaauuagagggugggccaucuauaguaaagauaacggcauuaggaucgguuccaagggggacaucuucgugauucgggagccguuuauaucuugcagccauuuggaaugucgcgcguucuuuuuaacucagggagcucugcuaaaugauaaacacuccaacggcaccguuaaggaccgaucacccuaccgugcccucaugaguugcccugugggcgaggcaccaagccccuauaauucuagauucgaauccgucgccuggucagcuagcgcaugucaugaugggaugggauggcugacaaucgguauuaguggcccugacaacggggccguggcuguacuuaaauacaauggaaucauaaccgagacuauuaagucuuggaggaagaaaauccugcggacacaagaauccgagugcgccuguguuaacggcagcugcuuuaccaucaugacggaugguccaucggacgggcccgcgucuuauaagauuuucaaaaucgagaagggaaaagugacuaaguccauugaauuggaugcaccuaauucacacuacgaggaauguaguugcuauccagacaccggcaaggucaugugugugugccgcgauaacuggcauggcagcaacagaccguggguguccuuugaccagaaucucgauuaccagauaggguacaucugcucuggagucuucggugacagccccaggccuaaagacggcacagggucauguggaccaguuaguguggauggcgccaacgguguaaagggguuuuccuaucgguacggcaauggaguguggauuggccgcacuaaaagcaagucuucacgacacggguucgagaugaucugggaccccaacggauggaccgagacagauaguagauuuagcgucaggcaggacgugguugcuaugaccgauugguccgguuauucuggcucguucgugcaacacccugaacugacggggcuggacugcaugcggccauguuuuugggucgagcucauccguggacagcccaaagaaaagacuauuuggacaagcggcuccucaauaaguuucugcgguguaaauucugauaccguggacuggagcuggccggauggggccgaguuaccuuucacuaucgacaaauga

SEQ ID NO: 145514 - RNA, 1410 nt, Artificial Sequence
  derived and/or modified sequence opt3 from neuraminidase__InfluenzaA__AGQ47873
augaacaccaaucagagaacaaucacuauuggcacgauaugccugaucguggggauuaucagccuccuucugcaaauuggaaacaucauauuguuauggaugucccacucuauccagaccggugagaagucacaucccaaaguguguaaucagaguguuauuacauacgaaaacaauacuugggugaaccagaccuauguaaauaucagcaacacaaauauugccgcuggccaaggggugaccccuaucauacuggcaggaaacuccucucuaugcccaauuucgggcugggccaucuacucaaaggacaauagcauuaggaucgguaguaaaggggauaucuucgucaugcgggagccguuuauuuccuguucucaccucgaaugccgcacuuucuuucugacacagggagcgcuucugaacgaccgacauagcaauggcaccgugaaggaucguucccccuauagaacguugaugucauguccuauaggcgaggcuccaagucccuacaacagcagguucgaaucuguugccugguccgcaucagccugccacgacgggaugggauggcucacuaucgguauuagcggcccugauaauggggcuguggcaguccugaaauauaacggaaucauaaccgacacaauuaagaguuggcggaacaagauccugcgcacucaggagucugagugugugugcaucaauggcuccuguuuuaccauuaugacagaugguccaagcaacgggcaggccucguacaaacucuucaagauggaaaaaggaaagaucauuaaaucuauagaguuagacgcucccaauuaucauuacgaagagugcuccuguuacccugauaccggcaagguaguuugcgugugcagagacaacuggcacgccucaaauaggccaugggucaguuuugaucaaaaccuggacuaucagaucggcuacauuuguagcgggguguucggagauaauccgcgguccaacgacgguaagggcaauugcgggcccgugcuuucuaacggagcgaauggcgucaaagguuuuagcuuccgcuaugggaacggcguuuggaucggacgaacgaagucaaucaguuccagaagcggcuuugagaugauuugggacccuaauggguggacugaaacagauucuucauucaguaugaaacaggacauaaucgcauugaccgauuggagcggauacuccgguucuuuugugcagcacccagagcugacuggcaugaacuguauuaggcccugcuucuggguagaacuaauccgggggcaaccuaaggagucgacaauuuggaccagcggauccucaaucaguuucuguggcgucaauucugguacggccagcugguccuggccagacggggcugaucuccccuuuaccauagacaaauga

SEQ ID NO: 145515 - RNA, 1410 nt, Artificial Sequence; identical to SEQ ID NO: 139230
  derived and/or modified sequence opt3 from neuraminidase__InfluenzaA__AGQ47885

SEQ ID NO: 145516 - RNA, 1410 nt, Artificial Sequence; identical to SEQ ID NO: 143996
  derived and/or modified sequence opt3 from neuraminidase__InfluenzaA__AGQ47897

SEQ ID NO: 145517 - RNA, 1410 nt, Artificial Sequence; identical to SEQ ID NO: 136111
  derived and/or modified sequence opt3 from neuraminidase__InfluenzaA__AGQ47909

SEQ ID NO: 145518 - RNA, 1410 nt, Artificial Sequence
  derived and/or modified sequence opt3 from neuraminidase__InfluenzaA__AGQ47921
augaaccccaaucagaagaucauuaccauaggcagcgugucccugacaaucgccacugucugcuuccucaugcaaacggcuauucuuguuaccacagugacucugcacuuuaaacaguacgagugugacucuccugcaucaaaccagguaaugccaugcgaaccgaucauuaucgagagaaauauaaccgaaaucguguauuugaacaauacaaccauugagaaggaaaucugucccaaagucguggaguacaggaacuggaguaagccucagugccaaauuacuggguucgccccauuuagcaaagauaauuccauccgguuaucugcgggaggugacauauggguuacacgcgagcccuaugugucgugugaucauggcaagugcuaccaguucgcucuggggcagggaaccacgcuagacaacaagcacucaaaugauacuauucaugaccgaaucccucaccguacccuccugaugaacgaacuuggcgucccauuucaucuggguacaagacagguguguauugccuggagcaguuccucuugccacgaugggaaagcaugguugcacguauguaucacuggagacgauaagaaugccaccgcuagcuucaucuaugacggcaggcucguugauuccauuggcucauggagucaaaacauacugcggacacaggagagcgaaugcguguguaucaaugggaccugcacggucgugaugacugacggaucugcauccggucgcgccgauacaaggauucuguuuaucgaggagggcaaaauagugcauauuucaccccucagcgggagugcucagcacgucgaagagugcucuuguuacccuagauauccaggaguucggugcaucugucgcgacaacuggaagggcuccaaucgaccggugguagacaucaacauggaagauuacagcauugacucgucuuacgugugcuccgguuuagucggggauacccccagaaacgacgauaggucaaguaauagcaacugucggaauccuaacaaugagcguggaaaccagggcgugaaaggcugggccuucgacaauggggaugacguuuggaugggacgcacuaucuccaaggaucugagaucugguuaugaaacauuuaaggugauuggcggguggagcaccccaaacucaaaaagucaaauaaauaggcaggucaucguggacuccgauaaccggagcggauacucuggcauuuucucaguagaggguaagaguugcaucaaucgauguuuuuauguugagcuuauccgcgggagaaaacaggaagcgagggugugguggacgagcaacuccauugucguguucugcggcaccucuggaacauacggcacugggucguggcccgacggagcaaauauaaacuuuaugccuaucuga

SEQ ID NO: 145519 - RNA, 1365 nt, Artificial Sequence
  derived and/or modified sequence opt3 from neuraminidase__InfluenzaA__AGQ47933
augaaccccaaucagaagaucauuaccauaggcagcaucugcaugguggucgggcugauuucccucauccuucaaauuggaaacaucauaucuaucuggauuucacacaguauccagacagguagccagaaucauacuggcauuuguaaccagaauaucauaacguacaaaaacuccaccuggguuaaggacacaacuucugugauucugaccggaaauucgucauugugcccuaucagagggugggccauuuauagcaaagauaacaguaucaggaucggcuccaagggugacguauucgugauucgggagccauuuauaucuuguagccacuuagaaugccgcacauucuuucugacccaaggggcucuacucaaugaucgacauuccaacggaacugucaaagaccguucaccguacagagcacugaugaguugucccgugggcgaggccccuagcccauauaauucuagguucgaauccguugcguggucagcuagcgccugccacgauggcaugggguggcuuacaaucggaauuaguggucccgacaacggcgcaguggccguccugaaguacaaugggaucauaaccgagacgauuaagucuuggcggaaaaagaucuugcgcacucaggaauccgagugugcuugcgugaacggaagcuguuuuaccaucaugacagauggcccuucggacggucucgcaucuuauaaaauuuucaagaucgagaaagggaagguaacuaaguccauugaacugaaugccccaaacucacauuacgaggaaugcaguuguuaucccgauaccggaaaaguuaugugcgugugcagagacaacuggcacggcagcaauaggccuugggucuccuuugaucagaaccuggacuaccagauaggcuacaucuguucugggguguucggagauaauccacggccgaaggacgguacaggcagcugcgggcccguguaugucgacggagcuaacggcguuaaagguuuuucauaccgcuaugggaauggcguguggauuggacgaaccaagagucacuccagcagacauggcuucgagaugaucugggauccuaacggguggacggagacugacucuaaauuuucaguaaggcaagauguggucgccaugacagacuggaguggauacagcgguuccuucgugcagcacccagaacucaccggcuuagauuguauccggcccugcuuuuggguugagcugauucgugggcgcccuaaggagaaaacuauauggacaucugcgucgagcaucuccuucuguggagucaauucagacaccgugaacuggaguuggccagauggcgcagaacuucccuucacgauugacaaguga

SEQ ID NO: 145520 - RNA, 1365 nt, Artificial Sequence; identical to SEQ ID NO: 137735
  derived and/or modified sequence opt3 from neuraminidase__InfluenzaA__AGQ47945

SEQ ID NO: 145521 - RNA, 1365 nt, Artificial Sequence; identical to SEQ ID NO: 137735
  derived and/or modified sequence opt3 from neuraminidase__InfluenzaA__AGQ47957

SEQ ID NO: 145522 - RNA, 1365 nt, Artificial Sequence; identical to SEQ ID NO: 137735
  derived and/or modified sequence opt3 from neuraminidase__InfluenzaA__AGQ47969

SEQ ID NO: 145523 - RNA, 1365 nt, Artificial Sequence; identical to SEQ ID NO: 137735
  derived and/or modified sequence opt3 from neuraminidase__InfluenzaA__AGQ47981

SEQ ID NO: 145524 - RNA, 1365 nt, Artificial Sequence
  derived and/or modified sequence opt3 from neuraminidase__InfluenzaA__AGQ48005
augaaccccaaucagaagaucauuaccauaggcagcaucugccugguggucgggcucauuucccuuauccugcaaauuggaaacaucauaucuaucuggauuucacacaguauccagacagguagccagaaucauacuggcauuuguaaccagaauaucauaacguacaaaaacuccaccuggguuaaggacacaacuucugugauuuugaccggaaauucgucauuaugcccuaucagagggugggccauuuauagcaaagauaacaguaucaggaucggcuccaagggugacguauucgugauucgggagccauuuauaucuuguagccaccuggaaugccgcacauucuuucuaacccaaggggcucuccugaaugauaaacauuccucaggaacugucaaggaccgaaguccguaccgugcacuuaugagcugucccgugggcgaggccccuucuccauauaacuccagauucgaaucaguugcguggagcgcuagugccugccacgauggcaugggguggcugacaaucggaauuucuggucccgacaauggcgcaguggccgucuugaaguacaacgggaucauaaccgagacgauuaaauccuggaggaagaaaauccuccggacucaggaaagcgagugugcuugcgugaauggaucguguuuuaccaucaugacagauggcccuucugacggucuggcauccuauaagauuuucaaaaucgagaaggggaagguaacuaaaucaauugaacugaacgccccaaauagucauuacgaggaaugcagcuguuaucccgauaccggaaagguuaugugcgugugccgcgacaacuggcacggcuccaacagaccuugggucucuuuugaucagaaucucgacuaccagauaggcuacaucuguagcgggguguucggagauaacccaaggccggaggacgguacaggcucaugcgggcccguguaugucgacggagcuaauggcguuaaagguuuuaguuaccgguauuccaacgggguguggauuggccgcaccaagagccacucuucacgacauggauucgagaugaucugggauccuaauggcuggacggaaacugacaguaaauuuagcguaagacaagauguggucgccaugacagacugguccggguacucuggaucguucgugcagcacccagaguuaaccggucuggauuguaugaggcccugcuuuuggguugaacuuauccggggccguccuaaggagaaaacuauuuggacaagcgcguccucaauaaguuucuguggggugaacucugacaccgucgauuggagcuggccagacggagcagaauugcccuucuccaucgauaaguga

SEQ ID NO: 145525 - RNA, 1365 nt, Artificial Sequence; identical to SEQ ID NO: 145524
  derived and/or modified sequence opt3 from neuraminidase__InfluenzaA__AGQ48017

SEQ ID NO: 145526 - RNA, 1365 nt, Artificial Sequence; identical to SEQ ID NO: 137735
  derived and/or modified sequence opt3 from neuraminidase__InfluenzaA__AGQ48029

SEQ ID NO: 145527 - RNA, 1365 nt, Artificial Sequence
  derived and/or modified sequence opt3 from neuraminidase__InfluenzaA__AGQ48041
augaaccccaaucagaagaucauuaccauaggcagcaucugccugguggucgggcucauuucccuuauccugcaaauuggaaacaucauaucuaucuggauuucacacaguauccagacagguagccagaaucauacuggcauuuguaaccagaauaucauaacguacaaaaacuccaccuggauuaaggacacaacuucuguuaucuugaccggaaauucgucauuaugcccuauuagagggugggccaucuauagcaaagauaacaguaucaggauuggcuccaagggugacguguucguaauacgggagccauuuaucucuuguagccaccuggaaugccgcacauucuuucuaacccaaggggcucuccugaaugauaaacauuccucaggaacugugaaggaccgaaguccguaccgugcacuuaugagcugucccgucggcgaggccccuucuccauauaacuccagauucgaaucaguggcguggagcgcuagugccugccacgauggcaugggguggcugacaauuggaaucucuggucccgacaauggcgcaguugccguguugaaguacaacgggauaauuaccgagacgaucaaauccuggaggaagaaaauccuccggacucaggaaagcgagugugcuugcgucaauggaucguguuuuaccauuaugacagauggcccuucugacggucuggcauccuauaagaucuucaaaauugagaaggggaaggugacuaaaucaauagaacugaacgccccaaauagucauuacgaggaaugcagcuguuaucccgauaccggaaagguaaugugcguuugccgcgacaacuggcacggcuccaacagaccuugggugucuuuugaucagaaucucgacuaccagaucggcuacauuuguagcggggucuucggagauaacccaaggccggaggacgguacaggcucaugcgggcccguguauguggacggagcuaauggcgucaaagguuuuaguuaccgguaugggaacggcguuuggaucggacgcaccaagucccacagcucucgacauggcuucgagaugaucugggauccuaauggguggacggaaacugacucaaaauuuagugugagacaagauguaguggccaugacagacuggagcggauacuccgguucuuucguccagcacccagaguuaaccggccuggauuguaugaggcccugcuuuuggguggaacuuauucgggggcguccuaaggagaaaacuauauggacaucggcgagcuccaucucauucuguggaguuaacagugacaccguggauuggucuuggccagacggcgcagaauugcccuucagcauugauaaguga

SEQ ID NO: 145528 - RNA, 1365 nt, Artificial Sequence
  derived and/or modified sequence opt3 from neuraminidase__InfluenzaA__AGQ48053
augaaccccaaucagaagaucauuaccauaggcagcaucugccugguggucgggcucauuucccuuauccugcaaauuggaaacaucauaucuaucuggauuucacacaguauccagacagguagccagaaucauacuggcauuuguaaccagaauaucauaacguacaaaaacuccaccuggauuaaggacacaacuucuguuaucuugaccggaaauucgucauuaugcccuauuagagggugggccaucuauagcaaagauaacaguaucaggauuggcuccaagggugacguguucguaauacgggagccauuuaucucuuguagccaccuggaaugccgcacauucuuucuaacccaaggggcucuccugaaugauaaacauuccucaggaacugugaaggaccgaaguccguaccgugcacuuaugagcugucccgucggcgaggccccuucuccauauaacuccagauucgaaucaguggcguggagcgcuagugccugccacgauggcaugggguggcugacaauuggaaucucuggucccgacaauggcgcaguugccguguugaaguacaacgggauaauuaccgagacgaucaaauccuggaggaagaaaauccuccggacucaggaaagcgagugugcuugcgucaauggaucguguuuuaccauuaugacagauggcccuucugacggucuggcauccuauaagaucuucaaaauugagaaggggaaggugacuaaaucaauagaacugaacgccccaaauagucauuacgaggaaugcagcuguuaucccgauaccggaaagguaaugugcguuugccgcgacaacuggcacggcuccaacagaccuugggugucuuuugaucagaaucucgacuaccagaucggcuacauuuguagcggggucuucggagauaacccaaggccggaggacgguacaggcucaugcgggcccguguauguggacggagcuaauggcgucaaagguuuuaguuaccgguaugggaacggcguuuggaucggacgcaccaagucccacagcucucgacauggcuucgagaugaucugggauccuaauggguggacggaaacugacucaaaauuuagugugagacaagauguaguggccauggcggacuggagcggauacuccgguucuuucguccagcacccagaguuaacaggccuggauuguaugaggcccugcuuuuggguggaacuuauucgggggcguccuaaggagaaaaccauauggacuucggcaagcuccaucucauucuguggaguuaacagugacacaguggauuggucuuggccagacggcgccgaauugcccuucagcauugauaaguga

SEQ ID NO: 145529 - RNA, 1410 nt, Artificial Sequence
  derived and/or modified sequence opt3 from neuraminidase__InfluenzaA__AGQ81707
augaaccccaaucagaagaucauuaccauaggcagcaucugcauggugauugggaucgccucccugaugcuccaaauuggaaacaugaucucuauaugggucucacacaguauccagacagguaaucaguaccagccugagccauguaaccaaagcauuaucacuuaugaaaauaacacguggguuaaucagaccuacgugaacauuuccaauacaaacuuccuuacugagcaggcuguaaccucuguggcacuggccggcaauucgucauugugcccgaucagcgggugggcgauauauaguaaagacaacggaauuagaaucggcuccaagggugaugucuuugugauuagggaacccuucaucucuuguagccauuuagagugccggacauuuuuccugacccagggggcucuacucaaugacaaacacuccaacggaacuguuaaggaucgcucaccuuaccgaacacugaugaguuguccagugggcgaagcccccagcccuuauaauucucguuuugaguccgucgcauggucagccagcgcuugccaugacggcaucaguuggcuuaccauugggauaucuggaccagauaacggugcaguggccguacugaaauacaacggcaucauuacggacacuaucaaguccuggagaaauaacauauugaggacccaagagagcgaaugugcuugcguuaaugggucguguuucacagugaugacugauggacccucuaacggccaggccuccuauaagauuuuuaaaaucgagaaggguaaagucgugaagucaguggaacucaaugcgccuaacuaccacuacgaggagugcaguuguuauccagacgcagggaaaaucaugugcgucugccgggauaauuggcauggaagcaaccgcccguggguuuccuucaaucagaaccuggaauaccagauuggcuauaucuguucuggcguguuuggggacaaucccagaccuaacgauggaaccgguagcugcggcccaguaucaaguaauggggccuacggagugaagggcuucuccuuuaaguaugguaacggggucuggauuggcaggacaaaaagcaccucuucacggaguggauucgagaugauaugggaccccaauggcuggacggaaacugauagcuccuuuucugugaagcaagacaucguugcuauuacagacuggucgggguacagcggauccuucgugcagcacccugagcugaccggucucgauuguaugcgcccaugcuucugggucgaauuaauccgaggcagacccaaagagaacacuaucuggacaucagggaguucuauuagcuuuuguggaguggacuccgauaccguaggcuggucauggccggacggugccgagcugccuuucacgauagauaaguga

SEQ ID NO: 145530 - RNA, 1410 nt, Artificial Sequence
  derived and/or modified sequence opt3 from neuraminidase__InfluenzaA__AGQ81715
augaaccccaaucagaagaucauugccauaggcagcgugucccugaccaucgcuacaauuugccuccuuaugcaaaucgcaauucuggucacuacgaugaccuugcacuucaaacauaacgaguguacaaauucuucaaacaaucaggccguuccuugcgggccaaucauaaucgaaagaaacgugacugagauuguacacuuaaauaguaccacacuggaaaaggagaucuguccgaaagcggcuggauacagggacuggagcaagccccagugccagauuaccgguuuugccccuuucuccaaagauaacucuauccggcuaucggcaucaggcgacauaugggugacucgcgaaccauaugucagcugugggcucggaaagugcuaccaauuugcccugggccaggguacaacccuugauaaucgacauaguaacgggacgucccacgaccguacucccuauagaacccuguugaugaaugagcucggagugccuuuccaucuggcuacaaagcagguuuguauugcauggucuagcuccucaugccacgauggcaaagccuggcugcacgugugugucacuggcgacgauaggaacgcuaccgccaguaucauuuacgacgggauccucguggauagcaucggaucuugguccaagaauauuuuacggacacaggagucagaaugcguauguauaaacgguaccugcacgguugugaugacugacggcagcgcgagugggaaagcagauacacgcauccuguuuauuagagagggaaagaucguccauauaucuccacuuuccggcagcgcccaacacguggaagagugcucguguuauccccaguacccugaggugaggugcgucugucgggacaauuggcgcgguucuaaccgaccaguuuuguauauuaacauggcugauuacuccaucgacucaggguacgugugcaguggacugguaggcgacaccccgagaaaugaugacaucagcuccucuagcaacuguaaagaucccaauaacgaaaggggcgccccuggggugaagggaugggcauucgacucagguaaugauauuuggaugggccggacuaucgagaaggacagucguuccggguaugaaacauuucgcgucauuggaggcuggaacaccgcuaauagcaaaucucagacgucaagacaggugauaguugauagugguaacagcuccggguacucuggcaucuucucgauugagggaaagagcugcaucaauagguguuuuuauguggaacuaauccggggccgaccaaaagagacccgcgucugguggacauccaacucaauuauaguguucugcgggaccaguggaacuuacgguacaggcucuuggcccgacggggccaauaucaacuuuauggcgauuuga

SEQ ID NO: 145531 - RNA, 1410 nt, Artificial Sequence
  derived and/or modified sequence opt3 from neuraminidase__InfluenzaA__AGQ81717
augaaccccaaucagaagaucauugccauaggcagcgugucccugaccaucgcuacaauuugccuccuuaugcaaaucgcaauucuggucacuacgaugaccccucacuucaaacaugacgaguguacaaacucuucaaauaaccaggccguuccaugcgggccgaucauaaucgaaagaaaugugacugagauuguacacaucaacaguaccauuuuggaaaaggagaucugucccaaagcggcuggauacaggaauuggagcaagccucagugccagauaauugguuuugccccauucuccaaagauaacucuauccgguuaucggcaucaggcgacauuugggugacacgcgaacccuaugucagcugugggcugggaaagugcuaccaauuugcccuaggccaggguaccacucucgauaaucgacauaguaacgggacaucccacgaccguaccccucauagaacgcugcuuaugaaugagcugggagugccauuccacuuggcuacuaagcagguuuguaucgcauggucuagcuccucaugccacgauggcaaagccuggcuccaugugugugucaccggcgacgauaggaacgcuacagccaguaucauuuaugacgggaugcugguggauagcauaggaucuugguccaagaauauccugcggacucaggagucagaaugcguauguauuaacgguaccugcacaguugugaugaccgacggcagcgcgagugggaaagcagauacgcgcauccucuuuauaagagagggaaagauuguccacaucucucccuuauccggcagcgcccaacauguggaagagugcucguguuacccucaguauccagaggugaggugcgucugucgggacaauuggcgcgguucuaaccgaccgguucuguacaucaacauggcugauuauuccauugacucaggguacgugugcaguggacuuguaggcgacacucccagaaaugaugacaucagcuccucuagcaacuguaaagauccuaauaacgaaaggggcgccccaggggugaagggaugggcauucgacucagguaaugauauuuggaugggccggacaauagagaaggacagucguuccggguacgaaaccuuucgcgucaucggaggcuggaacacugcuaauagcaaaucucagacaucaagacaggugauuguugauagugacaacagcuccgguuauucugggaucuucucgguggagggcaagagcugcaucaauagguguuuuuacgucgaauugauucggggacgacccaaagagacccgcgugugguggacguccaacucaauaaucguauucugcggcaccagugggacauauggaacugguucuuggccugauggcgccaauauuaacuuuauggcgaucuga

SEQ ID NO: 145532 - RNA, 1410 nt, Artificial Sequence
  derived and/or modified sequence opt3 from neuraminidase__InfluenzaA__AGQ81718
augaaccccaaucagaagaucauugccauaggcagcgugucccugaccaucgcuacaauuugccuccuuaugcaaaucgcaauucuggucacuacgaugaccuugcacuucaaacauaacgaguguacaaauucuucaaacaaucaggccguuccuugcgggccaaucauaaucgaaagaaacuuaacugagauugugcaccugaauaguaccauccuagaaaaggagauuuguccgaaagcggcuggauacaggaacuggagcaagccccagugccagaucacagguuuugccccuuucuccaaagacaauucuauacggcucucggcaucaggcgauauuuggguaacccgcgaaccauaugugagcugugggcugggaaagugcuaccaauuugcccuuggccaggguacuacacuggacaaccgacauaguaaugggaccucccacgaucguacgccccauagaacuuugcucaugaacgagcugggagucccuuuccaccugucuaccaaacagguguguaucgcuuggagcuccucaaguugccacgacggcaaggcauggcuccauguuugugugacaggcgaugacaggaaugccacugcuagcauuaucuaugaugggaucuuagucgacucuauuguguccuggucaaagaacauacugcggacccaggagagcgaaugcguauguaucaauggaacaugcaccguugugaugacggaugguagugccucuggcaaagcggacacucgcauucuuuuuaucagagaggggaagauaguccacauuuccccauugagcggaucggcacaacauguggaagagugcucuuguuaccccagguauccugaggugcggugcgucugucgcgauaacuggcgaggcuccaacagaccaguucuguacaucaauauggccgacuauucaaucgauagugguuacgugugcagcgggcuaguaggagacacaccgaggaacgacgauaccuccucuagcucaaauugucgggaccccaacaaugaacguggcgcuccuggcgugaaagggugggccuucgauaguggaaacgacauuuggaugggucgcacuaucgagaaggauuccagaagcggcuacgaaacauuuagggucauugggggauggaauaccgcaaacucuaagucacagacgagucgacaggugauaguugacagcgauaauuccucuggcuauucggguguguucagcgucgaggggaaauccugcaucaaccgguguuuuuacguggaacucauucgcggcagaccaaaggagaccaggguaugguggacaucaaauaguaucaucguuuucugcggaacuucuggcaccuaugggacaggaagcuggcccgacggugcuaacauuaauuuuauggccauauga

SEQ ID NO: 145533 - RNA, 1410 nt, Artificial Sequence
  derived and/or modified sequence opt3 from neuraminidase__InfluenzaA__AGQ81719
augaaccccaaucagaagaucauugccauaggcagcgugucccugaccaucgcuacaauuugccuccuuaugcaaaucgcaauucuggucacuacgaugaccuugcacuucaaacauaacgaguguacaaauucuucaaacaaucaggccguuccuugcgggccaaucauaaucgaaagaaacgugacugagauuguacacuuaaauaguaccacacuggaaaaggagaucuguaccaaagcggcuggauacagggacuggagcaagccgcagugccagauuacugguuuugcccccuucuccaaagauaacucuauccggcuaucggcaucaggcgacauaugggugacacgcgaaccuuaugucagcugugggcucggaaagugcuaccaauuugcccugggccaggguaccacgcuugauaaucgacauaguaacgggacuacccacgaccguacaccacauagaacucuguugaugaaugagcucggagugcccuuccaccuggcuaccaagcagguuuguauugcaugguccucuagcuccugccacgauggcaaagccuggcugcaugugugugucacaggcgacgauaggaacgcuaccgccucaaucauuuaugacgggauccucguggauaguaucggaagcuggucuaagaauauuuuacggacgcaggaguccgaaugcguauguauaaacgguacuugcacaguugugaugaccgacggcucagcgagcgggaaagcagauacucgcauccuguuuauuagagagggaaagaucguccacauaaguccucuuucuggcuccgcccaacauguggaagagugcagcuguuacccacaguaucccgaggugaggugcgucugucgggacaauuggcgcgguucgaaccgaccuguuuuguacauuaacauggcugauuauucuaucgacuccggguacgugugcucaggacugguaggcgacacaccaagaaaugaugacaucaguagcaacuccaauuguaaagauccgaacaaugaaucuggcgcccccggggugaagggaugggcauucgacagcgguaacgauauuuggaugggcaggaccaucgagaaggacucacggaguggguacgaaacguuucgugucauuggaggcuggaauaccgcuaacuccaaaagccagacaucucgccaggugauaguugauucagacaauaguagcgguuauuccgggaucuucucuauugagggcaagucgugcaucaacagauguuuuuacguggaacuaaucaggggacggccuaaagagacucgagucugguggaccagcaauuccauuauaguguucugcggcacaucagggacuuauggaaccgguaguuggccagauggcgccaacaucaauuuuauggcgauuuga

SEQ ID NO: 145534 - RNA, 1410 nt, Artificial Sequence
  derived and/or modified sequence opt3 from neuraminidase__InfluenzaA__AGQ81722
augaaccccaaucagaagaucauugccauaggcagcgugucccugaccaucgcuacaauuugccuccuuaugcaaaucgcaauucuggucacuacgaugaccccucacuucaaacaugacgaguguacaaacucuucaaauaaccaggccguuccaugcgggccgaucauaaucgaaagaaaugugacugagauuguacacaucaacaguaccauuuuggaaaagggaaucugucccaaagcggcugguuacaggaauuggagcaagccucagugccagauaauuggcuuugccccauucuccaaagauaacucuauccgguuaucggcaucaggggacauuugggugacacgcgagcccuaugucagcuguggacugggcaagugcuaccaauuugcccuaggucaggggaccacucucgauaaucgacauaguaacggaacaucccacgaccguaccccucauagaacgcugcuuaugaaugaacugggcgugccauuccacuuggcuacuaagcagguuuguaucgcauggucuagcuccucaugccacgauggcaaagccuggcuccaugugugugucaccggggacgauaggaacgcuacagccaguaucauuuaugacggaaugcugguggauagcauagguucuugguccaagaauauccugcggacucaggagucagagugcguauguauuaacgggaccugcacaguugugaugaccgacgggagcgcgaguggaaaagcagauacgcgcauccucuuuauaagagaaggcaagauuguccacaucucucccuuauccgguagcgcccaacauguggaggaaugcucguguuacccucaguauccagaggugaggugcgucugucgggacaauuggcgcgggucuaaccgaccgguucuguacaucaacauggcugauuauuccauugacucaggauacgugugcaguggccuuguaggcgacacucccagaaaugaugacacaagcuccucuagcaacuguaaagauccuaauaacgagaggggcgccccaggagugaaggguugggcauucgacucaggcaaugauaucuggauggggcggaccauugaaaaggacagucguuccggauacgagacuuuucgcgucauaggcgguuggaacacagcuaauagcaaaucucagaccucaagacaggugaucguugauagugacaacagcuccggguauucuggcauuuucucgguggaaggaaagagcugcaucaauagguguuuuuacgucgaguugauccggggccgacccaaagaaacgcgcgugugguggaccuccaacucaauuauaguauucugcgggacaaguggaacuuaugguaccggcucuuggccugauggggccaauaucaacuuuauggcgauuuga

SEQ ID NO: 145535 - RNA, 1410 nt, Artificial Sequence
  derived and/or modified sequence opt3 from neuraminidase__InfluenzaA__AGQ81724
augaaccccaaucagaagaucauugccauaggcagcgugucccugaccaucgcuacaauuugccuccuuaugcaaaucgcaauucuggucacuacgaugaccuugcacuucaaacauaacgaguguucuaauucaaguaacaaucaggccguuccuugcgggccaaucauaaucgaaagaaacgugacagagauuguacacuuaaauagcacuacccuggaaaaggagaucuguccgaaagcggcuggauacagggacugguccaagccccagugccagauuacagguuuugccccuuucucuaaagauaacucgauccggcuaucagcaagcggcgacauaugggugacccgcgaaccauaugucaguugugggcucggaaagugcuaccaauuugcccugggccaggguacuacacuugauaaucgacauuccaacgggaccucucacgaccguacgccccauagaacucuguugaugaaugagcucggagugccuuuccaccuggcuaccaagcagguuuguauugcauggagcuccucaaguugccacgauggcaaagccuggcugcaugugugugucacaggcgacgauaggaacgcuacugccagcaucauuuaugacgggauccucguggauucuaucggauccuggucaaagaauauuuuacggacccaggagagcgaaugcguauguauaaacgguacaugcaccguugugaugacggacggcagugcgucugggaaagcagauacucgcauccuguuuauuagagagggaaagaucguccacauauccccacuuagcggcucggcccaacauguggaagagugcucuuguuacccccaguauccugaggugaggugcgucugucgggacaauuggcgcgguuccaaccgaccaguuuuguacauuaacauggaagauuauucaaucgacaguggguacgugugcagcggacugguaggcgacacaccgagaaaugaugacaucuccucuagcucaaacuguaaagaucccaauaacgagaggggcgcuccuggggugaagggaugggccuucgacagugguaaugaucuauggaugggccggaccauugaaaaggacucccguagcggguacgagacuuuucgcgucaucggaggcuggaacacagcaaauucuaaaucacagaccaguagacaggugauuguugauagcgacaacuccucugguuauucggggauauucagcguggaaggcaaguccugcaucaauagguguuuuuacgucgagcucauucggggacgaccaaaagagacgcgcgugugguggaccucaaacaguaucaucguauucugcggcacaucugggacuuauggaaccgguagcuggcccgauggcgcuaauauuaacuuuauggccauauga

SEQ ID NO: 145536 - RNA, 1410 nt, Artificial Sequence
  derived and/or modified sequence opt3 from neuraminidase__InfluenzaA__AGQ81726
augaaccccaaucagaagaucauugccauaggcagcgugucccugaccaucgcuacaauuugccuccuuaugcaaaucgcaauucuggucacuacgaugaccuugcacuucaaacauaacgaguguucuaauucaaguaacaaucaggccguuccuugcgggccaaucauaaucgaaagaaacauuacagagaucgugcacuuaaauagcacuacccuggaaaaggagauuuguccgaaagcggcuggauacagggacugguccaagccccagugccagaucacagguuuugccccuuucucuaaagauaacucgauacggcuaucagcaagcggcgacauuuggguaacccgcgaaccauaugugaguugugggcucggaaagugcuaccaauuugcccugggccaggguacuacacuugauaaucgacauuccaacgggaccucucacgaccguacgccccauagaacucuguugaugaaugagcucggagucccuuuccaccuggcuaccaaacagguguguaucgcauggagcuccucaaguugccacgauggcaaggccuggcugcauguuugugugacaggcgacgauaggaacgcuacugccagcauuaucuaugacgggauccucgucgauucuauuggauccuggucaaagaauauauuacggacccaggagagcgaaugcguguguaucaaacgcacaugcaccguaguuaugacggacgguagugcgucuggcaaggcagauacuaggauucuguuuaucagagaggggaaaauagugcacauuuccccacuuagcggaucggcccaacaugucgaagagugcucuuguuacccccaguauccugaggugcggugcgugugucgcgacaacuggcgaggcuccaauagaccagucuuguacaucaacauggcugauuauucaaucgacagugguuacguuugcagcgggcuggugggagacacaccgaggaacgaugacauuuccucuagcucaaauuguaaggaucccaacaaugaacggggcgccccuggcguaaaggggugggcauucgacaguggaaacgaucuauggaugggucguaccaucgagaaagaaucccgcagcggcuacgagacuuuuagagugauugggggauggaauacagcuaacucuaagucacagaccaguaggcaggucauaguggacagcgauaauuccucuggcuauucggguaucuucagcguugaagggaaauccugcauuaaccgguguuuuuacguggagcucauccgaggccgcccaaaggagacgagagucugguggaccucaaauaguaucauuguguucugcggaacaucuggcacuuaugggaccggaagcuggcccgacggugccaacauaaauuuuauggcgaucuga

SEQ ID NO: 145537 - RNA, 1410 nt, Artificial Sequence
  derived and/or modified sequence opt3 from neuraminidase__InfluenzaA__AGQ81727
augaaccccaaucagaagaucauugccauaggcagcgugucccugaccaucgcuacaauuugccuccuuaugcaggucgcaauccugguuacuacgaugaccuugcacuucaaacauaacgaguguucuaauucaaguaacaaucaggccgugccuugcgggccaauuaucauagaaagaaacaucacagagauuguacacuuaaauagcacuacccuggaaaaggagaucuguccgaaagcggcuggauacagggacugguccaagccccagugccagauuacagguuuugccccuuucucuaaagauaacucgauccggcuaucagcaagcggcgacauaugggugacccgcgaaccauaugucaguugugggcucggaaagugcuaccaauuugcccugggccaggguacuacacuugauaaucgacauuccaacgggaccucucacgaccguacgccccauagaacucuguugaugaaugagcucggagugccuuuccaccuggcuaccaagcagguuuguauugcauggagcuccucaaguugccacgauggcagggccuggcugcaugugugugucacaggcgacgaucggaacgcuacugccagcaucauuuaugacgggauccucguggauucuaucggauccuggagcaaaaauauuuuacgcacccaggagucagaaugcguauguauaaacgguacaugcaccguugugaugacggacggcagugcgucugggaaggcagauacuagaauccuguuuauuagggagggaaaaaucguccacauauccccacuuagcggcucggcccaacauguggaagagugcucuuguuacccccaguauccugaggugcggugcgucugucgcgacaauuggcgagguuccaacagaccaguuuuguacauuaacauggcugauuauucaaucgacaguggguacgugugcagcggacugguaggcgacacaccgaggaaugaugacaucuccucuagcucaaacuguaaggaucccaauaacgaacggggcgccccuggggugaaaggaugggcauucgacagugguaaugaucuauggaugggccguaccauugagaaggaaucccgcagcggguacgagacuuuuagagucaucggaggcuggaacacagcuaauucuaagucacagaccaguaggcaagugauuguugacagcgauaacuccucugguuauucggggauauucagcguggaaggcaaauccugcaucaaucgguguuuuuacgucgagcucauucgaggacgcccaaaggagacgagagugugguggaccucaaacaguaucaucguauucugcggcacaucugggacuuauggaaccgguagcuggcccgacggcgccaauauuaacuuuaugccuauauga

SEQ ID NO: 145538 - RNA, 1410 nt, Artificial Sequence
  derived and/or modified sequence opt3 from neuraminidase__InfluenzaA__AGQ81728
augaaccccaaucagaagaucguggccauuggcagcgucucccugaccauagcuacaaugugccuccuuaugcaaaucgcacuguucgccacuacgaugaccuugcacuuuaaacagacagggucuacuaacucaagugacaaucaggcgguuccuuguggaccaauuaucauugagagaaacaucaccgaaauagugcauuuaaauagcacaacccuggagaaggaaacuugcccgaaauccgcugguuacaggaacuggucuaagccccagugucaaaucacaggcuucgccccuuuuucgaaagauaauucaauucggcuaagcgcagggggagacaucuggguaacccgcgagccauaugugaguugcggccucgguaaguguuaccaguucgcccuggggcagggaacgacucuugauaacaagcacuccaauggcaccacauaugaccgaacuccccaucguacccuguugaugaacgaacucggcgucccuuuucaccuggcuacaaaacaggugugcauugcauggucuagcuccucaugucaugaugggaaggccuggcugcacguuugcgugaccggagacgauaaaaaugcuacggccaguaucauauacgacgguauucucgucgauagcaucgcgucuugguccaagaacauuuuaagaacucaagagucagagugugugugcaucaauggcacauguaccguaguuaugacugacgggagcgcaaguggaagggccgauacacggauccuguucauucgcgaaggcaaaauagugcacaucucuccacuuuccgguagcgcucagcaugucgaggaaugcucgugcuaucccagauacccugaggugaggugugugugccgggacaacuggaaggggucuaaucgcccagucuuguauauuaacauggccgauuacuccaucgacucaaguuacguuuguagcggaauagugggcgacaccccgcgaaacgaugacagauccucuagcucaaauugcagggaucccaacaaugagauuggcgcaccugggguaaagggaugggcuuuugacagugguaacgauaucuggaugggccggacgaucgaaaaagacucccguagcggguaugagaccuuccgcgugauuggaggcuggucuacagccaauucaaagagucagaucaacagacaggucauuguggauagggacaauagcuccgguuacucugggauauuuucgguugaaggcaaaagcuguaucaaccggugcuucuauguggagcugauucgaggacgcccaaaggaaaauagagucugguggacuuccaacucaaucaucguguuuuguggcaccagugggacauacggaacugguucuuggcccgauggcgcgaauauuaaccuaaugccuauauga

SEQ ID NO: 145539 - RNA, 1410 nt, Artificial Sequence
  derived and/or modified sequence opt3 from neuraminidase__InfluenzaA__AGQ81729
augaaccccaaucagaagaucauugccauaggcagcgugucccugaccaucgcuacaauuugccuccuuaugcaaaucgcaauucuggucgccacuaugacguugcacucuaaacauggggaguguaccaacucaaguaauaaccaggcgguuccuugcggaccaaucauaaucgaaagaaaugugacagagauuguacacuuaaacagcacuacccuggaaaaggagaucuguccgaaagcugccgguuacagggacugguccaagccccagugccagauuacaggcuucgcaccuuuuucuaaagauaauucgauccggcuaucagccagcggggacauaugggugacccgcgaaccauaugucaguuguggacucggcaagugcuaccaauucgcucugggucaggggacuacacuugauaaccgacauuccaauggaaccucucacgaccguacgccccauagaacucuguugaugaacgagcucggcauuccuuuucaccuggcaaccaaacagguguguaucgccuggagcuccucaaguugccacgauggcaaggcuuggcugcauguuugugugacaggggacgauaggaaugccacugcgagcauuaucuaugacggaaugcucgucgauucuaucgguuccuggucaaagaacauuuuacggacccaggagagcgaaugcguguguauaaauggcacaugcaccguaguuaugacggacgggagugcaucuggaaaagccgauacucgcauccuguucauuagagagggcaagaucgugcacauauccccacuuuuggguagcgcucaacaugucgaagagugcucguguuacccccaguauccugaggugaggugcgugugucgggacaacuggcgcgggucuaaucgaccaguccuguacauuaacauggccgauuauuccguugacucaggauacgugugcaguggccuaguaggcgacacaccgagaaacgaugacaccagcuccucuagcaauuguaaagaucccaacaaugaaaggggagcaccuggggugaaggguugggcuuuugacucaggcaacgauaucuggauggggcggacuaucgagaaggacagucguuccggauacgaaacauuccgcgucauuggcgguuggaauaccgccaacagcaaaucucagacgucaagacaggugaucguugauagugacaauagcuccggguauucuggcauuuuuaguguggagggaaagagcugcauaaacagguguuucuacgucgaacucauccggggccgaccaaaagagacccgcgugugguggacauccaauucaauuaucguauuuugcgggacuucgggaaccuaugguacaggcucuuggcccgauggggcgaacaucaauuucaugccuauuuga

SEQ ID NO: 145540 - RNA, 1410 nt, Artificial Sequence
  derived and/or modified sequence opt3 from neuraminidase__InfluenzaA__AGQ81730
augaaccccaaucagaagaucauugccauaggcagcgugucccugaccaucgcuacaauuugccuccuuaugcaaaucgcaauucuggucacuacgaugaccuugcacuucaaacauaacgaguguaucaauucuucaaacaaucagaguguuccuugcgggccaauaaucauugaaagaaacgugacagagaucguacacuuaaauagcacuacccuggaaaaggagauuuguccgaaagccgcgggauacagggacugguccaagccccagugccagaucacagguuuugcuccuuucucuaaagauaacucgauacggcuaucagccagcggcgacauuugggugacccgcgaaccauaugucaguugugggcucggaaagugcuaccaauuugcacugggccaggguacuacacuugauaaucgacauuccaacgggaccucucacgaccguacgccccauagaacucuguugaugaaugagcucggagugccuuuccaccuggccagcaagcagguuuguaucgcuugguccucaaguagcugccacgauggcaaagcauggcugcaugugugugucaccggcgacgauaggaacgccacagcuucuauuaucuaugacgggaugcucguggauuccaucggaucauggagcaagaauauuuuacggacucaggagagugaaugcguauguauaaacgguaccugcacaguugugaugaccgacggcucugccuccggggaggcggauacgcgcauccuguuuauuagagaaggaaaaaucguccacauaagcccacuuucgggcucugcacaacauguggaggagugcuccuguuacccccaguauccugaagugaggugcgucugucgggacaauuggcgcgguucaaaccgaccaguuuuguacauuaacauggccgauuauaguaucgacagcggguacgugugcuccggacugguaggcgacacuccgagaaaugaugacaucucuagcucaaguaacuguaaggaucccaauaacgagaggggcgcuccuggggugaaaggaugggccuucgacuccgguaaugauauuuggaugggccggacaaucgaaaaggacagccguucuggguacgagaccuuucgcgucauuggaggcuggaacacugcaaauucaaagagucagacaagcagacaggugauaguugauuccgacaacucuucggguuauagcgggaucuucuccguggaaggcaaaucaugcauuaauagguguuuuuacgucgagcuaauccggggacgaccaaaggagacccgcgugugguggacgaguaacucuaucauuguauucugcggcaccagcgggacauauggaacugguuccuggcccgauggcgcuaauauaaacuuuauggccaucuga

SEQ ID NO: 145541 - RNA, 1410 nt, Artificial Sequence
  derived and/or modified sequence opt3 from neuraminidase__InfluenzaA__AGQ81731
augaaccccaaucagaagaucauugccauaggcagcgugucccugaccaucgcuacaauuugccuccuuaugcaaaucgcaauucuggucacuacgaugaccuugcacuucaaacauaacgaguguucuaauucaaguaacaaucaggccguuccuugcgggccaaucauaaucgaaagaaacauuacagagaucgugcacuuaaauagcacuacccuggaaaaggagauuuguccgaaaacagcgggauacagggacugguccaagccccagugccagaucaccgguuuugcuccuuucucuaaagauaacucgauacggcuaucagccagcggcgacauuuggguaacucgcgaaccauaugugaguuguggguuuggaaagugcuaccaauucgcacucggccaggguacaacccuggauaaucgacauuccaacgggacgucucacgaccguacuccccauagaacccuucugaugaaugaguugggagucccuuuucaccucgccacaaaacagguguguaucgcuuggagcuccucaaguugccacgauggcaaggcauggcugcauguuugugugacuggcgacgauaggaacgccaccgcuagcauuaucuaugacgggauccuggucgauucuauuggauccuggucaaagaauauacuccggacacaggagagcgaaugcguguguaucaacgguaccugcacgguaguuaugacugacggcagugccucugggaaagcggauacacgcauuuuauucaucagagagggaaagauagugcacauuuccccacugagcggcucggcacaacaugucgaagagugcucuuguuacccccaguauccugaggugaggugcgugugucgggacaauuggcgcgguuccaaccgaccaguccuuuacaucaacaugaccgauuauucaaucgacaguggguacguuugcagcggauuggugggcgacacuccgagaaaugaugacauuuccucuagcucaaacuguaaagaucccaauaacgaaaggggcgccccugggguaaagggaugggcuuuugacagugguaaugaucuguggaugggccggacaaucgagaaggaaucccguagcggguacgagaccuuccgcgugauuggaggcuggaacacggccaauucuaaaucacagaccaguagacaggucauaguggacagcgauaacuccucugguuauucggggaucuuuagcguugaaggcaaguccugcauuaauagguguuucuacguggagcuaauccggggacgaccaaaagagacacgcgucugguggacuucaaacaguaucauuguguuuugcggcaccucugggacauauggaacugguagcuggcccgacggcgcaaauauaaacuucauggcuaucuga

SEQ ID NO: 145542 - RNA, 1410 nt, Artificial Sequence
  derived and/or modified sequence opt3 from neuraminidase__InfluenzaA__AGQ81732
augaaccccaaucagaagaucauugccauaggcagcgugucccugaccaucgcuacaauuugccuccuuaugcaagucgcaauccugguuacuacgaugaccuugcacuucaaacauaacgaguguucuaauucaaguaacaaucaggccgugccuugcgggccaauuaucauagaaagaaacaucacagagauuguacacuuaaauagcacuacccuggaaaaggagaucuguccgaaagcggcuggauacagggacugguccaagccccagugccagauuacagguuuugccccuuucucuaaagauaacucgauccggcuaucagcaagcggcgacauaugggugacccgcgaaccauaugucaguugugggcucggaaagugcuaccaauuugcccugggccaggguacuacacuugauaaucgacauuccaacgggaccucucacgaccguacgccccauagaacucuguugaugaaugagcucggagugccuuuccaccuggcuaccaagcagguuuguauugcauggagcuccucaaguugccacgauggcaaagccuggcugcaugugugugucacaggcgacgauaggaacgcuacugccagcaucauuuaugacgggauccucguggauucuaucggauccuggucaaagaauauuuuacggacccaggagagcgaaugcguauguauaaacgguacaugcaccguugugaugacggacggcagugcgucugggaaagcagauacucgcauccuguuuauuagagagggaaagaucguccacauauccccacuuagcggcucggcccaacauguggaagagugcucuuguuacccccaguauccugaggugaggugcgucugucgggacaauuggcgcgguuccaaccgaccaguuuuguacauuaacauggcugauuauucaaucgacaguggguacgugugcagcggacugguaggcgacacaccgagaaaugaugacaucuccucuagcucaaacuguaaagaucccaauaacgaaaggggcgccccuggggugaagggaugggcauucgacagugguaaugaucuauggaugggccggaccauugagaaggaaucccguagcggguacgagacuuuucgcgucaucggaggcuggaacacagcuaauucuaaaucacagaccaguagacaggugauuguugacagcgauaacuccucugguuauucggggauauucagcguggaaggcaaguccugcaucaauagguguuuuuacgucgagcucauucggggacgaccaaaagagacgcgcgugugguggaccucaaacaguaucaucguauucugcggcacaucugggacuuauggaaccgguagcuggcccgacggcgccaauauuaacuuuaugccuauauga

SEQ ID NO: 145543 - RNA, 1410 nt, Artificial Sequence
  derived and/or modified sequence opt3 from neuraminidase__InfluenzaA__AGQ81733
augaaccccaaucagaagaucauugccauaggcagcgugucccugaccaucgcuacaauuugccuccuuaugcaaaucgcaauucuggucacuacgaugaccuugcacuucaaacauaacgaguguucuaauucaaguaacagccaggccguuccuugcgggccaaucauaaucgaaagaaaugugacagagauuguacacuuaaacuccacuacccuggaaaaggagaucuguccgaaagcggcugaauacagggacuggucuaagccccagugccagauuacaggauuugccccuuucucgaaagauaauucaauccggcuaagcgcaaguggugacauaugggugacccgcgagccauaugucuccuguggccucgggaagugcuaccaauuugcccugggacagggcacuacacuugauaaccgacauucuaaugguaccagccacgaccguacgccccauagaacucuguugaugaacgagcucggggugccuuuccaccuggcuaccaagcagguuuguauugcaugguccucaaguagcugccacgauggaaaagccuggcugcaugugugugucacaggcgacgauaggaaugcuacugccucuaucauuuaugacggcauccucguggauuccaucgggucauggagcaagaacauuuuacggacccaggaaagugagugcguauguauaaauggaacaugcaccguugugaugacggacgguucugcguccggcaaagcagauacucgcauccuguuuauuagagaagggaagaucguccacauaagcccacuuucgggaucugcccaacauguggaggagugcuccuguuacccccaguauccugaagugaggugcgucugucgggacaacuggcgcggcucaaaucgaccaguuuuguacauuaacauggcugauuauaguaucgacagcgguuacgugugcuccgggcugguaggagacacaccgagaaacgaugacaucucuagcucaaguaauuguaaagaucccaacaaugagaggggcgccccuggcgugaaggggugggcauucgacuccggaaacgaucuauggaugggucggaccauugaaaaggacagccguucuggcuacgagacuuuucgcgucaucgggggauggaauacagcuaacucaaaaagucagaccagcagacaggugauuguugauuccgacaauucuucgggcuauagcgguauauucuccguggaagggaagucaugcaucaacagguguuuuuacgucgagcucauucggggccgaccaaaagagacgcgcgugugguggaccaguaauucuaucaucguauucugcggaacaagcggcacuuaugggaccggauccuggcccgauggugccaacauuaauuuuaugccuauauga

SEQ ID NO: 145544 - RNA, 1410 nt, Artificial Sequence
  derived and/or modified sequence opt3 from neuraminidase__InfluenzaA__AGQ81734
augaaccccaaucagaagaucauugccauaggcagcgugucccugaccaucgcuacaauuugccuccuuaugcaaaucgcaauucuggucacuacgaugaccuugcacuucaaacauaacgaguacucuaauucaaguaacaaucaggccguuccuugugggccaaucauaaucgaaagaaacauuacagagaucgugcacuuaaauagcacuacccuggaaaaggagauuugcccgaaagcggcuggauauagggacugguccaagccccagugucagaucacagguuuugccccuuucucuaaagauaacucgauacggcuaucagcaagcggcgacauuuggguaacccgcgaaccauacgugaguugcgggcucggaaaguguuaucaauuugcccugggccaggguacuacacuugauaaucgacauuccaacgggaccucucacgaccguacgccccauagaacucuguugaugaaugagcucggagucccuuuccaccuggcuaccaaacaggugugcaucgcauggagcuccucaaguugucacgauggcaaggccuggcugcauguuugcgugacaggcgacgauaggaacgcuacugccagcauuaucuacgacgggauccucgucgauucuauuggauccuggucaaagaauauauuacggacccaggagagcaaaugugugugcaucaagcgcacauguaccguaguuaaaacggacgguagugcgucuggcaaggcagauacuaggauucuguuuaucagagaagggaagauagugcacauuuccccacuuagcggaucggcccaacaugucgaggaaugcucuugcuauccccaguacccugaggugcggugugugugccgcgacaacuggcgaggcuccaauagaccagucuuguauaucaacauggcugauuacucaaucgacagugguuacguuuguagcgggcuggugggagacacaccgaggaacgaugacauuuccucuagcucaaauugcaaagaucccaacaaugagcggggcgccccuggcguaaaggggugggcauucgacaguggaaacgaucuauggaugggucguaccaucgaaaaagagucccgcagcggcuaugaaacuuuuagagugauugggggauggaauacagcuaacucuaagucacagaccaguaggcaggucauaguggacagcgauaauuccucuggcuacucggguaucuucagcguugaggggaaauccuguauuaaccggugcuuuuauguggaacucauccgaggccgcccaaaggagacgagagucugguggaccucaaauaguaucauuguguucuguggaacaucuggcacuuacgggaccggaagcuggcccgacggugccaacauaaauuuuauggcgaucuga

SEQ ID NO: 145545 - RNA, 1410 nt, Artificial Sequence; identical to SEQ ID NO: 145543
  derived and/or modified sequence opt3 from neuraminidase__InfluenzaA__AGQ81735

SEQ ID NO: 145546 - RNA, 1410 nt, Artificial Sequence
  derived and/or modified sequence opt3 from neuraminidase__InfluenzaA__AGQ81736
augaaccccaaucagaagaucauugccauaggcagcgugucccugaccaucgcuacaauuugccuccuuaugcaaaucgcaauucuggucgccacuaugacguugcacucuaaacauggggaguguaccgacucaaguaacaaucaggcgguuccuugcggaccaaucauaaucgaaagaaacgugacagagauuguacacuuaaauagcacuacccuggaaaaggagaucuguccgaaagcugccgguuacaaggauugguccaaaccccagugccagauuacaggcuucgcaccuuuuucuaaggacaacucgaucaggcuaucagccagcggggauauaugggugacccgggaaccauaugucaguuguggacucggcaagugcuaccaauucgcucugggucaggggacuacacuugacaaucgccauuccaacggaaccucucacgaucgaacgccccaucguacucuguugaugaaugagcucggcgugccuuuucaccuggcaaccaaacagguuuguauugccuggagcuccucaaguugccacgacggcaaggcuuggcugcaugugugugucacaggggaugacagaaacgccacugcgagcaucauuuaugauggaaugcucguggacucuaucgguuccuggagcaaaaauaucuuaaggacccaggagucagaaugcguauguauuaacggcacaugcaccguugugaugacggaugggagugcaucuggaaaggccgacacucggauacuguucauccgcgagggcaaaauugcucacaucuccccacuuagcgguucggcccaacaugucgaagagugcucuuguuacccccaguauccugaggugagaugcguguguagggauaauuggcggggguccaaccgcccagucuuguacauaaauauggcagacuauucaguugacaguggauacgugugcagcggccugguaggcgauacaccgcgaaacgacgauaccuccucuagcucaaacuguaaggaccccaauaacgaaagaggggcuccuggagugaaggguugggccuuugauaguggcaaugacauuuggauggggaggacuaucgagaaagauucccggagcggauacgaaacauuccgugucaucggcgguuggaacaccgccaauucuaagucacagacgagucgccaggugauuguugacagcgauaacuccucuggguauucgggcaucuuuagcguggagggaaaauccugcauuaauagauguuucuacgucgaacuaauaaggggccggccaaaggagacccgagugugguggacaucaaacaguaucauuguauuuugcgggacuucuggaaccuaugguacaggcagcuggcccgacggggcgaauaucaacuucaugccuaucuga

SEQ ID NO: 145547 - RNA, 1410 nt, Artificial Sequence
  derived and/or modified sequence opt3 from neuraminidase__InfluenzaA__AGQ81737
augaaccccaaucagaagaucauugccauaggcagcgugucccugaccaucgcuacaauuugccuccuuaugcaaaucgcaauucuggucacuacgaugaccuugcacuucaaacauaacgaguguucuaauucaaguaacaaucaggccguuccuugcgggccaaucauaaucgaaagaaacauuacagagaucgugcacuuaaauagcacuacccuggaaaaggagauuuguccgaaagcggcuggauacagggacugguccaagccccagugccagaucacagguuuugccccuuucucuaaagauaacucgauacggcuaucagcaagcggcgacauuuggguaacccgcgaaccauaugugaguugugggcucggaaagugcuaccaauuugcccugggccaggguacuacacuugauaaucgacauuccaacgggaccucucacgaccguacgccccauagaacucuguugaugaaugagcucggagucccuuuccaccuggcuaccaaacagguguguaucgcauggagcuccucaaguugccacgauggcaaggccuggcugcauguuugugugacaggcgacgauaggaacgcuacugccagcauuaucuaugacgggauccucgucgauucuauuggauccuggucaaagaauauauuacggacccaggagagcgaaugcguguguaucaacgguacaugcaccguaguuaugacggacggcagugcgucugggaaagcagauacucgcauucuguuuaucagagagggaaagauagugcacauuuccccacuuagcggcucggcccaacaugucgaagagugcucuuguuacccccaguauccugaggugaggugcgugugucgggacaauuggcgcgguuccaaccgaccagucuuguacaucaacauggcugauuauucaaucgacaguggguacguuugcagcggacuggugggcgacacaccgagaaaugaugacauuuccucuagcucaaacuguaaagaucccaauaacgaaaggggcgccccugggguaaagggaugggcauucgacagugguaaugaucuauggaugggccggaccaucgagaaggaaucccguagcggguacgagacuuuucgcgugauuggaggcuggaacacagcuaauucuaaaucacagaccaguagacaggucauaguggacagcgauaacuccucugguuauucggggaucuucagcguugaaggcaaguccugcauuaauagguguuuuuacguggagcucauccggggacgaccaaaagagacgcgcgucugguggaccucaaacaguaucauuguguucugcggcacaucugggacuuauggaaccgguagcuggcccgacggcgccaauauaaacuuuauggcgaucuga

SEQ ID NO: 145548 - RNA, 1410 nt, Artificial Sequence
  derived and/or modified sequence opt3 from neuraminidase__InfluenzaA__AGQ81738
augaaccccaaucagaagaucauugccauaggcagcgugucccugaccaucgcuacaauuugccuccuuaugcaagucgcaauccugguuacuacgaugaccuugcacuucaaacauaacgaguguucuaauucaaguaacaaucaggccgugccuugcgggccaauuaucauagaaagaaacaucacagagauuguacacuuaaauagcacuacccuggaaaaggagaucuguccgaaagcggcuggauacagggacugguccaagccccagugccagauuacagguuuugccccuuucucuaaagauaacucgauccggcuaucagcaagcggcgacauaugggugacccgcgaaccauaugucaguugugggcucggaaagugcuaccaauuugcccugggccaggguacuacacuugauaaucgacauuccaacgggaccucucacgaccguacgccccauagaacucuguugaugaaugagcucggagugccuuuccaccuggcuaccaagcagguuuguauugcauggagcuccucaaguugccacgauggcaaagccuggcugcaugugugugucacaggcgacgauaggaacgcuacugccagcaucauuuaugacgggauccucguggauucuaucggauccuggucaaagaauauuuuacggacccaggagagcgaaugcguauguauaaacgguacaugcaccguugugaugacggacggcagugcgucugggaaagcagauacucgcauccuguuuauuagagagggaaagaucauacacauuuccccacuuagcggcucggcccaacaugucgaagagugcucuuguuacccccaguauccugaggugaggugcgugugucgggacaauuggcgcgguuccaaccgaccagucuuguacaucaacauggcugauuauucaaucgacaguggguacguuugcagcggacuggugggcgacacaccgagaaaugaugacauuuccucuagcucaaacuguaaagaucccaauaacgaaaggggcgccccugggguaaagggaugggcauucgacagugguaaugaucuauggaugggccggaccaucgagaaggaaucccguagcggguacgagacuuuucgcgugauuggaggcuggaacacagcuaauucuaaaucacagaccaguagacaggucauaguggacagcgauaacuccucugguuauucggggaucuucagcguugaaggcaaguccugcauuaauagguguuuuuacguggagcucauccggggacgaccaaaagagacgcgcgucugguggaccucaaacaguaucauuguguucugcggcacaucugggacuuauggaaccgguagcuggcccgacggcgccaauauaaacuuuaugccuaucuga

SEQ ID NO: 145549 - RNA, 1410 nt, Artificial Sequence
  derived and/or modified sequence opt3 from neuraminidase__InfluenzaA__AGQ81739
augaaccccaaucagaagaucauugccauaggcagcgugucccugaccaucgcuacaauuugccuccuuaugcaaaucgcaauucuggucacuacgaugaccuugcacuucaaacaugacgaguguacaaacucuucaaauaaccaggccguuccuugcgaaccaaucauaaucgagagaaaugugacugaaauuguacacaucaacaguaccauuuuagagaaggaaaucuguccgaaagcggcuggguacaggaauuggagcaagccccagugccagauaacaggauuugccccuuucuccaaagauaacucuauucggcugucggcaucaggugacaucugggugacccgcgagccauaugucagcuguggccuagggaagugcuaccaauuugcccucggacagggcacuacacuggauaaucgacauaguaacgguacccuuaaugaccguacgccccacagaacucuguugaugaacgagcucggggugccuuuccaucuggcuaccaagcagguuuguauugcaugguccucuagcuccugccacgauggaaaagccuggcugcacgugugugucacaggcgacgauaggaaugcuacugccucaaucaucuaugacgauaugcucguggacaguauuggcagcuggucuaagaacauauuacggacccaggaauccgagugcguauguaucaaugggacaugcaccguugugaugacggauggaucagcgagcgguaaagcagacacucgcauucuguuuaucagagaaggcaagauaguccauauuaguccacuuucuggguccgcccaacacguggaggagugcagcuguuacccccaguauccugaagugaggugcgucugucgggauaacuggcgcggaucgaaccgaccaguuuuguacaucaauauggcugacuauucuaucgacuccggcuacgugugcucaggucugguaggggauacaccgagaaacgacgauauuaguagcuccucuaauuguaaagaccccaacaaugagaggggagccccuggcgugaagggcugggcauucgauagcgggaacgacaucuggaugggacggaccauugaaaaggauucacguagugguuacgagacuuuucgcgucauaggcggguggaauacagcuaacuccaaaagccagaccucuagacaggugaucguugacucagauaauaguagcggauauuccggcauuuucucuguggaagguaagucgugcaucaacagguguuuuuacgucgagcuaauccgggggcgaccaaaagagacgcgcgugugguggaccagcaauuccauuauaguauucugcggcacaucaggaacuuauggcaccgggaguuggcccgacggagccaacaucaauuuuauggcgauuuga

SEQ ID NO: 145550 - RNA, 1410 nt, Artificial Sequence
  derived and/or modified sequence opt3 from neuraminidase__InfluenzaA__AGQ81740
augaaccccaaucagaagaucguggccauuggcagcgucucccugaccauagcuacaaucugccuccuuaugcaaauugcaauccugguuacuacgaugaccuugcacuucaaacauggggaguguacaaacucuucaaauaaccaggccgugccuugcggaccaauuaucauagaaagaaauaucacugagauuguacacuuaaacaguaccacacuggaaaaggagaucuguccgaaagcggcugguuacagggacuggagcaagccccagugccagauuaccggcuuugccccuuucuccaaagauaauucuauccggcuaucggcaucaggggacauaugggugacucgcgaaccauaugucagcuguggacucggcaagugcuaccaauuugcccugggucaggggacaacccuugauaaccgacauaguaauggaacgucccacgaccguacuccccauagaacccuguugaugaacgagcucggcgugccuuuccaccuggcuacaaagcagguuuguauugcauggucuagcuccucaugccacgauggcaaagccuggcugcaugugugugucacuggggacgauaggaaugcuaccgccaguaucauuuauaacggaauccucguggacagcaucgguucuugguccaagaauauuuuacggacacaggagucagaaugcguauguauaaacgggaccugcacgguugugaugacugaugggagcgcgaguggaaaagcagacacacgcauccuguuuauuagagagggcaagaucguccacauaucuccacuuuccgguagcgcccaacauguggaagagugcucguguuacccccaguauccugaggugaggugcgucugucgggauaauuggcgcgggucuaaccgaccaguuuuguacauuaacauggcugacuauuccguggauucaggauacguaugcaguggccuggugggcgacaccccgagaaaugacgauacuagcuccucuagcaacuguaaagaccccaauaacgaaaggggcgccccuggagucaaggguugggcauucgauucaggcaaugacaucuggauggggcggacaaucgagaaggaucuacguaguggauacgaaaccuuucgcgugauuggcgguuggaacacggcuaauuccaaaagccagaccucuagacagguuaucguggacucagauaacaguagcggguauuccggcauuuucucugucgagggaaagucgugcauaaauagguguuuuuacguggaacucauccggggccgaccaaaagagacacgcguaugguggacuagcaacuccauuaucguuuucugcgggaccucaggaacauaugguacuggcaguuggcccgacggggccaauaucaacuuuaugccuauuuga

SEQ ID NO: 145551 - RNA, 1410 nt, Artificial Sequence
  derived and/or modified sequence opt3 from neuraminidase__InfluenzaA__AGQ81741
augaaccccaaucagaagaucguggccauuggcagcgucucccugaccauagcuacaaucugccuccuuaugcaaauugcaauccugguuacuacgaugaccuugcacuucaaacauggggaguguacaaacucuucaaauaaccaggccgugccuugcggaccaauuaucauagaaagaaauaucacugagauuguacacuuaaacaguaccacacuggacaaggaaaucuguccgaaagcggcugguuacagggauuggagcaagccccagugccagauuaccggcuuugccccuuucuccaaagacaauucuauccggcuaucggcaucaggggauauaugggugacucgcgagccauaugucagcuguggacucggcaagugcuaccaauuugcccugggucaggggacaacccuugacaaccgacauaguaauggaacgucccacgaucguacuccccauagaacccuguugaugaacgaacucggcgugccuuuccaccuggcuacaaagcagguuuguauugcauggucuagcuccucaugccacgacggcaaagccuggcugcaugugugugucacuggggaugacaggaaugcuaccgccaguaucauuuaugauggaaugcucguggacagcaucgguucuugguccaagaacaucuuacggacacaggagucagagugcguauguauuaaugggaccugcacgguugugaugacugaugggagcgcgaguggaaaagcagacacacgcauacuguuuaucagagaaggcaagauuguccacaucucuccacuuuccgguagcgcccaacauguggaggaaugcucguguuacccccaguauccugaggugaggugcgucugucgggauaacuggcgcgggucuaaucgaccaguuuuguacauaaacauggcugacuauuccguggacucaggauacguaugcaguggccuggugggcgauaccccgagaaacgacgauacuagcuccucuagcaauuguaaagaccccaacaaugagaggggcgccccuggagucaaggguugggcauucgauucaggcaacgacauuuggauggggcggacaaucgaaaaggaucuacguaguggauacgagaccuuucgcgugaucggcgguuggaauacggcuaacuccaaaagccagaccucuagacagguuauuguggacucagauaauaguagcggguauuccggcaucuucucugucgaaggaaagucgugcauuaacagguguuuuuacguggagcucauacggggccgaccaaaagaaacacgcguaugguggacuagcaauuccaucauuguuuucugcgggaccucaggaacauaugguacuggcaguuggcccgacggggccaacaucaauuuuaugccuaucuga

SEQ ID NO: 145552 - RNA, 1410 nt, Artificial Sequence
  derived and/or modified sequence opt3 from neuraminidase__InfluenzaA__AGQ81742
augaaccccaaucagaagaucguggccauuggcagcgucucccugaccauagcuacaaucugccuccuuaugcaaauugcaauccugguuacuacgaugaccuugcacuucaaacauggggaguguacaaacucuucaaauaaccaggccgugccuugcggaccaauuaucauagaaagaaauaucacugagauuguacacuuaaacaguaccacacuggaaaaggagaucuguccgaaagcggcugaauacagggacuggagcaagccccagugccagauuaccgguuuugccccuuucuccaaagauaauucuauccggcuaucggcaucaggcgacauaugggugacucgcgagccauaugucagcugugggcucggaaagugcuaccaauuugcccugggccaggguacaacccuugauaaccgacauaguaaugggacgucccacgaccguacuccccauagaacccuguugaugaacgagcucggagugccuuuccaccuggcuacaaagcagguuuguauugcauggucuagcuccucaugccacgauggcaaagccuggcugcaugugugugucacuggcgacgauaggaaugcuaccgccaguaucauuuaugacgggaugcucguggauagcaucggaucuugguccaagaacaucuuacggacacaggaaucagagugcguauguauuaaugguaccugcacgguugugaugacugacggcagcgcgagugggaaagcagauacacgcauacuguuuaucagagaaggaaagauuguccacaucucuccacuuuccggcagcgcccaacauguggaggagugcucguguuacccccaguauccugaagugaggugcgucugucgggacaacuggcgcgguucuaaucgaccaguuuuguacauaaacauggcugauuauuccguggacucaggguacguaugcaguggacuggugggcgacaccccgagaaacgaugacacuagcuccucuagcaauuguaaagaucccaacaaugagaggggcgccccuggggucaagggaugggcauucgacucagguaacgauauuuggaugggccggacaaucgaaaaggaccuacguaguggguacgagaccuuucgcgugaucggaggcuggaauacggcuaacuccaaaagccagaccucuagacagguuauuguggauucagacaauaguagcgguuauuccgggaucuucucugucgaaggcaagucgugcauuaacagguguuuuuacguggagcucauacggggacgaccaaaagagacacgcguaugguggacuagcaauuccaucauuguuuucugcggcaccucagggacauauggaacugguaguuggcccgauggcgccaacaucaauuuuaugccuaucuga

SEQ ID NO: 145553 - RNA, 1410 nt, Artificial Sequence
  derived and/or modified sequence opt3 from neuraminidase__InfluenzaA__AGQ81744
augaaccccaaucagaagaucauugccauaggcagcgugucccugaccaucgcuacaauuugccuccuuaugcaaaucgcaauucuggucacuacgaugaccuugcacuucagacaugacgaguguacaaacucuucaaauaaccaggccguuccuugcgggccaaucauaaucgaaaggaaugugacugagauuguacacuuaaacaguaccacacuggaaaaagagaucuguccgaaggcggcugaauaccgggauuggagcaaaccccagugccagauuaccggauuugugccuuucuccaaggacaauucuauccgccuaucggccgguggcgauauaugggucacucgagagccauaugugucaugugggcucggaaaaugcuaccaauuugcacugggccaggguacaacccuugacaaccgucauagcaaugggacgagucacgauagaacuccccauaggacccuguugaugaacgagcucggaguuccuuuccaccuggccacaaaacagguguguauugcuugguccucuagcuccugccacgacggcaaggcauggcugcaugucugugugacuggcgaugaccggaaugccaccgcuucaaucauuuaugaugggaugcucguagacaguaucggaagcuggucuaagaacaucuuacgcacacaggaauccgagugcguuuguauuaaugguaccugcacgguggucaugacugauggcucagccagcgggaaggcggacacaagaauacuguuuaucagggaaggaaaaauugugcacaucaguccacuuucuggcuccgcacaacauguggaggagugcagcuguuacccccaguauccugaaguccggugcguuugucgcgauaacuggcgagguucgaauagaccaguguuguacauaaacguagccgacuauucuguggacuccggguacgucugcucaggacuggugggcgauaccccgaggaacgacgauauuaguagcuccucuaauuguaaggaccccaacaaugagcggggcgcuccugggguuaaaggaugggccuucgauagcgguaacgacaucuggaugggccguacuaucgaaaaggauucacgcaguggguacgagacauuuagagugauuggaggcuggaauaccgcaaacuccaagagccagacgucuaggcaggucaucguggacucagauaauccaagugguuauagcgggauuuucuccguagaaggcaaaucuugcauaaaccgguguuuuuacguugagcuaauccgaggacgccccaaggagaccagagugugguggacaucgaauagcauuaucgucuucugcggcacuuccgggaccuauggaacagguucauggccugacggcgcuaacaucaauuuuaugccaauuuga

SEQ ID NO: 145554 - RNA, 1410 nt, Artificial Sequence
  derived and/or modified sequence opt3 from neuraminidase__InfluenzaA__AGQ81746
augaaccccaaucagaagaucauugccauaggcagcgugucccugaccaucgcuacaauuugccuccuuaugcaaaucgcaauucuggucacuacgaugaccuugcacuucaaacauaacgaguguucuaauucaaguaacagccaggccguuccuugcgggccaaucauaaucgaaagaaaugugacagagauuguacacuuaaacuccacuacccuggaaaaggagaucuguccgaaagcggcugaauacaggggauggucuaagccccagugccagauuacagguuuugccccuuucucgaaagacaauucaauccggcuaagcgcaaguggcgauauaugggugacccgcgagccauaugucuccugugaccucgggaagugcuaccaauuugcccugggacagggcacuacacuugauaaccgacauucuaaugguaccagccacgaccguacgccccauagaacucuguugaugaacgagcucggggugccuuuccaccuggcuaccaagcagguuuguauugcaugguccucaaguagcugccacgauggaaaagccuggcugcaugugugugucacaggcgacgauaggaaugcuacugccucuaucauuuaugacggcauccucguggauuccaucgggucauggagcaagaacauuuuacggacccaggaaagugagugcguauguauaaauggaacaugcaccguugugaugacggacgguucugcguccggcaaagcagauacucgcauccuguuuauuagagaagggaagaucguccacauaagcccacuuucgggaucugcccaacauguggaggagugcuccuguuacccccaguauccugaagugaggugcgucugucgggacaacuggcgcggcucaaaucgaccaguuuuguacauuaacauggcugauuauaguaucgacagcgguuacgugugcuccgggcugguaggagacacaccgagaaacgaugacaucucuagcucaaguaauuguaaagaucccaacaaugagaggggcgccccuggcgugaaggggugggcauucgacuccggaaacgaucuauggaugggucggaccauugaaaaggacagccguucuggcuacgagacuuuucgcgucaucgggggauggaauacagcuaacucaaaaagucagaccagcagacaggugauuguugauuccgacaauucuucgggcuauagcgguauauucuccguggaagggaagucaugcaucaacagguguuuuuacgucgagcucauucggggccgaccaaaagagacgcgcgugugguggaccaguaauucuaucaucguauucugcggaacaagcggcacuuaugggaccggauccuggcccgauggugccaacauuaauuuuaugccuauauga

SEQ ID NO: 145555 - RNA, 1410 nt, Artificial Sequence
  derived and/or modified sequence opt3 from neuraminidase__InfluenzaA__AGQ81747
augaaccccaaucagaagaucguggccauuggcagcgucucccugaccauagcuacaaucugccuccuuaugcaaauugcaauccugguuacuacgaugaccuugcacuucaaacauggggaguguacaaacucuucaaauaaccaggccgugccuugcggaccaauuaucauagaaagaaauaucacugagauuguacacuuaaacaguaccacacuggaaaaggagaucuguccgaaagcggcugguuacagggacuggagcaagccccagugccagauuaccggcuuugccccuuucuccaaagauaauucuauccggcuaucggcaucaggggacauaugggugacucgcgaaccauaugucagcuguggacucggcaagugcuaccaauuugcccugggucaggggacaacccuugauaaccgacauaguaauggaacgucccacgaccguacuccccauagaacccuguugaugaacgagcucggcgugccuuuccaccuggcuacaaagcagguuuguauugcauggucuagcuccucaugccacgauggcaaagccuggcugcaugugugugucacuggggacgauaggaaugcuaccgccaguaucauuuaugacggaaugcucguggauagcaucgguucuugguccaagaacaucuuacggacacaggagucagaaugcguauguauuaaugggaccugcacgguugugaugacugacgggagcgcgaguggaaaagcagauacacgcauacuguuuaucagagagggcaagauuguccacaucucuccacuuuccgguagcgcccaacauguggaagagugcucguguuacccccaguauccugaggugaggugcgucugucgggacaacuggcgcgggucuaaucgaccaguuuuguacauaaacauggcugauuauuccguggacucaggauacguaugcaguggccuggugggcgacaccccgagaaacgaugacacuagcuccucuagcaauuguaaagaucccaacaaugaaaggggcgccccuggagucaaggguugggcauucgacucaggcaacgauauuuggauggggcggacaaucgagaaggaccuacguaguggauacgaaaccuuucgcgugaucggcgguuggaauacggcuaacuccaaaagccagaccucuagacagguuauuguggauucagacaauaguagcggguauuccggcaucuucucugucgagggaaagucgugcauuaacagguguuuuuacguggaacucauacggggccgaccaaaagagacacgcguaugguggacuagcaauuccaucauuguuuucugcgggaccucaggaacauaugguacuggcaguuggcccgauggggccaacaucaauuuuaugccuaucuga

SEQ ID NO: 145556 - RNA, 1401 nt, Artificial Sequence
  derived and/or modified sequence opt3 from neuraminidase__InfluenzaA__AGQ81749
augaaccccaaucagaagaucauugccauaggcagcgugucccugaccacagcuaucauuugcuuccucaugcaaaucgcaauucuuacuacgaccaugacacugcacuuuaaacagaacgaguguucuaauccuucaaacaaucaggucguuccaugcgaaccgaucauaaucgagagaaacacugugcauuugaauaguaccacaauugaaaaggagaucuguagcaaaguagccgaauacaagaacugguccaaaccccagugccaaauuaccggguucgcgccuuuuucuaaggacaauucgaucagguuaucagcuggaggugauauaugggugacucgggagccauaugucagcuguagucugggcaagugcuaccaguucgcccuagggcagggaacaacccucaaaaacaagcacuccaauggcacgacucaugaccgcauuccccaccgaacccugcuuaugaacgagcugggugugccuuuucauuuggggacaaaacagguuuguaucgcauggucuagcuccucaugcuaugauggaaaggccuggcuccacauuugugugacuggcgacgauaaaaaugcuaccgcaaguaucaucuacgacggcaugcuggccgauagcauugggucuugguccaagaacauacugcguacacaagaaucagagugcgucuguaucaauggaaccugcgcugugguaaugacggacgguagcgccaguggcaaggcggauacuaggauucucuucaucagagaagggcggauaauuaacaucucuccauuauccggaagcgcacagcacguugaggagugcucguguuauccccgcuacccugaagugagaugcgucuguagggacaacuggaaaggcucuaaucggccagugcuguauaucaacauggccgauuacuccguggagucaaguuacgucugcagcggucuuguuggggacacaccgcgcaaugaugacuccucuagcucaaguaacugucgagaccccaauaacgaaagaggagcuccuggcgugaagggcugggccuuugaugacgggaaugauguauggaugggaaggaccauuaaaaaggacucccggagcgguuaugagacuuuccgugugaucaacggcuggacaaccgcaaauucuaaaucacagauuaaccgccaggucauaguggauagugacaauuggagcggguacuccggaaucuuuucuguugaaggcaagaacugcauuaauagauguuucuauguggaguugaucaggggucggccacaagagcccaaagucugguggacgucgaacagcaucauugcuuuuugcgggaccuccggcacauacggaacuggcucauggccugauggggccaauauaaacuucaugccaaucuga

SEQ ID NO: 145557 - RNA, 1401 nt, Artificial Sequence; identical to SEQ ID NO: 145556
  derived and/or modified sequence opt3 from neuraminidase__InfluenzaA__AGQ81750

SEQ ID NO: 145558 - RNA, 1410 nt, Artificial Sequence
  derived and/or modified sequence opt3 from neuraminidase__InfluenzaA__AGQ81751
augaaccccaaucagaagaucauugccauaggcagcgugucccugaccaucgcuacaauuugccuccuuaugcaaaucgcaauucuggucacuacgaugaccuuguacuucaaacacaacgaguguucuaauucaaguaacaaucaggccguuccuugcgggccaaucauaaucgaaagaaacauuacagagaucgugcauuuaaauagcacuacccuggaaaaggagauuuguccgaaagcggcuggauauagggacugguccaagccccagugccagaucacagguuuugccccuuucucuaaagauaacucgauacggcuaucagcaagcggcgacauuuggguaacccgcgaaccauacgugaguugugggcucggaaagugcuaucaauuugcccugggccaggguacuacacuugauaaucgacacuccaacgggaccucucaugaccguacgccccacagaacucuguugaugaaugagcucggagucccuuuccaucuggcuaccaaacagguguguaucgcauggagcuccucaaguugccacgauggcaaggccuggcugcacguuugugugacaggcgacgauaggaacgcuacugccagcauuaucuacgacgggauccucgucgauucuauuggauccuggucaaagaauauauuacggacccaggagagcgaaugcguguguaucaacgguacaugcaccguaguuaugacggacggcagugcgucugggaaagcagauacucgcauucuguuuaucagagagggaaagauagugcauauuuccccacuuagcggcucggcccaacacgucgaagagugcucuuguuauccccaguacccugaggugaggugcgugugucgggacaauuggcgcgguuccaaccgaccagucuuguauaucaacauggcugauuacucaaucgacaguggguacguuugcagcggacuggugggcgacacaccgagaaaugaugacauuuccucuagcucaaacuguaaagaucccaauaacgaaaggggcgccccugggguaaagggaugggcauucgacagugguaaugaucuauggaugggccggaccaucgagaaggaaucccguagcggguaugagacuuuucgcgugauuggaggcuggaacacagcuaauucuaaaucacagaccaguagacaggucauaguggacagcgauaacuccucugguuacucggggaucuucagcguugaaggcaaguccugcauuaauagguguuuuuauguggagcucauccggggacgaccaaaagagacgcgcgucugguggaccucaaacaguaucauuguguucugcggcacaucugggacuuacggaaccgguagcuggcccgacggcgccaauauaaacuuuaugccuaucuga

SEQ ID NO: 145559 - RNA, 1410 nt, Artificial Sequence
  derived and/or modified sequence opt3 from neuraminidase__InfluenzaA__AGQ81753
augaaccccaaucagaagaucguggccauuggcagcgucucccugaccauagcuacaaucugccuccuuaugcaaauugcaauccugguuacuacgaugaccuugcacuucaaacauggggaguguacaaacucuucaaauaaccaggccgugccuugcggaccaauuaucauagaaagaaauaucacugguauuguacacuuaaacaguaccacacuggagaaggaaaucuguccgaaagcggcuggcuacagggacuggagcaagccccagugccagauuaccggguuugccccuuucuccaaagauaauucuauccggcuaucggcaucaggagacauaugggugacucgcgagccauaugucagcuguggccucgguaagugcuaccaauuugcccuggggcagggaacaacccuugauaaccgacauaguaauggcacgucccacgaccguacuccccauagaacccuguugaugaacgaacucggcgugccuuuccaccuggcuacaaagcagguuuguauugcauggucuagcuccucaugccacgaugggaaagccuggcugcauaucugugugacuggagacgauaggaaugcuaccgccaguauuaucuaugacgguaugcucgucgauagcaucggcucuugguccaagaacauuuuacggacacaggagucagagugcguguguauaaaugggaccugcacgguaguuaugacugacggaagcgcgaguggcaaagcagauacacgcauccuguuuauuagagaagguaagaucgugcacauaucuccacuuuccgggagcgcccaacaugucgaggaaugcucguguuacccccaguauccugaggugaggugcgugugucgggacaacuggcgcggaucuaaucgaccagucuuguacauuaacauggcugauuauuccguugacucaggcuacgugugcaguggccugguaggggacaccccgagaaacgaugacacuagcuccucuagcaauuguaaagaucccaacaaugagaggggagccccuggugugaagggcugggcauucgacucagggaacgauaucuggaugggacggacaaucgaaaaggaccuacguaguggcuacgagaccuuucgcgucauugguggguggaauacggcuaacuccaaaagccagaccaauagacaggugaucguugauucugacaacucaaguggcuauagcggaauuuucuccguggaaggcaagucuugcauaaauagguguuuuuacgucgagcucauccgggggcgaccaaaagaaacacgcgugugguggacuucgaacagcauuaucguauucugcggaaccuccgguacauauggcacugggucauggcccgauggagccaauaucaacuuuaugccuauuuga

SEQ ID NO: 145560 - RNA, 1410 nt, Artificial Sequence; identical to SEQ ID NO: 145559
  derived and/or modified sequence opt3 from neuraminidase__InfluenzaA__AGQ81754

SEQ ID NO: 145561 - RNA, 1410 nt, Artificial Sequence
  derived and/or modified sequence opt3 from neuraminidase__InfluenzaA__AGQ81756
augaaccccaaucagaagaucauugccauaggcagcaucucccugaccauugcuacaaucugccuccuuauucaaaucgcaauacuggugacuacgaugaccuugcacuucaaacauggggaguguacaaacucuucaaauaaccaggccgucccuugcggaccaaucauuaucgaaagaaauguuacugagauugugcacuuaaacaguaccacacuggaaaaggagaucuguccgaaagcggcugguuacagggacuggagcaagccccagugccagauaaccggcuuugccccuuucuccaaagauaauucuauucggcuaucggcaucaggggacaucuggguaacucgcgaaccauaugugagcuguggacucggcaagugcuaccaauuugcccugggucaggggacaacccuugauaaccgacauaguaauggaacgucccacgaccguacuccccauagaacccuguugaugaacgagcucggcgucccuuuccaccuggcuacaaaacagguguguauugcauggucuagcuccucaugccacgauggcaaggccuggcugcauguuugugugacuggggacgauaggaaugcuaccgccaguaucaucuaugacggacucuuagucgauagcauugguucuugguccaagaacauacugcggacacaggagucagaaugcguguguaucaaugggaccugcacgguaguuaugacugacgggagcgcgaguggaaaagcagauacacgcauucuuuuuaucagagagggcaagauaauucacaucucuccauuguccgguagcgcccaacauguggaagagugcucguguuacccccaguauccugaggucaggugcgugugucgggacaacuggcgcgggucuaaucgaccagugcuguacaucaacauggcugauuauuccgucgacucaggauacguuugcaguggccuagugggcgacaccccgagaaacgaugacacuagcuccucuagcaauuguaaagaucccaacaaugaaaggggcgccccuggaguaaaggguugggcauucgacucaggcaacgauauuuggauggggcggacaaucgagaaggacagucguuccggauacgaaaccuuucgcgugauuggcgguuggaauacggcuaacagcaaaucucagaccucaagacaggucauaguggauagugacaauagcuccggguauucuggcaucuucucgguugagggaaagagcugcauuaacagguguuuuuacguggaacucauccggggccgaccaaaagagacacgcgucugguggacuuccaauucaaucauuguguucugcgggaccaguggaacauaugguacuggcucuuggcccgauggggccaacauaaauuuuaugccuaucuga

SEQ ID NO: 145562 - RNA, 1410 nt, Artificial Sequence
  derived and/or modified sequence opt3 from neuraminidase__InfluenzaA__AGQ81757
augaaccccaaucagaagaucauugccauaggcagcgugucccugaccaucgcuacaauuugccuccuuauccaaauugcaauccuggucacuacgaugaccuugcacuucaaacauggggaguguacaaacucuucaaauaaccaggccguuccuugcggaccaauaaucauugaaagaaaugugacugagaucguacacuuaaacaguaccacacuggaaaaggagauuuguccgaaagcggcugguuacagggacuggagcaagccccagugccagaucaccggcuuugccccuuucuccaaagauaauucuauacggcuaucggcaucaggggacauuugggugacucgcgaaccauaugucagcuguggacucggcaagugcuaccaauuugcccugggucaggggacaacccuugauaaccgacauaguaauggaacgucccacgaccguacuccccauagaacccuguugaugaacgagcucggcgugccuuuccaccuggcuacaaagcagguuuguaucgcauggucuagcuccucaugccacgauggcaaagccuggcugcaugugugugucacuggggacgauaggaaugcuaccgccaguauuaucuaugacggacucuuaguggauagcaucgguucuugguccaagaacauucugcggacacaggagucagaaugcguauguauaaaugggaccugcacgguugugaugacugacgggagcgcgaguggaaaagcagauacacgcauccuuuuuauuagagagggcaagaucauacacauuucuccauuguccgguagcgcccaacaugucgaagagugcucguguuacccccaguauccugaggugaggugcgugugucgggacaacuggcgcgggucuaaucgaccaguccuguacaucaacauggcugauuauuccguugacucaggauacgugugcaguggccuaguaggcgacaccccgagaaacgaugacacuagcuccucuagcaauuguaaagaucccaacaaugaaaggggcgccccuggagugaaggguugggcauucgacucaggcaacgauaucuggauggggcggacaauugagaaggacagucguuccggauacgaaaccuuucgcgucaucggcgguuggaauacggcuaacagcaaaucucagaccucaagacaggugauuguugauagugacaauagcuccggguauucuggcauauucucgguggagggaaagagcugcaucaacagguguuuuuacgucgaacucauucggggccgaccaaaagagacacgcgugugguggacuuccaauucaaucaucguauucugcgggaccaguggaacauaugguacuggcucuuggcccgauggggccaacauuaauuuuaugccuauauga

SEQ ID NO: 145563 - RNA, 1401 nt, Artificial Sequence
  derived and/or modified sequence opt3 from neuraminidase__InfluenzaA__AGQ81758
augaaccccaaucagaagaucauugccauaggcagcgugucccugaucauugcuaucauuugccuccuuaugcaaaucgcaauacugaccacaacuaugacguugcacuucagacagaacgaguguucuaauccuucaaacaaucaggucguuccaugcgaaccgaccaucauugagaggaacacagugcauuuaaauaguacuaccaucgaacgggagauuugucccaaaguagccgaauacaagaacuggagcaaaccucagugccaaaucacaggguuugcgccauucuccaaggacaauucuauacgccugucggcuggaggugauauuugggugacccgagagcccuaugucucauguagccuaggcaaaugcuaccaguuugcccucgggcagggaacuacacugaagaacaagcacaguaauggcaccacgcaugaccguacuccucacagaacccuucugaugaacgaguugggugugccauuccaucucgggacaaaacagguuuguaucgcaugguccucuagcuccugcuaugauggaaaggccuggcugcacauuugugugacuggcgacgaugaaaaugcuaccgcaucaaucaucuacgacggcaugcuggucgauaguauugggagcuggucuaaaaacauacucaggacacaagaguccgaaugcguguguaucaauggaaccugcgccguaguuaugacggacgguucagcuagcggcaaggccgauacucggguguuauuuauucgcgaggggaaaaucauaaacauuaguccccugucuggauccgcgcagcacgucgaggaaugcagcuguuauccuagauacccagaggugaggugcgugugucgggacaacuggaagggcucgaaucgcccgguccuuuauaucaacauggcagauuacucuaucgaauccucauacguuugcagugguuuggugggggacacaccccgaaaugaugacagcuccucuagcucaaacuguagagacccuaauaacgagaggggagccccaggcguaaagggcugggcuuucgaugacgggaaugauguguggaugggacggaccauuaaaaacgacagucguuccgguuaugaaacuuuucgcgucgugaauggcuggacaauggccaacagcaagucucagaucaauagacagguuauuguggauucagacaacuggaguggguacagcggaauauucuccgucgagggcaaaaagugcaucaauagguguuuuuauguggagcugauucggggucgaccccaagaaccucgcguaugguggaccucuaacucgaucaucguuuucugcgggacgagcggcaccuacggaacaggcuccuggccagauggggcaaauauuaacuuuaugcccauauga

SEQ ID NO: 145564 - RNA, 1401 nt, Artificial Sequence
  derived and/or modified sequence opt3 from neuraminidase__InfluenzaA__AGQ81759
augaaccccaaucagaagaucauugccauaggcagcgugucccugaccaucgcuauuaucugcuuccucauucaaaucgcaauacuuacaacuacgaugacccugcacuuuagacagucugaguguucaaacccuaguaauaaccaggucguuccaugcgaaccgaucauuaucgagaggaauacagugcauuugaacagcacuauuaucgaaaaagagauaugucccaagguagccgaauacaaaaauugguccaagccucagugccaaauuaccggguucgcgccauuuucuaaagacaacucgauccgguuaucagcuggaggugauauuugggugacacgcgagcccuaugucagcuguagucugggcaagugcuaccaguucgcccuagggcagggaaccacucucaagaauaaacacuccaacggcacaacccaugaccgaaucccucaccguacgcugcuuaugaaugagcugggugugccauuucauuuggggacuaagcagguuuguaucgcauggucuagcuccucaugccacgauggaaaagccuggcuccacauuugugugaccggcgacgauaagaacgcuacagcaaguauaaucuaugacggcaugcuggucgauagcauugggucuugguccaaaaauauccugagaacucaagaaucagagugcguguguauaaacggaaccugcgccguaguuaugacagacgguagcgcuaguggcaaggccgauaccaggauucucuucauccgggaagggaagaucauuaauaucucucccuuauccggaagcgcgcagcauguggaggagugcucguguuacccucgcuauccagaagucagaugcguguguagggacaacuggaaaggcucuaaccggccggugcuguacauuaauauggcagauuauuccauagagucaaguuacgucugcagcggucuuguuggggacacgccccgcgaugacgacuccucuagcucaaguaacugucgagauccuaauaacgaaagaggagccccaggcgugaagggcugggcuuuugacgaugggaaugacaucuggaugggaaggacuauuaaauccgauagccggucugguuacgagacauuccguguaaucaacggcuggaccacugccaauucaaagagucagaucaaccgccaggugauugucgacagcgauuccuggucuggguauucgggaauauuuagcguggaaggcaaaaauugcaucaacagauguuucuacguugaguugauuaggggucggccccgagagacacgcgugugguggaccuccaauucaaucauugucuuuugcgggacgaguggcaccuauggaacaggcucuuggccugacggggcaaacaucaauuucaugccaauauga

SEQ ID NO: 145565 - RNA, 1401 nt, Artificial Sequence
  derived and/or modified sequence opt3 from neuraminidase__InfluenzaA__AGQ81760
augaaccccaaucagaagaucauugccauaggcagcgugucccugaccaucgcuauuaucugcuuccucaugcaaauugcaauccuuacaacuacgaugacccugcacuuuagacagaacgaguguucuaauccuucaaacaaucaggucguuccaugcgaaccgauaaucauugagaggaacacagugcauuugaauaguacuaccaucgaaaaagagauuugucccaagguagccgaauacaaaaacuggagcaagccucagugccaaaucacaggguucgcgccauuuuccaaagacaauucuauacgguuaucggcuggaggugauauuugggugacccgcgagcccuaugucucauguagccugggcaagugcuaccaguucgcccuagggcagggaacuacacucaagaacaaacacaguaauggcaccacgcaugaccgaaucccucaccguacucugcuuaugaacgagcugggugugccauuucauuuggggaccaagcagguuuguauugcaugguccucuagcuccugccacgauggaaaagccuggcuccacaucugugugacaggcgacgauaagaaugcuacugcaucaaucauuuaugacggcaugcuggucgauaguauagggagcuggucuaaaaacauccugagaacccaagaauccgagugcguguguauuaauggaacaugcgccguaguuaugaccgacgguucagcuagcggcaaggccgauacgaggguccucuucauccgggaagggaagauaauuaacaucagucccuuaucuggauccgcgcagcauguggaggagugcagcuguuacccucgcuauccagaagugagaugcguguguagggacaacuggaaaggcucgaaucggccgguccuguacaucaacauggcagauuauucuauugaguccucauacguuugcaguggucuugugggggacacuccccgcgaugacgacagcuccucuagcucaaauugucgagauccuaacaaugaaagaggagccccaggcguaaagggcugggcuuuugacgaugggaacgacaucuggaugggaaggacaauuaaaagugauucccggagcgguuacgagaccuuccguguggucaauggcuggauaacugccaacucuaagucacagaucaaucgccaggugauuguugacagugauagcugguccggguauucuggaaucuuuucgguggaaggcaaaaacugcaucaauagauguuucuacgucgaguugauuaggggucggccccaagagacacgagugugguggaccagcaacuccauaaucguauuuugcgggacgucaggcaccuauggaacaggcaguuggccugacggggcaaauauuaacuucaugccaaucuga

SEQ ID NO: 145566 - RNA, 1401 nt, Artificial Sequence
  derived and/or modified sequence opt3 from neuraminidase__InfluenzaA__AGQ81761
augaaccccaaucagaagaucauugccauaggcagcgugucccugaccaucgcuauuaucugcuuccucaugcaaauugcaauccuuacaacuacgaugacccugcacuuuagacagaacgaguguucuaauccuucaaacaaucaggucguuccaugcgaaccgauaaucauugagaggaacacagugcauuugaauaguacuaccaucgaaaaagagauuugucccaagguagccgaauacaaaaacuggagcaagccucagugccaaaucacaggguucgcgccauuuuccaaagacaauucuauacgguuaucggcuggaggugauauuugggugacccgcgagcccuaugucucauguagccugggcaagugcuaccaguucgcccuagggcagggaacuacacucaagaacaaacacaguaauggcaccacgcaugaccgaaucccucaccguacucugcuuaugaacgagcugggugugccauuucauuuggggaccaagcagguuuguauugcaugguccucuagcuccugccacgauggaaaagccuggcuccacaucugugugacaggcgacgauaagaaugcuacugcaucaaucauuuaugacggcaugcuggucgauaguauagggagcuggucuaaaaacauccugagaacccaagaauccgagugcguguguauuaauggaacaugcgccguaguuaugaccgacgguucagcuagcggcaaggccgauacgaggauccucuucauaaaggaagggaaaauuaucaacaucagucccuuaucuggauccgcgcagcauguggaggagugcagcuguuacccucgguauccagaaguccgcugcguguguagagacaacuggaagggcucgaauaggccggugcuguacauuaacauggcagauuauucuaucgaguccucauacgucugcaguggucuuguuggggacacuccccgggaugacgacagcuccucuagcucaaauugucgcgauccuaacaaugaacgaggagccccaggcgugaaaggcugggcuuuugacgaugggaacgacauuuggaugggaagaacaauaaagagugauuccaggagcgguuacgagaccuuccggguagugaauggcuggacuacagccaacucuaaaucacagaucaaucgucaggucauuguggacagugauagcugguccggguauucuggaaucuuuucgguugaaggcaagaacugcaucaaucgcuguuucuacguggaguugauuagagguaggccccaagagacccgggucugguggacgagcaacuccauaaucguguuuugcgggaccucaggcacauauggaacuggcaguuggccugacggggcaaauauuaacuucaugccaaucuga

SEQ ID NO: 145567 - RNA, 1401 nt, Artificial Sequence
  derived and/or modified sequence opt3 from neuraminidase__InfluenzaA__AGQ81763
augaaccccaaucagaagaucauugccauaggcagcgugucccugaucauugcuaucauuugccuccuuaugcaaaucgcaauacugaccacaacuaugacguugcacuucagacagaacgaguguucuaauccuucaaacaaucaggucguuccaugcgaaccgaucauuaucgagaggaacaccgugcauuuaaauaguacaacuauugaacgggagaucugucccaaaguagccgaauacaagaacuggagcaaaccucagugccaaauaaccggguuugcgccauucuccaaggacaauucuauucgccugucggcuggaggugauaucugggugacacgagagcccuaugucucauguagccuaggcaaaugcuaccaguuugcccucgggcagggaaccacucugaagaacaagcacaguaauggcacaacccaugaccguacgccucacagaacucuucugaugaacgaguugggugugccauuccaucucgggaccaaacagguuuguauugcaugguccucuagcuccugcuaugauggaaaggccuggcugcacaucugugugacaggcgacgauaaaaaugcuacugcaucaaucauuuacgacggcaugcuggucgauaguauagggagcuggucuaagaacauccucaggacccaagaauccgagugcguguguauuaauggaacaugcgccguaguuaugaccgacgguucagcuagcggcaaagccgauacgcggguguuauuuauccgcgaagggaagauaauuaacaucaguccccugucuggauccgcgcagcacgucgaggagugcagcuguuauccuagauacccagaagugaggugcgugugucgggacaacuggaagggcucgaaucgcccgguccuuuauaucaacauggcagauuacucuauugaguccucauacguuugcagugguuuggugggggacacuccccgaaaugaugacagcuccucuagcucaaacuguagagacccuaauaacgaaaggggagccccaggcguaaaaggcugggcuuucgaugacgggaaugauguguggaugggacggacaaucaagaacgguagucguuccggcuaugagaccuuucgcgucgugaauggguggacuauggccaacagcaaaucucagauuaauagacagguuauaguggacucagauaacuggaguggauacagcggcaucuucuccgucgaagguaagaaaugcauuaauagguguuuuuauguggagcugauccgggggcgaccccaagagccucgcguaugguggacaucuaacucgaucauuguuuucugcggcaccagcggaacguacggcaccggguccuggccagacggagcaaauauaaacuuuaugcccaucuga

SEQ ID NO: 145568 - RNA, 1401 nt, Artificial Sequence
  derived and/or modified sequence opt3 from neuraminidase__InfluenzaA__AGQ81766
augaaccccaaucagaagaucauugccauaggcagcgugucccugaccaucgcuauuaucugcuuccucaugcaaauugcaauccuuacaacuacgaugacccugcacuuuagacagaacgaguguucuaauccuucaaacaaucaggucguuccaugcgaaccgauaaucauugagaggaacacagugcauuugaauaguacuaccaucgaaaaagagauuugucccaagguagccgaauacaaaaacuggagcaagccucagugccaaaucacaggguucgcgccauuuuccaaagacaauucuauacgguuaucggcuggaggugauauuugggugacccgcgagcccuaugucucauguagccugggcaagugcuaccaguucgcccuagggcagggaacuacacucaagaacaaacacaguaauggcaccacgcaugaccgaaucccucaccguacucugcuuaugaacgagcugggugugccauuucauuuggggaccaagcagguuuguauugcaugguccucuagcuccugccacgauggaaaagccuggcuccacaucugugugacaggcgacgauaagaaugcuacugcaucaaucauuuaugacggcaugcuggucgauaguauagggagcuggucuaaaaacauccugagaacccaagaauccgagugcguguguauuaauggaacaugcgccguaguuaugaccgacgguucagcuagcggcaaggccgauacgaggauccucuucauacgggaagggaagauuaucaacaucagucccuuaucuggauccgcgcagcauguggaggagugcagcuguuacccucgcuauccagaagucagaugcguguguagggacaacuggaaaggcucgaaucggccggugcuguacauuaacauggcagauuauucuaucgaguccucauacgucugcaguggucuuguuggggacacuccccgcgaugacgacagcuuuuccucuagcaauugucgagauccuaacaaugaaagaggagccccaggcgugaagggcugggcuuucgacgaugggaacgacauuuggaugggaaggacaauaaaaucagauagucgguccgguuacgagaccuuucguguagugaauggcuggacuacagccaacagcaagucucagaucaaucgccaggucauuguggacucagauaguuggagcggguauuccggaaucuucucuguugaaggcaaaaacugcaucaauagauguuuuuacguggaguugauuaggggucggccccaagagaccauagucugguggacgucgaacagcaucauuguguucugcgggaccuccggcacauauggaacuggcucauggccugacggggcaaauaucaacuuuaugccaauuuga

SEQ ID NO: 145569 - RNA, 1401 nt, Artificial Sequence; identical to SEQ ID NO: 145568
  derived and/or modified sequence opt3 from neuraminidase__InfluenzaA__AGQ81767

SEQ ID NO: 145570 - RNA, 1410 nt, Artificial Sequence
  derived and/or modified sequence opt3 from neuraminidase__InfluenzaA__AGQ81768
augaaccccaaucagaagaucguggccauuggcagcgucucccugaccauagcuacaaucugccuccuuaugcaaauugcaauccugguuacuacgaugaccuugcacuucaaacauggggaguguacaaacucuucaaauaaccaggccgugccuugcggaccaauuaucauagaaagaaauaucacugagauuguacacuuaaacaguaccacacuggaaaaggagaucuguccgaaagcggcugguuacagggacuggagcaagccccagugccagauuaccggcuuugccccuuucuccaaagauaauucuauccggcuaucggcaucaggggacauaugggugacucgcgaaccauaugucagcuguggacucggcaagugcuaccaauuugcccugggucaggggacaacccuugauaaccgacauaguaauggaacgucccacgaccguacuccccauagaacccuguugaugucugagcucggcgugccuuuccaccuggcuacaaagcagguuuguauugcauggagcuccucaaguugccacgauggcgaggccuggcugcauaucugugugacuggggacgauaggaacgcuaccgccagcauuaucuaugacggaaugcucgucgauucuaucgguuccuggagcaaaaauauuuuacggacacaggaaucagagugcguguguauaaacgggaccugcacgguaguuaugacugacgggagugcgucuggaaaggcagauacacgcauccuguuuauuagagaaggcaaaaucgugcacauauccccacuuagcgguucggcccaacaugucgaggagugcucuuguuacccccaguauccugaagugaggugcgugugucgggacaauuggcgcggguccaaccgaccagucuuguacauuaauauggcugauuauucaguugacaguggauacgugugcagcggccugguaggcgacaccccgagaaacgaugacacuuccucuagcucaaacuguaaggaucccaauaacgagaggggcgccccuggagugaaagguugggcauucgacaguggcaaugauaucuggauggggcggacaaucgaaaaggaccuacguuccggauacgagaccuuucgcgucauuggcgguuggaacacggcuaauagcaagucucagaccaacagacaggugaucguugauucagacaauaguagcggguauuccggcauuuucucuguggaaggaaaaucgugcauaaacagguguuuuuacgucgagcucauccggggccgaccaaaggagacacgcgugugguggacuagcaauuccauuaucguauucugcgggaccucaggaacauaugguacuggcaguuggcccgauggggccaacaucaauuuuaugccuauuuga

SEQ ID NO: 145571 - RNA, 1410 nt, Artificial Sequence
  derived and/or modified sequence opt3 from neuraminidase__InfluenzaA__AGQ81769
augaaccccaaucagaagaucguggccauuggcagcgucucccugaccauagcuacaaucugccuccuuaugcaaauugcaauccugguuacuacgaugaccuugcacuucaaacauggggaguguacaaacucuucaaauaaccaggccgugccuugcggaccaauuaucauagaaagaaauaucacugagauuguacacuuaaacaguaccacacuggaaaaggagaucuguccgaaagcggcugguuacagggacuggagcaagccccagugccagauuaccggcuuugccccuuucuccaaagauaauucuauccggcuaucggcaucaggggacauaugggugacucgcgaaccauaugucagcuguggacucggcaagugcuaccaauuugcccugggucaggggacaacccuugauaaccgacauaguaauggaacgucccacgaccguacuccccauagaacccuguugaugucugagcucggcgugccuuuccaccuggcuacaaagcagguuuguauugcauggagcuccucaaguugccacgauggcgaggccuggcugcauaucugugugacuggggacgauaggaacgcuaccgccagcauuaucuauggagguaugcucgucgacucuaucggcuccuggagcaaaaauauuuuacggacacaggaaucagagugcguguguauaaacgggaccugcacgguaguuaugacugauggaagugcgucuggcaaggcagacacacgcauccuguuuauuagagaagguaaaaucgugcacauauccccacuuagcgggucggcccaacaugucgaggagugcucuuguuacccccaguauccugaagugaggugcgugugucgggauaauuggcgcggauccaaccgaccagucuuguacauuaauauggcugacuauucaguugauaguggcuacgugugcagcggccugguaggggacaccccgagaaacgacgauacuuccucuagcucaaacuguaaggaccccaauaacgagaggggagccccuggugugaaaggcugggcauucgauagugggaaugacaucuggaugggacggacaaucgaaaaggaucuacguuccggcuacgagaccuuucgcgucauugguggguggaacacggcuaauagcaagucucagaccaacagacaggugaucguugacucagauaauaguagcggcuauuccggaauuuucucuguggaaggcaaaucgugcauaaacagguguuuuuacgucgagcucauccgggggcgaccaaaggagacacgcgugugguggacuagcaauuccauuaucguauucugcggaaccucagguacauauggcacugggaguuggcccgacggagccaacaucaauuuuaugccuauuuga

SEQ ID NO: 145572 - RNA, 1401 nt, Artificial Sequence
  derived and/or modified sequence opt3 from neuraminidase__InfluenzaA__AGQ81770
augaaccccaaucagaagaucauugccauaggcagcguuuccaucaccauugcuaucauuugcuucaucaugcaaauagcaauccugacaacuacgaugacccuccacuuuagacagaacgaguguucuaauccuucaaacaaucaggucguuccaugcgaaccgauuaucauugagaggaacacagugcaucuuaauaguacuaccaucgaaaaagagacaugucccaagguagccgaauacaaaaacuggagcaagccucagugccaaauaaccggguucgcgccauuuuccaaagacaauucuauucggcugucggcuggaggugauaucugggugacucgcgagcccuaugucucauguagcuugggcaagugcuaccaguucgccuuagggcagggaacaacccugaagaacaaacacaguaauggcacgacucaugaccguauuccucaccgaacccuacucaugaacgagcugggugugccauuucaucuugggacaaagcagguuuguaucgcaugguccucuagcuccugccacgauggaaaagccuggcugcacaucugugugacuggcgacgauaagaaugcuaccgcaucaauuauauaugacggcauguuggucgauaguaucgggagcuggucuaaaaacauucucagaacacaagaauccgagugcguguguaucaauggaaccugcgccguaguuaugacggacgguucagcuagcggcaaggccgauacuagggugcuguucauacgggaagggaagauuaucaacaucaguccccugucuggauccgcgcagcaugucgaggagugcagcuguuacccucgcuauccagaagugagaugcguguguagggacaacuggaaaggcucgaaucggccgguccucuacauuaacauggcagauuauucuguugaguccucauacgugugcagugguuuaguaggggacacaccccgcgaugacgacagcuccucuagcucaaauugucgagauccuaacaaugaaagaggagccccaggcgugaagggcugggcuuuugacgaugggaacgacaucuggaugggaaggaccauuaaaagugauucccggagcgguuacgagacuuuccgugucgugaauggcuggacaaccgccaacucuaagucacagauaaaucgccagguuaucguggacagugauagcugguccggguauucuggaaucuuuucggucgaaggcaaaaacugcauuaauagauguuucuacguggagcugaucaggggucggccccaagagacgcgaguaugguggaccagcaacuccauuauaguguuuugcgggacaucaggcacuuauggaaccggcaguuggccugacggggcaaauaucaacuucaugccaauuuga

SEQ ID NO: 145573 - RNA, 1410 nt, Artificial Sequence
  derived and/or modified sequence opt3 from neuraminidase__InfluenzaA__AGQ81772
augaaccccaaucagaagaucguggccauuggcagcgcuucccugaccauagcaacaaugugccuccuucugcaaaucgccuuguucgcgacuacgaugaccuuacacuuuaaacagacaggguguacuaacucuucagacaaucaggcugucccuugcggaccaauuaucauugagagaaacaucaccgaaauaguucaucugaauaguacaacccuagagaaggaaacuuguccgaaaagcgccgguuacaggaacugguccaagccccagugccaaaucacaggcuucgcaccuuuuucuaaagauaauucgauucggcucgccgcugcaggggacaucugggugacccgcgagccauauguaucauguggacugggcaagugcuaccaguucgcccuuggucaggggacgacucuggauaacaagcacagcaauggaaccacacaugaccgaacuccccaccguaccuugcucaugagugaacugggcgugccuuuucaucuggcuacaaaacaggucuguauugccugguccucuagcuccugccacgauggcaaggcguggcuccacguguguguuaccggggacgauaaaaacgcaacggccucaaucauauaugacggaauuuuaguggauaguaucgcuagcuggucuaagaauauucugagaacucaagaguccgagugcgucuguaucaacgguacaugcaccgugguaaugacugacggcucagccagcgggagggcagauacacggauccuuuucauucgcgaaggaaaaauaguucauaucaguccauugucuggcuccgcucagcacguggaggaaugcagcuguuaccccagauauccugaggucaggugcgugugucgggacaauuggaaggguucgaaccgcccagugcuguuuauuaauauggccgauuacucuaucgacuccucauaugucugcccggggcuaguuggagacacccccaggaacgaugacagaaguagcuccucuaacuguagggauccuaauaacgagcggggcgcgccaggcgugaaggggugggccuucgacagcggaaaugauauauggaugggucguacgauugaaaaagacucacgcaguggcuacgagaccuuuagaguaaucuccggguggagcacagcaaacucuaagucacagaucaaucgacaggugauugucgaucgggacaacaguagcggauacuccggcaucuucucuguggaagguaaaucgugcauuaaucgauguuuuuauguugagcucauacgcgggagacccaaggaaaacagggugugguggacuagcaauuccaucauugucuucugcggcaccucaggaacauacggcacugggaguuggccugauggagcuaacaucaaucugaugccaaucuga

SEQ ID NO: 145574 - RNA, 1401 nt, Artificial Sequence
  derived and/or modified sequence opt3 from neuraminidase__InfluenzaA__AGQ81773
augaaccccaaucagaagaucauugccauaggcagcgugucccugaccaucgcuauuaucugcuuccucaugcaaauugcaauccuuacaacuacgaugacccugcacuuuagacagaacgaguguucuaauccuucaaacaaucaggucguuccaugcgaaccgauaaucauugagaggaaaacagugcauuugaacaguacuaccaucgaaaaggagauuugucccaaaguagccgaauacaagaauuggagcaaaccucagugccaaaucacaggguucgcgccauuuuccaaggacaacucuauacgguuaucggcuggaggugauauuugggugacccgcgagcccuaugucucauguagccugggcaagugcuaccaguucgcccuagggcagggaacuacacucaaaaauaagcacaguaacggcaccacgcaugaccgaaucccucaccguacucugcuuaugaaugagcugggugugccauugcauugggggaccaaacagguuuguauugcaugguccucuagcuccugccacgauggaaaggccuggcuccacaucugugugacaggcgacgauaaaaacgcuacugcaucaaucauuuaugacggcaugcuggucgauaguauagggagcuggucuaagaauauccugagaacccaagaauccgagugcguguguauuaacggaacaugcgccguaguuaugaccgacgguucagcuagcggcaaggccgauacgagggugcucuuuauccgggaagggaaaauaauuaauaucagucccuuaucuggauccgcgcagcaugucgaggagugcagcuguuacccucgcuauccagaagugagaugcguguguagggacaacuggaagggcucgaaccggccgguccuguacaucaauauggcagauuauucuauugaguccucauacguuugcaguggucuugugggggacacuccccgcgaugacgacagcuccucuagcucaaacugucgagauccuaauaacgaaagaggagccccaggcguaaaaggcuggggguucgacgauggaaaugacaucuggauggguaggacaauuaagagugauucccggagcggcuacgagaccuuucguguggucaacggguggacuacagcuaauucuaaaucacagauaaaccgccaggugaucguugacagugauagcugguccggauauucuggcauuuucucgguggaagguaagaauugcaucaacagauguuuuuacgucgaguugaucagggggcggccccaagagacccgagugugguggacgagcaauuccauuauaguauucugcggcaccucaggaacauauggcacugggaguuggccugacggagccaacaucaauuuuaugccaauuuga

SEQ ID NO: 145575 - RNA, 1401 nt, Artificial Sequence
  derived and/or modified sequence opt3 from neuraminidase__InfluenzaA__AGQ81774
augaaccccaaucagaagaucauugccauaggcagcgugucccugaucauugcuaucauuugccuccuuaugcaaaucgcaauacugaccacaacuaugacguugcacuucagacagaacgaguguucuaauccuucaaacaaucaggucaugccaugcgaaccgaucauuaucgagaggaacaccguucauuuaaauaguacaacuauugaacgggagaucugucccaaaguggccgaauacaagaacuggagcaaaccucagugccaaauaaccggguuugcgccauucuccaaggacaauucuauucgccugucggcuggaggugauaucuggguaacacgagagcccuaugugucauguagccuagacaaaugcuaccaguuugcccucggccaggggaccacucugaagaacaagcacaguaauggaacaacccaugaucguacgccucacagaacucuucugaugaacgaguugggcgucccauuccaucucgguaccaaacagguguguauugcaugguccucuagcuccugcuaugacgggaaggccuggcugcacaucuguguuacaggagaugacaaaaaugcuacugcaucaaucauuuacgauggcaugcugguggacaguauaggcagcuggucuaagaacauccucaggacccaagaauccgagugcgucuguauuaaugggacaugcgccgugguaaugaccgauggaucagcuagcgguaaagccgacacgcggguuuuauuuauccgcgaaggcaagauaauuaacaucaguccccugucuggguccgcgcagcacguggaggagugcagcuguuauccuagauacccagaagucaggugcgugugucgggauaacuggaagggaucgaaucgcccgauccuuuauauuaacauggcagacuacucuaucgaguccucauacgugugcaguggcuuggucggugauacuccccgaaaugacgacagcuccucuagcucaaacuguagagauccuaauaacgaaaggggagccccagggguuaaaggcugggcuuucgacgauggcaaugacguguggauggggcggacaauuaagaacggaagucguuccgguuaugagaccuuucgcguagugaauggcuggacuauagccaacagcaaaucucagaucaauagacaggucauuguggauucagacgauuggaguggguacagcggaaucuucuccguugaaggcaagaaaugcaucaacagguguuuuuauguggagcugauucggggucgaccccaagagccucgcgucugguggacaucuaauucgauaaucguguucugcgggaccagcggcacguacggaaccggcuccuggccagacggggcaaacauuaauuuuaugcccaucuga

SEQ ID NO: 145576 - RNA, 1401 nt, Artificial Sequence
  derived and/or modified sequence opt3 from neuraminidase__InfluenzaA__AGQ81776
augaaccccaaucagaagaucauugccauaggcagcgugucccugaccaucgcuauuaucugcuuccucaugcaaauugcaauccuuacaacuacgaugacccugcacuuuagacagaacgaguguucuaauccuucaaacaaucaggucguuccaugcgaaccgauaaucauugagaggaacacagugcauuugaauaguacuaccaucgaaaaagagauuugucccaagguagccgaauacaaaaacuggagcaagccucagugccaaaucacaggguucgcgccauuuuccaaagacaauucuauacgguuaucggcuggaggugauauuugggugacccgcgagcccuaugucucauguagccugggcaagugcuaccaguucgcccuagggcagggaacuacacucaagaacaaacacaguaauggcaccacgcaugaccgaaucccucaccguacucugcuuaugaacgagcugggugugccauuucauuuggggaccaagcagguuuguauugcaugguccucuagcuccugccacgauggaaaagccuggcuccacaucugugugacaggcgacgauaagaaugcuacugcaucaaucauuuaugacggcaugcuggucgauaguauagggagcuggucuaaaaacauccugagaacccaagaauccgagugcguguguauuaauggaacaugcgccguaguuaugaccgacgguucagcuagcggcaaggccgauacgaggguccucuucauccgggaagggaagauaauuaacaucagucccuuaucuggauccgcgcagcauguggaggagugcagcuguuacccucgcuauccagaagugagaugcguguguagggacaacuggaaaggcucgaaucggccgguccuguacaucaacauggcagauuauucuauugaguccucauacguuugcaguggucuugugggggacacuccccgcgaugacgacagcuccucuagcucaaauugucgagauccuaacaaugaaagaggagccccaggcguaaagggcugggcuuuugacgaugggaacgacaucuggaugggaaggacaauuaaaagugauucccggagcgguuacgagaccuuccgugugauagacggcuggacuacagccgauucuaagucacagaucaaucgccaggucauuguggacagugauagcugguccggguauucuggaaucuuuucgguugaaggcaaaaacugcaucaauagauguuucuacguggaguugauuaggggucggccccaagagacccgagucugguggacgagcaacuccauaaucguguuuugcgggaccucaggcacauauggaacuggcaguuggccugacggggcaaauauuaacuucaugccaaucuga

SEQ ID NO: 145577 - RNA, 1410 nt, Artificial Sequence
  derived and/or modified sequence opt3 from neuraminidase__InfluenzaA__AGQ81777
augaaccccaaucagaagaucgugaccauuggcagcgccucccugacaauagcuacuaugugccuccuucugcagaucgcauuguucgccacgaccaugacauuacacuuuaaacagacuggguguaccaacucuucagacaaucaggcggucccuugcggaccaauuaucauugagagaaacaucacagaaauaguucaucugaauaguaccacucuagagaaggaaacauguccgaaaagcgcugguuacaggaacugguccaagccccagugccaaaucaccggcuucgccccuuuuucuaaagauaauucgauucggcucgcagccgcuggggacaucugggugacgcgcgagccauauguaucauguggacugggcaagugcuaccaguucgcacuuggucaggggacuacccuggauaacaagcacagcaauggaacaacucaugaccgaacaccccaccguaccuugcucaugaacgaacugggcgugccuuuucaucuggccaccaaacaggucuguauugcuuggaguuccucuagcugccacgauggcaaggccuggcuccacguguguguuacgggggacgauaaaaaugcgacugcauccaucauauaugacggaauuuuaguggauucaaucgccaguuggagcaagaacauucugagaacacaagagucugagugcgucuguaucaaugguaccugcacugugguaaugacagacggcuccgcuucagggagggccgauacccggauccuuuucauucgcgaaggaaaaauaguucauaucagcccauugaguggcucugcacagcacguggaggaaugcuccuguuaccccagauauccugaggucaggugcgugugucgggacaacuggaaugguagcaaccgcccagugcuguuuauuaacauggcugauuacucgaucgacucuuccuaugucugcucagggcuaguuggagacacgccgcgaaaugaugacagaaguagcuccucuaacuguagggaucccaauaacgagcggggcgccccuggcgugaaggggugggcguucgacagcggaaaugauauauggaugggucguaccauugaaaaggacucacgcaguggcuacgagacauuuagaguaaucuccggguggagcacugccaacucuaaaucacagaucaauaggcaagugauugucgaucgggacaacaguagcggauacuccggcaucuucucuguggaagguaagucgugcauuaaucgauguuuuuauguugagcucauacgcgggagaccaaaagaaaacagggugugguggaccagcaauuccaucauugucuucugcggcacaucaggaacuuacggcaccgggaguuggcccgauggagcaaacaucaaucugaugccuaucuga

SEQ ID NO: 145578 - RNA, 1410 nt, Artificial Sequence
  derived and/or modified sequence opt3 from neuraminidase__InfluenzaA__AGQ81778
augaaccccaaucagaagaucgugaccauuggcagcgccucccugacaauagcuacuaugugccuccuucugcagaucgcauuguucgccacgaccaugacauuacacuuuaaacagacuggguguaccaacucuucagacaaucaggcggucccuugcggaccaauuaucauugagagaaacaucacagaaauaguucaucugaauaguaccacucuagagaaggaaacauguccgaaaagcgcugguuacaggaacugguccaagccccagugccaaaucaccggcuucgccccuuuuucuaaagauaauucgauucggcucgcagccgcuggggacaucugggugacgcgcgagccauauguaucauguggacugggcaagugcuaccaguucgcacuuggucaggggacuacccuggauaacaagcacagcaauggaacaacucaugaccgaacaccccaccguaccuugcucaugaacgaacugggcgugccuuuucaucuggccaccaaacaggucuguauugcuuggaguuccucuagcugccacgauggcaaggccuggcuccacguguguguuacgggggacgauaaaaaugcgacugcauccaucauauaugacggaauuuuaguggauucaaucgccaguuggagcaagaacauucugagaacacaagagucugagugcgucuguaucaaugguaccugcacugugguaaugacagacggcuccgcuucagggagggccgauacccggauccuuuucauucgcgaaggaaaaauaguucauaucagcccauugaguggcucugcacagcacguggaggaaugcuccuguuaccccagauauccugaggucaggugcgugugucgggacaacuggaaggguagcaaucgcccagugcuguuuauuaacauggcugauuacucgaucgacucuuccuaugucugcucagggcuaguuggagacacgccgcgaaacgaugacagaaguagcuccucuaauuguagggaucccaacaaugagcggggcgccccuggcgugaaggggugggcguucgacagcggaaacgauauauggaugggucguaccauugaaaaagacucacgcaguggcuacgagacauuuagaguaaucuccggguggagcacugccaauucuaagucacagaucaacaggcaagugauugucgaucgggacaauaguagcggauacuccggcaucuucucuguggaagguaaaucgugcauuaaccgauguuuuuauguugagcucauacgcgggagaccaaaggaaaauagggugugguggaccagcaacuccaucauugucuucugcggcacaucaggaacuuacggcaccgggaguuggcccgauggagcaaauaucaaccugaugccuaucuga

SEQ ID NO: 145579 - RNA, 1410 nt, Artificial Sequence
  derived and/or modified sequence opt3 from neuraminidase__InfluenzaA__AGQ81779
augaaccccaaucagaagaucguggccauuggcagcgcuucccugaccauagcaacaaugugccuccuucugcaaaucgccuuguucgcgacuacgaugaccuuacacuuuaaacagacaggguguacuaacucuucagacaaucaggcugucccuugcggaccaauuaucauugagagaaacaucaccgaaauaguucaucugaauaguacaacccuagagaaggaaacuuguccgaaaagcgccgguuacaggaacugguccaagccccagugccaaaucacaggcuucgcaccuuuuucuaaagauaauucgauucggcucgccgcugcaggggacaucugggugacccgcgagccauauguaucauguggacugggcaagugcuaccaguucgcccuuggucaggggacgacucuggauaacaagcacagcaauggaaccacacaugaccgaacuccccaccguaccuugcucaugaacgaacugggcgugccuuuucaucuggcuacaaaacaggucuguauugccuggaguuccucuagcugccacgauggcaaggcguggcuccacguguguguuaccggggacgauaaaaaugcaacggccuccaucauauaugacggaauuuuaguggauucaaucgcuaguuggagcaagaacauucugagaacucaagagucugagugcgucuguaucaaugguacaugcaccgugguaaugacugacggcuccgccucagggagggcagauacacggauccuuuucauucgcgaaggaaaaauaguucauaucagcccauugaguggcucugcucagcacguggaggaaugcuccuguuaccccagauauccugagauuaggugcgucugucgggacaacuggaaggguagcaaucgcccagugcuguuuaucaacauggccgauuacucgauagacucuuccuaugugugcucagggcuagucggagacaccccgcgaaacgaugacagaaguagcuccucuaauuguagggaucccaacaaugagcggggcgcgccuggcguuaaggggugggccuucgacagcggaaacgauauuuggaugggucguacgaucgaaaaagacucacgcaguggcuacgagaccuuuagagugaucuccggguggagcacagcaaauucuaagucacagauuaacaggcagguaaucguggaucgggacaauaguagcggauacuccggcauuuucucugucgaagguaaaucgugcauaaaccgauguuuuuauguggagcucauccgcgggagaccaaaggaaaauaggguuugguggacuagcaacuccauuaucguguucugcggcaccucaggaacauacggcacugggaguuggcccgauggagcuaauaucaaccugaugccuauuuga

SEQ ID NO: 145580 - RNA, 1410 nt, Artificial Sequence
  derived and/or modified sequence opt3 from neuraminidase__InfluenzaA__AGQ81780
augaaccccaaucagaagaucguggccauuggcagcgcuucccugaccauagcaacaaugugccuccuucugcagaucgccuuguucgcgacuacgaugaccuuacacuuuaaacagacaggguguacuaacucuucagacaaucaggcugucccuugcggaccaauuaucauugagagaaacaucaccgaaauaguucaucugaauaguacaacccuagagaaggaaacuuguccgaaaagcgccgguuacaggaacugguccaagccccagugccaaaucacaggcuucgcaccuuuuucuaaagauaauucgauucggcucgccgcugcaggggacaucugggugacccgcgagccauauguaucauguggacugggcaagugcuaccaguucgcccuuggucaggggacgacucuggauaacaagcacagcaauggaaccacacaugaccgaacuccccaccguaccuugcucaugaacgaacugggcgugccuuuucaucuggcuacaaaacaggucuguauugccuggaguuccucuagcugccacgauggcaaggcguggcuccacguguguguuaccggggacgauaaaaaugcaacggccuccaucauauaugacggaauuuuaguggauucaaucgcuaguuggagcaagaacauucugagaacucaagagucugagugcgucuguaucaaugguacaugcaccgugguaaugacugacggcuccgccucagggagggcagauacacggauccuuuucauucgcgaaggaaaaauaguucauaucagcccauugaguggcucugcucagcacguggaggaaugcuccuguuaccccagauauccugaggucaggugcgugugucgggacaacuggaaggguagcaaucgcccagugcuguuuauuaacauggccgauuacucgaucgacucuuccuaugucugcucagggcuaguuggagacaccccgcgaaacgaugacagaaguagcuccucuaauuguagggaucccaacaaugagcggggcgcgagcggcgugaaggggugggccuucgacucaggaaacgauauauggaugggucguacgauugaaaaagacagucgcuccggcuacgagaccuuuagaguaaucagcggguggucuacagcaaauucaaagagucagaucaacaggcaagugauugucgaucgggacaauagcuccggauacucuggcaucuucucgguggaagguaaaagcugcauuaaccgauguuuuuauguugagcucauacgcgggagaccuaaggaaaauagggugugguggacuuccaacucaaucauugucuucugcggcaccaguggaacauacggcacugggucuuggccagauggagcuaauaucaaccugaugcccaucuga

SEQ ID NO: 145581 - RNA, 1401 nt, Artificial Sequence
  derived and/or modified sequence opt3 from neuraminidase__InfluenzaA__AGQ81781
augaaccccaaucagaagaucauugccauaggcagcgugucccugaccaucgcuauuaucugcuuccucaugcaaauugcaauccuuacaacuacgaugaccccucacuuuagacagaacgaguguucuaauccaucaaacaaucaggucguuccgugcgaacccauaaucauugagaggaacacagugcaucugaauaguacuaccaucgaaaaagagauuuguccuaagguagccgaauacaaaaacuggagcaagccacagugccaaaucacaggguucgcgcccuuuuccaaagacaauucuauacgguugucggcuggaggugauauuugggugacccgcgagccuuaugucucauguagcuuaggcaagugcuaccaguucgcccuggggcagggaacuacacuaaagaacaaacacaguaauggcaccacgcaugaccgaaucccacaccguacucuccugaugaacgagcuuggugugcccuuucaucuggggaccaagcagguuuguauugcaugguccucuagcuccugccacgauggaaaagccugguugcacaucugugugacaggcgacgauaagaaugcuacugcaucaaucauuuaugacggcaugcucgucgauaguauagggagcuggucuaaaaacauccugagaacccaagaauccgagugcguguguauuaauggaacaugcgccguaguuaugaccgacgguucagcuagcggcaaggccgauacgaggauccuguucauacgggaagggaagauuaucaacaucaguccucucucuggauccgcgcagcauguggaggagugcagcuguuacccacgcuauccggaagucagaugcguguguagggacaacuggaaaggcucgaaucggcccguguuauacauuaacauggcagauuauucuaucgaguccucauacgucugcaguggucugguuggggacacuccucgcgaugacgacagcuccucuagcucaaauugucgagauccaaacaaugaaagaggagcccccggcgugaagggcugggcuuuugacgaugggaacgacauuuggaugggaaggacaauaaaaagugauucccggagcgguuacgagaccuuccguguagugaauggcuggacuacagccaacucuaagucacagaucaaucgccaggucauuguggacagugauagcugguccggguauucuggaaucuuuucgguugaaggcaaaaacugcaucaauagauguuucuacguggagcuuauuaggggucggccucaagagacccgagucugguggacgagcaacuccauaaucguguuuugcgggaccucaggcacauauggaacuggcaguuggccagacggggcagauauuaauuugaugcccaucuga

SEQ ID NO: 145582 - RNA, 1410 nt, Artificial Sequence
  derived and/or modified sequence opt3 from neuraminidase__InfluenzaA__AGQ81783
augaaccccaaucagaagaucgugaccauuggcagcgccucccugacaauagcuacuaugugccuccuucugcagaucgcauuguucgccacgaccaugacauuacacuuuaaacagacuggguguaccaacucuucagacaaucaggcggucccuugcggaccaauuaucauugagagaaacaucacagaaauaguucaucugaauaguaccacucuagagaaggaaacauguccgaaaagcgcugguuacaggaacugguccaagccccagugccaaaucaccggcuucgccccuuuuucuaaagauaauucgauucggcucgcagccgcuggggacaucugggugacgcgcgagccauauguaucauguggacugggcaagugcuaccaguucgcacuuggucaggggacuacccuggauaacaagcacagcaauggaacaacucaugaccgaacaccccaccguaccuugcucaugaacgaacugggcgugccuuuucaucuggccaccaaacaggucuguauugcuuggaguuccucuagcugccacgauggcaaggccuggcuccacguguguguuacgggggacgauaaaaaugcgacugcauccaucauauauaacggaauuuuaguggacucaaucgccaguuggagcaagaauauucugagaacacaagagucugagugcgucuguaucaacgguaccugcacugugguaaugacagauggcuccgcuucagggagggccgacacccggauccuuuucauucgcgaaggaaaaauaguucauaucagcccauugaguggcucugcacagcacguggaggaaugcuccuguuaccccagauauccugaggucaggugcgugugucgggauaauuggaaggguagcaaccgcccagugcuguuuauuaacauggcugacuacucgaucgauucuuccuaugucugcucagggcuaguuggagacacgccgcgaaaugacgauagaaguagcuccucuaacuguagggaccccaauaacgagcggggcgccccuggcgugaaggggugggcguucgauagcggaaaugacauauggaugggucguaccauugaaaaagauucacgcaguggcuacgagacauuuagaguaaucuccggguggagcacugccaacucuaagucacagaucaauaggcaagugauugucgaccgggauaacaguagcggauacuccggcaucuucucuguggaagguaaaucgugcauuaaucgauguuuuuauguugagcucauacgcgggagaccaaaggaaaacagggugugguggaccagcaauuccaucauugucuucugcggcacaucaggaacuuacggcaccgggaguuggcccgacggagcaaacaucaaucugaugccuaucuga

SEQ ID NO: 145583 - RNA, 1401 nt, Artificial Sequence
  derived and/or modified sequence opt3 from neuraminidase__InfluenzaA__AGQ81784
augaaccccaaucagaagaucauugccauaggcagcgugucccugaccaucgcuauuaucugcuuccucaugcaaauugcaauccuuacaacuacgaugacccugcacuuuagacagaacgaguguucuaauccuucaaacaaucaggucguuccaugcgaaccgauaaucauugagaggaacacagugcauuugaauaguacuaccaucgaaaaagagauuugucccaagguagccgaauacaaaaacuggagcaagccucagugccaaaucacaggguucgcgccauuuuccaaagacaauucuauacgguuaucggcuggaggugauauuugggugacccgcgagcccuaugucucauguagccugggcaagugcuaccaguucgcccuagggcagggaacuacacuccgaaacaagcacaguaauggcaccacgcaugaccguaucccucacagaacucugcuuaugaacgagcugggugugccauuucauuuggggaccaaacagguuuguauugcaugguccucuagcuccugccacgauggaaaggccuggcuccacaucugugugacaggcgacgauaaaaaugcuacugcaucaaucauuuaugacggcaugcuggucgauaguauagggagcuggucuaagaacauccugaggacccaagaauccgagugcguguguauuaauggaacaugcgccguaguuaugaccgacgguaacgcuucaggcaaagccgauacgcgggugcucuuuauccgcgaagggaagauaauuaacaucagccccuuaaguggaucugcgcagcaugucgaggagugcuccuguuacccuagauauccagaagugaggugcgugugucgggacaauuggaagggcagcaaccgcccgguccuguacaucaauauggcagauuauucgauugagucuuccuacguuugcucaggucuugugggggacacuccccgagaugacgacaguagcuccucuagcaacuguagagauccuaauaacgaaaggggagccccaggcguaaaaggcugggcuuuugacgaugggaaugacaucuggaugggacggacaauuaagucagauagucguuccgguuacgagaccuuccgcguggucaacggcuggacuacagccaauagcaaaucucagauaaacagacaggugaucguugacucagauaguuggagcggguauuccggaauuuucucuguggaaggcaagaauugcaucaacagguguuucuacgucgaguugauccggggucgaccccaagagacccgcgugugguggacgucgaauagcauuauaguauuuugcgggaccuccggcacauauggaacuggcucauggccugacggggcagauaucaacuucaugccaauuuga

SEQ ID NO: 145584 - RNA, 1401 nt, Artificial Sequence
  derived and/or modified sequence opt3 from neuraminidase__InfluenzaA__AGQ81785
augaaccccaaucagaagaucauugccauaggcagcgugucccugaccaucgcuauuaucugcuucauuaugcaaaucgcaauacucacaacuacgaugaccccucacuuuagacagaacgaguguucuaauccaucaaacaaucaggucguuccgugcgaacccaucauuaucgagaggaacacagugcaucuuaauaguacuaccauugaaaaagagaucuguccuaagguagccgaauacaaaaacuggagcaagccacagugccaaauaacaggguucgcgcccuuuuccaaagacaauucuauucggcugucggcuggaggugauaucugggugacccgcgagccuuaugucucauguagcuugggcaagugcuaccaguucgccuuagggcagggaacuacacugaagaacaaacacaguaauggcaccacgcaugaccguauuccacaccgaacucuacucaugaacgagcugggugugcccuuucaucuugggaccaagcagguuuguaucgcaugguccucuagcuccugccacgauggaaaagccuggcugcacaucugugugacaggcgacgauaagaaugcuacugcaucaauuauauaugacggcauguuggucgauaguaucgggagcuggucuaaaaacauucucagaacccaagaauccgagugcguguguaucaauggaacaugcgccguaguuaugaccgacgguucagcuagcggcaaggccgauacgaggauacuguucauucgggaagggaagaucaucaacauuaguccucugucuggauccgcgcagcauguggaggagugcagcuguuacccacgcuauccggaagucagaugcguguguagggacaacuggaaaggcucgaaucggcccgugcucuacaucaacauggcagauuauucuauugaguccucauacgucugcagugguuuaguuggggacacuccucgcgaugacgacagcuccucuagcucaaauugucgagauccaaacaaugaaagaggagcccccggcgugaagggcugggcuuuugacgaugggaacgacauauggaugggaaggacaaucaaaagugauucccggagcgguuacgagaccuuccguguagugaauggcuggacuacagccaacucuaagucacagauuaaucgccaggucaucguggacagugauagcugguccggguauucuggaaucuuuucgguugaaggcaaaaacugcauuaauagauguuucuacguggagcugauaaggggucggccucaagagacccgagucugguggacgagcaacuccaucauuguguuuugcgggaccucaggcacauauggaacuggcaguuggccagacggggcagauaucaaucuuaugcccauuuga

SEQ ID NO: 145585 - RNA, 1401 nt, Artificial Sequence
  derived and/or modified sequence opt3 from neuraminidase__InfluenzaA__AGQ81787
augaaccccaaucagaagaucauugccauaggcagcgugucccugaucauugcuaucauuugccuccuuaugcaaaucgcaauacugaccacaacuaugacguugcacuucagacagaacgaguguucuaauccuucaaacaaucaggucguuccaugcgaaccgaucauuaucgagaggaacaccgugcauuuaaauaguacaacuauugaacgggagaucugucccaaaguagccgaauacaagaacuggagcaaaccucagugccaaauaaccggguuugcgccauucuccaaggacaauucuauucgccugucggcuggaggugauaucugggugacacgagagcccuaugucucauguagccuagacaaaugcuaccaguuugcccucggccaggggaccacucugaagaacaagcacaguaauggaacaacccaugaucguacgccucacagaacucuucugaugaacgaguugggcgugccauuccaucucgguaccaaacagguuuguauugcaugguccucuagcuccugcuaugacgggaaggccuggcugcacaucugugugacaggagaugacaaaaaugcuacugcaucaaucauuuacgauggcaugcuggucgacaguauaggcagcuggucuaagaacauccucaggacccaagaauccgagugcguguguauuaaugggacaugcgccguaguuaugaccgauggaucagcuagcgguaaagccgacacgcggguguuauuuauccgcgaaggcaagauaauuaacaucaguccccugucuggguccgcgcagcacgucgaggagugcagcuguuauccuagauacccagaagugaggugcgugugucgggauaacuggaagggaucgaaucgcccgauccuuuauauuaacauggcagacuacucuaucgaguccucauacgucugcaguggcuugguuggugauacuccccgaaaugacgacagcuccucuagcucaaacuguagagauccuaauaacgaaaggggagccccaggggugaaaggcugggcuuucgacgauggcaaugacguauggauggggcggacaauuaagaacggaagucguuccgguuaugagaccuuucgcguggucaauggcuggacuauggccaacagcaaaucucagauaaauagacaggugaucguugauucagacgauuggaguggguacagcggaauuuucuccguggaaggcaagaaaugcaucaacagguguuuuuaugucgagcugauccggggucgaccccaagagccucgcgugugguggacaucuaauucgauuauaguauucugcgggaccagcggcacguacggaaccggcuccuggccagacggggcaaacaucaauuuuaugcccauuuga

SEQ ID NO: 145586 - RNA, 1401 nt, Artificial Sequence
  derived and/or modified sequence opt3 from neuraminidase__InfluenzaA__AGQ81789
augaaccccaaucagaagaucauugccauaggcagcgugucccugaccaucgcuauuaucugccuccuuaugcaaauugcaauccugacaacuacgaugaccccucacuucagacagaacgaguguucuaauccaucaaacaaucaggucguuccgugcgaacccauaaucauugagaggaacacagugcauuugaauaguacuaccaucgaaaaagagauuuguccuaagguagccgaauacaaaaacuggagcaagccacagugccaaaucacaggguuugcgcccuucuccaaagacaauucuauacgguuaucggcuggaggugauauuugggugacccgcgagccuuaugucucauguagccugggcaagugcuaccaguuugcccuagggcagggaacuacacucaagaacaaacacaguaauggcaccacgcaugaccgaaucccacaccguacucugcuuaugaacgagcugggugugcccuuccauuuggggaccaagcagguuuguauugcaugguccucuagcuccugccacgauggaaaagccuggcuccacaucugugugacaggcgacgauaagaaugcuacugcaucaaucauuuaugacggcaugcuggucgauaguauagggagcuggucuaaaaacauccugagaacccaagaauccgagugcguguguauuaauggaacaugcgccguaguuaugaccgacgguucagcuagcggcaaggccgauacgaggauccucuuuauacgggaagggaagauuaucaacaucaguccuuuaucuggauccgcgcagcauguggaggagugcagcuguuacccacgcuauccggaagucagaugcguguguagggacaacuggaaaggcucgaaucggcccgugcuguacauuaacauggcagauuauucuaucgaguccucauacgucugcaguggucuuguuggggacacuccucgcgaugacgacagcuccucuagcucaaauugucgagauccaaacaaugaaagaggagcccccggcgugaagggcugggcuuucgacgaugggaacgacauuuggaugggaaggacaauaaaaagugauucccggagcgguuacgagaccuuucguguagugaauggcuggacuacagccaacucuaagucacagaucaaucgccaggucauuguggacagugauagcugguccggguauucuggaaucuucucgguugaaggcaaaaacugcaucaauagauguuuuuacguggaguugauuaggggucggccucaagagacccgagucugguggacgagcaacuccauaaucguguucugcgggaccucaggcacauauggaacuggcaguuggccagacggggcagauauuaaucugaugcccaucuga

SEQ ID NO: 145587 - RNA, 1401 nt, Artificial Sequence
  derived and/or modified sequence opt3 from neuraminidase__InfluenzaA__AGQ81790
augaaccccaaucagaagaucauugccauaggcagcgugucccugaucauugcuaucauuugccuccuuaugcaaaucgcaauacugaccacaacuaugacguugcacuucagacagaacgaguguucuaauccuucaaacaaucaggccaugccaugcgaaccgaucauuaucgagaggaacaccguccauuuaaauaguacaacuauugaacgggagaucugucccaaaguuaccgaauacaagaacuggagcaaaccucagugccaaauaacaggguuugcgccauucuccaaggacaauucuauucgccugucggcuggaggugauaucugggugacccgagagcccuauguaucauguagccuagacaaaugcuaccaguuugcccucggccaggggacuacacugaagaacaagcacaguaauggaaccacgcaugaucguacuccucacagaacccuucugaugaacgaguugggcgugccauuccaucucgguacaaaacaggucuguauugcaugguccucuagcuccugcuaugacgggaaggccuggcugcacaucugugugacuggagaugacaaaaaugcuaccgcaucaaucauuuacgauggcaugcugguugacaguauaggcagcuggucuaagaacauccucaggacacaagaauccgagugcguguguauuaaugggaccugcgccgucgugaugacggauggaucagcuagcggucgggccgacacucgcguauuauuuaucagagaaggcaaaauaauuaacaucaguccccugucugggaacgcgcagcacguugaggagugcuccuguuauccuagguacccagaagugcggugcgucugucgcgauaauuggaagggaagcaaccgaccgauccuuuauauuaauauggcagacuacucgaucgagucuuccuacgugugcucaggcuuggugggugauacacccagaaacgacgacaguagcuccucuagcaauuguagggauccuaacaaugaacguggggccccaggagucaagggcugggcuuucgacgauggcaacgacguuuggauggggcggaccauuaaaaauggaucacgcagugguuaugagacuuuuagagugguaaacggcuggacaauggccaauuccaagagccagauaaacaggcaagugaucgucgauucugacgaauggucaggguacaguggaauuuucagcguggagggcaaaaagugcaucaaucgguguuuuuauguugagcugauccgaggucgcccccaggaaccuagagugugguggaccuccaacucuauuauagucuucugcgggacgucgggcaccuacggaacaggcagcuggccagauggggcaaauaucaacuuuaugcccauuuga

SEQ ID NO: 145588 - RNA, 1401 nt, Artificial Sequence
  derived and/or modified sequence opt3 from neuraminidase__InfluenzaA__AGQ81792
augaaccccaaucagaagaucauugccauaggcagcgugucccugaucauugcuaucauuugccuccuuaugcaaaucgcaauacugaccacaacuaugacguugcacuucagacagaacgaguguucuaauccuucaaacaaucaggucaugccaugcgaaccgaucauuaucgagaggaacaccguucauuuaaauaguacaacuauugaacgggagaucugucccaaaguggccgaauacaagaacuggagcaaaccucagugccaaauaaccggguuugcgccauucuccaaggacaauucuauucgccugucggcuggaggugauaucuggguaacacgagagcccuaugugucauguagccuaaacaaaugcuaccaguuugcccucggccaggggaccacucuggagaauaagcacaguaacggaacaacccaugaccguacgccucacagaacucuucugaugaaugaauugggcgucccauuccaucucgguaccaaacagguguguauggcaugguccucuagcuccugcuaugaugggaaggccuggcugcacauuuguguuacaggagacgauaagaacgcuacugcaucagugaucuacgacggcaugcuggucgauaguaucggcagcuggucucaaaauauucucaggacccaggaguccgaaugcguguguauaaacgggacaugcgccguaguuaugaccgacggaucagcuagcgguaaagccgauacgcggguguuauuuauccgcgagggcaagauuaucaacauaaguccccugucuggguccgcgcagcacgucgaggaaugcagcuguuauccuagauacccagaggugaggugcgugugucgggacaauuggaaaggaucgaaccgcccgauucuuuauaucaauauggcagauuacucuaucgaauccucauacgucugcaguggcuugguuggugacacuccccgaaacgaugacagcuccucuagcucaaauuguagagacccuaacaaugagaggggagccccaggggugaagggcugggcuuucgaugacggcaacgauguauggauggggcggacaauuaagaauggaagucguuccgguuaugaaaccuuucgcguggucaacggcuggacuauggccaauagcaaaucucagaucaacagacaagugauuguugacucagaugacuggaguggguacagcggaauauucuccguggagggcaagaaaugcaucaauagguguuuuuaugucgagcugauucggggucgaccccaggaaccucgcgugugguggacaucuaacucgaucaucguauucugcgggaccagcggcacguacggaaccggcuccuggccagauggggcaaauauuaacuuuaugcccauauga

SEQ ID NO: 145589 - RNA, 1401 nt, Artificial Sequence
  derived and/or modified sequence opt3 from neuraminidase__InfluenzaA__AGQ81793
augaaccccaaucagaagaucauugccauaggcagcgugucccugaucauugcuaucauuugccuccuuaugcaaaucgcaauacugaccacaacuaugacguugcacuucagacagaacgaguguucuaauccuucaaacaaucaggucaugccaugcgaaccgaucauuaucgagaggaacaccguucauuuaaauaguacaacuauugaacgggagaucugucccaaaguggccgaauacaagaacuggagcaaaccucagugccaaauaaccggguuugcgccauucuccaaggacaauucuauucgccugucggcuggaggugauaucuggguaacacgagagcccuaugugucauguagccuaaacaaaugcuaccaguuugcccucggccaggggaccacucuggagaauaagcacaguaacggaacaacccaugaccguacgccucacagaacucuucugaugaaugaauugggcgucccauuccaucucgguaccaaacagguguguauggcaugguccucuagcuccugcuaugaugggaaggccuggcugcacauuuguguuacaggagacgauaagaacgcuacugcaucagugaucuacgacggcaugcuggucgauaguaucggcagcuggucuaaaaauauucucaggacccaagaguccgaaugcguguguauaaacgggacaugcgccguaguuaugaccgacggaucagcuagcgguaaggccgauacgcggguguuauuuauccgcgagggcaaaauuaucaacauaaguccccugucuggguccgcgcagcacgucgaggaaugcagcuguuauccuagauacccagaggugaggugcgugugucgggacaauuggaagggaucgaaccgcccgauucuuuauaucaauauggcagauuacucuaucgaauccucauacgucugcaguggcuugguuggugacacuccccgaaacgaugacagcuccucuagcucaaauuguagagacccuaacaaugagaggggagccccaggggugaagggcugggcuuucgaugacggcaacgauguauggauggggcggacaauuaaaaauggaagucguuccgguuaugaaaccuuucgcguggucaacggcuggacuauggccaauagcaagucucagaucaacagacaggugauuguugacucagaugacuggaguggguacagcggaauauucuccguggagggcaaaaagugcaucaauagguguuuuuaugucgagcugauucggggucgaccccaagaaccucgcgugugguggacaucuaacucgaucaucguauucugcgggaccagcggcacguacggaaccggcuccuggccagauggggcaaauauuaacuuuaugcccauauga

SEQ ID NO: 145590 - RNA, 1401 nt, Artificial Sequence; identical to SEQ ID NO: 145589
  derived and/or modified sequence opt3 from neuraminidase__InfluenzaA__AGQ81794

SEQ ID NO: 145591 - RNA, 1401 nt, Artificial Sequence
  derived and/or modified sequence opt3 from neuraminidase__InfluenzaA__AGQ81795
augaaccccaaucagaagaucauugccauaggcagcgugucccugaucauugcuaucauuugccuccuuaugcaaaucgcaauacugaccacaacuaugacguugcacuucagacagaacgaguguaauaacccuucuaauaaccaggucaugccaugcgaaccgaucauuaucgagaggaauaccguucauuuaaacucaacaacuauugaacgggagaucugucccaaaguggccgaauacaagaauuggaguaaaccucagugccaaauaaccggguuugcgccauucagcaaggacaacuccauucgccugucugcuggaggugauaucuggguaacacgagagcccuaugugucguguucacuagacaaaugcuaccaguuugcccucggccaggggaccacucugaagaauaagcacagcaacggaacaacccaugaucguacgccucacagaacucuucugaugaaugaguugggcgucccauuccaucucgguaccaaacagguguguauugcauggaguuccucuagcugcuaugacgggaaggccuggcugcacaucuguguuacaggagaugacaaaaacgcuacugcauccaucauuuacgauggcaugcugguggacucaauaggcaguuggagcaagaauauccucaggacccaagaaucugagugcgucuguauuaacgggacaugcgccgugguaaugaccgauggauccgcuucagguaaagccgacacgcggguuuuauuuauccgcgaaggcaagauaauuaacaucagcccccugagugggucugcgcagcacguggaggagugcuccuguuauccuagauacccagaagucaggugcgugugucgggauaauuggaagggaagcaaccgcccgauccuuuauauuaauauggcagacuacucgaucgagucuuccuacgugugcucaggcuuggucggugauacuccccgaaacgacgacaguagcuccucuagcaauuguagagauccuaacaaugaaaggggagccccagggguuaaaggcugggcuuucgacgauggcaacgacguguggauggggcggacaauuaagaauggaucacguagugguuaugagaccuuucgcguagugaacggcuggacuauagccaauuccaaaagccagaucaacagacagauuaucgucgauucugacgauuggucaggguacaguggaaucuucagcguggaaggcaagaaaugcauuaauagguguuuuuauguugagcugauacggggucgaccccaagagccucgcgugugguggacauccaacucuaucauugucuucugcgggaccucgggcacguacggaaccggcagcuggccagacggggcaaauaucaacuuuaugcccauuuga

SEQ ID NO: 145592 - RNA, 1401 nt, Artificial Sequence
  derived and/or modified sequence opt3 from neuraminidase__InfluenzaA__AGQ81796
augaaccccaaucagaagaucauugccauaggcagcgugucccugaucauugcuaucauuugccuccuuaugcaaaucgcaauacugaccacaacuaugacguugcacuucagacagaacgaguguucuaauccuucaaacaaucaggucaugccaugcgaaccgaucauuaucgagaggaacaccguucauuuaaauaguacaacuauugaacgggagaucugucccaaaguggccgaauacaagaacuggagcaaaccucagugccaaauaaccggguuugcgccauucuccaaggacaauucuauucgccugucggcuggaggugauaucuggguaacacgagagcccuaugugucauguagccuagacaaaugcuaccaguuugcccucggccaggggaccacucugaagaacaagcacaguaauggaacaacccaugaucguacgccucacagaacucuucugaugaacgaguugggcgucccauuccaucucgguaccaaacagguguguauugcaugguccucuagcuccugcuaugacgggaaggccuggcugcacaucuguguuacaggagaugacaaaaaugcuacugcaucaaucauuuacgauggcaugcugguggacaguauaggcagcuggucuaagaacauccucaggacccaagaauccgagugcgucuguauuaaugggacaugcgccgugguaaugaccgauggaucagcuagcgguaaagccgacacgcggguuuuauuuauccgcgaaggcaagauaauuaacaucaguccccugucuggguccgcgcagcacguggaggagugcagcuguuauccuagauacccagaagucaggugcgugugucgggauaacuggaagggaucgaaucgcccgauccuuuauauuaacauggcagacuacucuaucgaguccucauacgugugcaguggcuuggucggugauacuccccgaaaugacgacagcuccucuagcucaaacuguagagauccuaauaacgaaaggggagccccagggguuaaaggcugggcuuucgacgauggcaaugacauuuggauggggcggacaauaaagaacggaagucguuccgguuaugagaccuuucgcgugguaaauggcuggacuauggccaacagcaaaucucagaucaauagacaggugauugucgauucagacgauuggaguggguacagcggaaucuucuccguggaaggcaagaaaugcaucaacagguguuuuuauguugagcugauucggggucgaccccaagagccucgcgugugguggacaucuaauucgauaaucgucuucugcgggaccagcggcacguacggaaccggcuccuggccagacggggcaaacauuaauuuuaugcccaucuga

SEQ ID NO: 145593 - RNA, 1401 nt, Artificial Sequence
  derived and/or modified sequence opt3 from neuraminidase__InfluenzaA__AGQ81798
augaaccccaaucagaagaucauuagcauaggcuccgugucucugaucauugccaucauuugccuccuuaugcaaaucgcuauacugaccacaacuaugacguugcacuucagacagaacgaguguucaaauccuaguaacaaucaggucaugccaugcgaaccgaucauuaucgagaggaacaccguucauuuaaauagcacaacuauugaacgggagaucugucccaaaguggcagaauacaagaacugguccaaaccucagugccaaauaaccggguuugccccauucucuaaggacaauucgauucgccugucagcgggaggugauaucuggguaacacgagagcccuaugugagcuguagucuagacaaaugcuaccaguuugcucucggccaggggaccacucugaagaacaagcacuccaauggaacaacccaugaucguacgccucacagaacucuucugaugaacgaguugggcgucccauuccaucucgguaccaaacagguguguauugccuggucuagcuccucaugcuaugacgggaaggcauggcugcacaucuguguuacaggagaugacaaaaaugccacugcuaguaucauuuacgauggcaugcugguggacagcauaggcucuugguccaagaacauccucaggacccaagaaucagagugcgucuguauuaaugggacaugcgcagugguaaugaccgauggaagcgccagugguaaagcugacacgcggguuuuauuuauccgcgaaggcaagauaauuaacaucucuccccuguccgggagcgcccagcacguggaggagugcucguguuauccuagauacccagaagucaggugcgugugucgggauaacuggaagggaucuaaucgcccgauccuuuauauuaacauggcggacuacuccaucgagucaaguuacgugugcagcggcuuggucggugauacuccccgaaaugacgacuccucuagcucaaguaacuguagagauccuaauaacgaaaggggagcaccagggguuaaaggcugggccuucgacgauggcaaugacguguggauggggcggacaauuaagaacggaucccguagcgguuaugagaccuuucgcguagugaauggcuggacuauggcuaacucuaaaucacagauaaauagacaggucaucguggauagugacgauuggagcggguacuccggaauuuucucuguugaaggcaagaaaugcaucaacagguguuuuuauguggagcugauccggggucgaccccaagagccucgcgucugguggacaucgaauagcauuauaguguucugcgggaccuccggcacguacggaaccggcucauggccagacggggccaacaucaauuuuaugcccauuuga

SEQ ID NO: 145594 - RNA, 1401 nt, Artificial Sequence
  derived and/or modified sequence opt3 from neuraminidase__InfluenzaA__AGQ81799
augaaccccaaucagaagaucauugccauaggcagcgugucccugaucauugcuaucauuugccuccuuaugcaaaucgcaauacugaccacaacuaugacguugcacuucagacagaacgaguguucuaauccuucaaacaaucaggucaugccaugcgaaccgaucauuaucgagaggaacaccguucauuuaaauaguacaacuauugaacgggagaucugucccaaaguggccgaauacaagaacuggagcaaaccucagugccaaauaaccggguuugcgccauucuccaaggacaauucuauucgccugucggcuggaggugauaucuggguaacacgagagcccuaugugucauguagccuagacaaaugcuaccaguuugcccucggccaggggaccacucugaagaacaagcacaguaauggaacaacccaugaucguacgccucacagaacucuucugaugaacgaguugggcgucccauuccaucucgguaccaaacagguguguauugcaugguccucuagcuccugcuaugacgggaaggccuggcugcacaucuguguuacaggagaugacaaaaaugcuacugcaucaaucauuuacgauggcaugcugguggacaguauaggcagcuggucuaagaacauccucaggacccaagaauccgagugcgucuguauuaaugggacaugcgccgugguaaugaccgauggaucagcuagcgguaaagccgacacgcggguuuuauuuauccgcgaaggcaagauaauuaacaucaguccccugucuggguccgcgcagcacguggaggagugcagcuguuauccuagauacccagaagucaggugcgugugucgggauaacuggaagggaucgaaucgcccgauccuuuauauuaacauggcagacuacucuaucgaguccucauacgugugcaguggcuuggucggugauacuccccgaaaugacgacagcuccucuagcucaaacuguagagauccuaauaacgaaaggggagccccagggguuaaaggcugggcuuucgacgauggcaaugacguguggauggggcggacaauuaagaacggaagucguuccgguuaugagaccuuucgcguagugaauggcuggacuauggccaacagcaaaucucagauaaauagacaggucaucguggauucagacgauuggaguggguacagcggaauuuucuccguugaaggcaagaaaugcaucaacagguguuuuuauguggagcugauccggggucgaccccaagagccucgcgucugguggacaucuaauucgauuauaguguucugcgggaccagcggcacguacggaaccggcuccuggccagacggggcaaacaucaauuuuaugcccauuuga

SEQ ID NO: 145595 - RNA, 1401 nt, Artificial Sequence; identical to SEQ ID NO: 145594
  derived and/or modified sequence opt3 from neuraminidase__InfluenzaA__AGQ81800

SEQ ID NO: 145596 - RNA, 1401 nt, Artificial Sequence
  derived and/or modified sequence opt3 from neuraminidase__InfluenzaA__AGQ81801
augaaccccaaucagaagaucauugccauaggcagcgugucccugaucauugcuaucauuugccuccuuaugcaaaucgcaauacugaccacaacuaugacguugcacuucagacagaacgaguguucuaauccuucaaacaaucaggucaugccaugcgaaccgaucauuaucgagaggaacaccguucauuuaaauaguacaacuauugaacgggagaucugucccaaaguggccgaauacaagaacuggagcaaaccucagugccaaauaaccggguuugcgccauucuccaaggacaauucuauucgccugucggcuucaggagauaucuggguaacacgagagcccuaugugagcuguagucuagacaaaugcuaccaguuugcccucggucagggcaccacucugaagaacaagcacuccaaugggacaacccaugaucguacgccucacagaacucuucugaugaacgaguugggagucccauuccaucucggcaccaaacagguguguauugcauggucuagcuccucaugcuaugacgguaaggccuggcugcacaucuguguuacaggggaugacaaaaaugcuacugcaaguaucauuuacgauggaaugcugguggacagcauaggcucuugguccaagaacauccucaggacccaagaaucagagugcgucuguauuaauggcacaugcgccgugguaaugaccgaugggagcgcuaguggaaaagccgacacgcggguuuuauuuauccgcgaagguaagauaauuaacaucucuccccuguccggcagcgcgcagcacguggaggagugcucguguuauccuagauacccagaagucaggugcgugugucgggauaacuggaaggggucuaaucgcccgauccuuuauauuaacauggcagacuacuccaucgagucaaguuacgugugcagcggauuggucggcgauacuccccgaaaugacgacuccucuagcucaaguaacuguagagauccuaauaacgaaaggggugccccagggguuaaaggaugggcuuucgacgauggcaaugacguguggaugggccggacaauuaagaacgggucccguagcggauaugagaccuuucgcguagugaaugguuggacuauggccaacucuaaaucacagauaaauagacaggucaucguggauagugacgauuggagcggcuacuccgggauuuucucuguugaaggaaagaaaugcaucaacagguguuuuuauguggagcugauccggggccgaccccaagagccucgcgucugguggacaucgaauagcauuauaguguucugcgguaccuccgggacguacggcaccggaucauggccagacggcgcaaacaucaauuuuaugcccauuuga

SEQ ID NO: 145597 - RNA, 1401 nt, Artificial Sequence
  derived and/or modified sequence opt3 from neuraminidase__InfluenzaA__AGQ81802
augaaccccaaucagaagaucauugccauaggcagcgugucccugaucauugcuaucauuugccuccuuaugcaaaucgcacuguugaccacaacuaugacguuacacuucagacagaacgaguguucuaauccuucaaacaaucaggucaugccaugcgaaccgauaaucauugagaggaacaccguucaucugaauaguacaacuaucgaacgggagauuugucccaaaguggccgaauacaagaacuggagcaaaccucagugccaaaucaccggguuugcgccauucuccaaggacaauucuauacgccuaucggcuggaggugauauuuggguaacacgagagcccuaugugucauguagccucgacaaaugcuaccaguuugcccugggccaggggaccacucuuaagaacaagcacaguaauggaacaacccaugaucguacgccucacagaacucuguugaugaacgagcucggcgucccauuccaucuggguaccaaacagguguguaucgcaugguccucuagcuccugcuaugacgggaaggccuggcugcacauuuguguuacaggagaugacaaaaaugcuacugcaucaaucaucuacaacggcaugcucguggauaguauuggcagcuggucuaagaauauauuaaggacccaagaauccgagugcgucuguaucaacgggacaugcgccgugguaaugaccgacggaucagcuagcgguaaagccgauacgcggguucuguuuauucgcgaaggcgagaucauaaacauuaguccccuuucuggguccgcgcagcacguggaggaaugcagcuguuauccuagauacccagaggucaggugcgugugucgggacaauuggaagggaucgaaccgcccgaucuuguauaucaauauggcagauuacucuauugaauccucauacgugugcaguggccuggucggugacacuccccgaaacgaugacagcuccucuagcucaaauuguagagacccuaacaaugagaggggagccccagggguuaagggcugggcuuucgaugacggcaacgauguguggauggggcggacaaucaaaaauggaagucguuccgguuaugaaaccuuucgcguagugaacggcuggacuauggccaauagcaagucucagauuaacagacaggucauaguggacucagaugacuggaguggguacagcggaaucuucuccguugagggcaaaaagugcauuaauagguguuuuuauguggagcuaauccggggucgaccccaagaaccucgcgucugguggacaucuaacucgaucauuguguucugcgggaccagcggcacguacggaaccggcuccuggccagauggggcaaauauaaacuuuaugcccaucuga

SEQ ID NO: 145598 - RNA, 1401 nt, Artificial Sequence
  derived and/or modified sequence opt3 from neuraminidase__InfluenzaA__AGQ81803
augaaccccaaucagaagaucauugccauaggcagcgugucccugaucauugcuaucauuugccuccuuaugcaaaucgcaauacugaccacaacuaugacguugcacuucagacagaacgaguguucuaauccuucaaacaaucaggucaugccaugcgaaccgaucauuaucgagaggaacaccguucauuuaaauaguacaacuauugaacgggagaucugucccaaaguggccgaauacaagaacuggagcaaaccucagugccaaauaaccggguuugcgccauucuccaaggacaauucuauucgccugucggcuucaggagauaucuggguaacacgagagcccuaugugagcuguagucuagacaaaugcuaccaguuugcccucggucagggcaccacucugaagaacgagcacuccaaugggacaacccaugaucguacgccucacagaacucuucugaugaacgaauugggagucccauuccaucucggcaccaaacagguguguauugcauggucuagcuccucaugcuaugacgguaaagccuggcugcacaucuguguuacaggggaugacaagaaugcuacugcaaguaucauuuacgauggaaugcugguggacagcauaggcucuugguccaaaaacauccucaggacccaagagucagaaugcgucuguauuaauggcacaugcgccgugguaaugaccgaugggagcgcuaguggaaaggccgacacgcggguuuuauuuauccgcgaggguaaaauaauuaacaucucuccccuguccggcagcgcgcagcacguggaggaaugcucguguuauccuagauacccagaggucaggugcgugugucgggauaacuggaaggggucuaaucgcccgauccuuuauauuaacauggcagacuacuccaucgaaucaaguuacgugugcagcggauuggucggcgauacuccccgaaaugacgacuccucuagcucaaguaacuguagagauccuaauaacgagaggggugccccagggguuaagggaugggcuuucgacgauggcaaugacguguggaugggccggacaauuaaaaacgggucccguagcggauaugaaaccuuucgcguagugaaugguuggauaauggccaacucuaagucacagaucaauagacaggucauuguggauagugacgauuggagcggcuacuccgggaucuucucuguugagggaaagaagugcaucaacagguguuuuuauguggagcugauucggggccgaccccaagaaccucgcgucugguggacuucgaauagcauaaucguguucugcgguacauccgggaccuacggcacgggaucauggccagacggcgcaaacauuaauuuuaugcccaucuga

SEQ ID NO: 145599 - RNA, 1410 nt, Artificial Sequence
  derived and/or modified sequence opt3 from neuraminidase__InfluenzaA__AGQ81804
augaaccccaaucagaagaugaucgccauuggcgcugugagccugaccauagcaaucauuugccuccuuaugcaaacagccauccuggucacuacgaugaccuugcacuucaaacauaacgaguguacaaauuccucuaacaaucaggcggcuccuugcgggccaauuaucauagaaagaaacguuacugaggugguacacuuaaauucaaccacacuggaaaaggagaucuguccgaaagccgcaggauacaggaacuggaguaagccccagugccagauuaccgguuuugccccuuucagcaaagacaauuccauccggcuaucugcuggcggggauauuugggugacucgcgaaccauaugucucguguggacucggcaagugcuaccaauuugcacugggucaggggacaacccuugacaacucacauagcaauggaacgagucacgaucgaacuccccaucguacccuguugaugaacgagcucggcgugccuuuccaccugaugacaaagcagguuuguaucgccugguccucuagcuccugccacgacggcaaggcuuggcugcaugugugugucacuggggaugacagaaaugccaccgcgucaauaauuuauggagguauccucguggauaguauuggcagcuggucuaaaaacaucuuaaggacacaggaguccgaaugcguauguaucaaugggaccugcgcaguugugaugacggacggaucagccagcggcaaagcugauacucggauucuguuuauacgcgaggguaagaucguccacauuaguccacuuucuggguccgcccaacauguggaagagugcagcuguuacccccaguauccugaggugagaugcgucuguagggacaacuggcggggaucgaaccgcccaguuuuguacaucaauauggcagauuauucuauagacuccggcuacgugugcucaggccugguaggggauacaccgcgaaacgacgacgugaguagcuccucuaauuguaaagaucccaacaaugaaagaggagcuccuggugucaagggcugggccuucgacaacgggaaugauauuuggaugggaaggaccaucgacaaggauagccggucaggcuacgagacuuuucgugugaucgacgguuggaacacagcgaauaguaaaucccagaccagccgccagguuauuguggggucugauaacucaaguggcuauagcggaaucuucuccgucgaaggcaagucuugcauuaauagauguuuuuacguggagcuaauaagggggcggccaaaagaaacgcgaguaugguggaccucgaacagcaucauuguuuucugcggaacauccgguacuuauggcaccgggucauggcccgacggagccaauaucaacuuuaugccuaucuga

SEQ ID NO: 145600 - RNA, 1401 nt, Artificial Sequence
  derived and/or modified sequence opt3 from neuraminidase__InfluenzaA__AGQ81805
augaaccccaaucagaagaucauugccauaggcagcgugucccugaucauugcuaucauuugccuccuuaugcaaaucgcacuguugaccacaacuaugacguuacacuucagacagaacgaguguucuaauccuucaaacaaucaggucaugccaugcgaaccgauaaucauugagaggaacaccguucaucugaauaguacaacuaucgaacgggagauuugucccaaaguggccgaauacaagaacuggagcaaaccucagugccaaaucaccggguuugcgccauucuccaaggacaauucuauacgccuaucggcuggaggugauauuuggguaacacgagagcccuaugugucauguagccucgacaaaugcuaccaguuugcccugggccaggggaccacuaugaagaacaagcacaguaauggaacaacccaugaucguacgccucacagaacucuucugaugaacgaguugggcgucccauuccaucucgguaccaaacagguguguaucgcaugguccucuagcuccugcuaugacgggaaggccuggcugcacauuuguguuacaggagaugacaaaaaugcuacugcaucaaucaucuacgauggcaugcugguggacaguauuggcagcuggucuaagaacauacucaggacccaagaauccgagugcgucuguaucaaugggacaugcgccgugguaaugaccgauggaucagcuagcgguaaagccgacacgcggguuuuauuuauucgcgaaggcaagaucauaaacauuaguccccugucuggguccgcgcagcacguggaggagugcagcuguuauccuagauacccagaagucaggugcgugugucgggauaacuggaagggaucgaaucgcccgauccuuuauaucaacauggcagacuacucuauugaguccucauacgugugcaguggcuuggucggugauacuccccgaaaugacgacagcuccucuagcucaaacuguagagggccuaauaacgaaaggggagccccaggcguuaaaggcugggcuuucgaugacgggaaugauguguggaugggacggacaaucaagaacgguagucguuccggcuaugagaccuuucgcguagugaauggguggacuauggccaacagcaaaucucagauuaauagacaggucauaguggacucagaugacuggaguggauacagcggcaucuucuccguugaagguaagaaaugcauuaacagguguuuuuauguggagcugauccgggggcgaccccaagagccucgcgucugguggacaucuaauucgaucauuguguucugcggcaccagcggaacguacggcaccggguccuggccagauggagcaaacauaaauuuuaugcccaucuga

SEQ ID NO: 145601 - RNA, 1401 nt, Artificial Sequence
  derived and/or modified sequence opt3 from neuraminidase__InfluenzaA__AGQ81807
augaaccccaaucagaagaucaccgccauuggcagcauaucccugaucauugcuaucauuugccuccuuaugcaaaucgcaauacugacaacuacgaugaccuugcacuucagacagaacgaguguaggaauccuucuaacaaucaggugaugccaugcgaaccggucaucauugagcggaacacaguucauuuaaauucaacuaccaucgaacgcgagauuugucccaaaguggccgaauacaagaacuggaguaaaccucagugccaaaucacaggguuugcgccauucagcaaggacaauuccauacgacugucugcuucgggagauauuuggguaacccgugagcccuaugugucauguagccuaaacaaaugcuaccaguuugcccucggucagggcacuacacugaagaauaagcacaguaacgggaccacgcaugacagaacuccucacaggacccuucugaugaaugaguugggagucccauuccaucucggcacaaaacagguguguaucgcaugguccucuagcuccugcuaugaugguaaggccuggcugcacauuuguguuacuggggacgauaaaaacgcuaccgcaucaaucaucuacgacggaaugcugguggauaguauuggcagcuggucuaagaauauacuccggacacaagaauccgagugcgucuguaucaacggaaccugcgccgugguaaugacggacgggucagcuagcggaaaagccgauacucgcguuuuauuuauuaaggaagguaagaucauaaacauuaguccccugucuggcuccgcgcagcacguggaggagugcagcuguuauccuagauacccagaagucaggugcgugugucgggacaauuggaaagggucgaaccgcccgauccuuuauaucaauauggcagauuacucuauugaguccucauacgugugcaguggauuggucggcgacacaccccgaaacgaugacagcuccucuagcucaaauuguagagacccuaacaaugaaaggggugccccagggguuaagggaugggcuuucgaugacggcaacgauguguggaugggccggaccaucaaaaaugggagucguuccggauaugagacuuuucgcguagugaacgguuggauuauggccaauagcaagucucagauaaacagacaggucaucguggacucagaugacuggaguggcuacagcgggauuuucuccguugaaggcaaaaagugcaucaauagguguuuuuauguggagcugauccggggccgaccccaagagccucgcgucugguggacaucuaacucgauuauaguguucugcgguaccagcgggacguacggcaccggauccuggccagauggcgcaaauaucaacuuuaugcccauuuga

SEQ ID NO: 145602 - RNA, 1401 nt, Artificial Sequence
  derived and/or modified sequence opt3 from neuraminidase__InfluenzaA__AGQ81808
augaaccccaaucagaagaucauugccauaggcagcgugucccugaccaucgcuauuaucugcuuccucaugcaaauugcaauccuuacaacuacgaugacccugcacuuuaaacagaacgaguguucuaauccuucaaacaaucaggucguuccaugcgaaccgauauugaucgagagaaacacagugcauuuaaauaguacuaccauugaaaaggagguaugucccaaaguggccgaauacaagaacuggagcaaaccucagugccaaaucacaggguucgcgccauuuuccaaggacaauucuauuaggcugucggcuggaggugauaucugggucacccgggagcccuaugugucauguagccuaggcaagugcuaccaguucgcccucgggcagggaacuacacugaaaaacaaucacaguaacggcaccacgcaugaccgcacuccucaccgaacccuucugaugaaugaguuggguguuccauuucaucucgggacaaagcagguuuguauagcaugguccucuagcuccugcuaugauggaaaagccuggcugcacauuugugucacuggcgacgauaagaacgcuaccgcaucaaucauuuacgacggcaugcugguggauaguaucgggagcuggucuaaaaauauccuccguacacaagaauccgagugcguauguauuaacggaaccugcgccguugugaugacggacgguucagcuagcggcaaggccgauacuagaauauuauucaucagggaagggaagauuaucaacauaaguccccugucuggauccgcgcagcacgucgaggagugcagcuguuauccucgguacccagaagugcgcugcguguguagagacaauuggaaaggcucgaacaggccgguccuuuauauuaauauggcagauuacucuguugaguccucauacgugugcagugguuugguaggggacacaccccggaacgaugacagcuccucuagcucaaauugucgcgacccuaacaaugaacgaggagccccaggcgugaagggcugggcuuuugaugacgggaacgaugucuggaugggaagaaccaucaggaauaacagucgguccgguuaugagacuuuccgugugguuaauggcuggacaaccgccaacagcaaaucucagaucaaucgccagauuaucguggacucagaaaacuggaguggguacagcggaauauuuuccgucgagggcaagaauugcauuaacagauguuucuauguggagcugaucaggggucggccccaagaaccucgaguaugguggacgucuaacucgauuaucguguuuugcgggaccagcggcacauacggaacuggcuccuggccagauggggcaaauaucaacuucaugcccauuuga

SEQ ID NO: 145603 - RNA, 1401 nt, Artificial Sequence
  derived and/or modified sequence opt3 from neuraminidase__InfluenzaA__AGQ81809
augaaccccaaucagaagaucaccgccauuggcagcgugucccugauaaucgcuauuaucugccuccuuaugcaaauugcaauccugacaacuacgaugaccuugcacuucagacagaacgaguguucuaauccuucaaacaaucaggucaugccaugcgaaccgauaaucauugagaggaacacaguucauuuaaauaguacuaccaucgaacgggagauuugucccaaaguggccgaauacaagaacuggagcaaaccucagugccaaaucacaggguuugcgccauucuccaaggacaauucuauacgccugucggcuggaggugauauuuggguaacccgagagcccuaugugucauguagcccugacaaaugcuaccaguuugcccuaggccaggggacuacacucaagaacaagcacaguaauggaaccacgcaugaucguacuccacacagaacccugcuuaugaacgagcugggcguccccuuccauuuggguacaaaacagguguguaucgcaugguccucuagcuccugcuaugacgggaaggccuggcuccacauuuguguuacuggagaugacaaaaaugcuaccgcaucaaucaucuacgauggcaugcugguggacaguauuggcagcuggucuaagaacauacugaggacacaagaauccgagugcgucuguaucaaugggaccugcgccgugguaaugacggauggaucagcuagcggugaagccgacacucggauucucuuuauccgcgagggcaaaauaauuaacaucaguccuuuaucuggguccgcgcagcacguugaggaaugcagcuguuauccaagauacccggaggugaggugcgucugucgggauaacuggaagggaucgaaucgccccaucauuuauaucaacaugguggacuacucuauuggcucccgauacgugugcucaggucuggucggggauacaccuagaaaugacgacaguaccagcuccucuaacuguagggauccaaauaacgaacggggagcacccggcguuaagggcugggccuucgacgaugggaaugacguguggaugggacguacuaucaaaaacgguagccgcucaggcuaugagacauuuagaguaauaaauggguggaccauggcuaacaguaagucccagauuaauaggcaagugaucgucgauagcgacaacuggucuggauacucaggcaucuucaguguggaagguaaaaagugcauuaaucgguguuuuuauguugagcuuauacgagggcgcccucaggagccaagagugugguggacgagcaacuccaucauugucuucugcggcaccucuggaacauacggcacugggucguggcccgauggagccgacaucaauuuuaugccgauuuga

SEQ ID NO: 145604 - RNA, 1401 nt, Artificial Sequence
  derived and/or modified sequence opt3 from neuraminidase__InfluenzaA__AGQ81810
augaaccccaaucagaagauccuggccauuggcagcgugucccucaccauagcuaucauuugcuuccuuaugcaaaucgcaauucugacaacuacgaugaccuugcacuuuaaacagaacgaguguucuaauccuucaaacaaucaggucguuccaugcgaaccgaucuuaauagagagaaacacagugcaucugaauaguacuaccaucgaaaaggagguaugucccaaaguggccgaauacaagaacuggagcaaaccucagugccaaauuacaggguucgcgccauuuuccaaggacaauucuaucaggcuaucggcuggaggugauauuugggucacccgggagcccuaugugucauguagccucggcaagugcuaccaguucgcccuggggcagggaacuacacuuaaaaacaaucacaguaacggcaccacgcaugaccgcacuccucaccgaacccuguugaugaaugagcucgguguuccauuucaucuggggacaaagcagguuuguaucgcaugguccucuagcuccugcuaugauggaaaagccuggcugcacauaugugucacuggcgacgauaagaacgcuaccgcaucaauuaucuacgacggcaugcucguggauaguauugggagcuggucuaaaaauaucuuacguacacaagaauccgagugcguauguaucaacggaaccugcgccguugugaugacggacgguucagcuagcggcaaggccgauacuaggauucuguucauaagagaagggaagaucauuaacaucaguccccuuucuggauccgcgcagcacgucgaggagugcagcuguuauccucgguacccagaagugcgcugcguguguagagacaauuggaaaggcucgaacaggccggucuuguauauaaauauggcagauuacucuauugaguccucauacguuugcaguggucuggugggggacacaccccggaacgaugacagcuccucuagcucaaauugucgcgacccuaacaaugaacgaggagccccaggcguaaagggcugggcuuuugaugacgggaacgauguguggaugggaagaaccaucaggaauaacagucgguccgguuaugagacuuuccgugucgugaauggcuggacaaccgccaacagcaaaucucagaucaaucgccagguuauuguggacucagaaaacuggaguggguacagcggaaucuuuuccgucgagggcaagaauugcauuaacagauguuucuauguggagcuaauaaggggucggccccaagaaccucgaguaugguggacgucuaacucgaucauuguguuuugcgggaccagcggcacauacggaacuggcuccuggccagauggggcaaauaucaacuucaugcccaucuga

SEQ ID NO: 145605 - RNA, 1401 nt, Artificial Sequence
  derived and/or modified sequence opt3 from neuraminidase__InfluenzaA__AGQ81811
augaaccccaaucagaagaucauugccauaggcagcgugucccugaccaucgcuauuaucugcuuccucaugcaaauugcaauccuuacaacuacgaugacccugcacuuuaaacagaacgaguguucuaauccuucaaacaaucaggucguuccaugcgaaccgauauugaucgagagaaacacagugcauuuaaauaguacuaccauugaaaaggagguaugucccaaaguggccgaauacaagaacuggagcaaaccucagugccaaaucacaggguucgcgccauuuuccaaggacaauucuauuaggcugucggcuggaggugauaucugggucacccgggagcccuaugugucauguagccuaggcaagugcuaccaguucgcccucgggcagggaacuacacugaaaaacaagcacaguaauggcaccacgcaugaccgcacuccucaccgaacccuucugaugaacgaguuggguguuccauuucaucucgggacaaaacagguguguauagcaugguccucuagcuccugcuaugauggaaaggccuggcugcacauuugugucacuggcgacgauaaaaaugcuaccgcaucaaucauuuacgacggcaugcugguggauaguaucgggagcuggucuaagaacauccuccguacacaagaauccgagugcguauguauuaauggaaccugcgccguugugaugacggacgguucagcuagcggcaaggccgauacuagaauauuauucaucagggaagggaaaauugucaacaucaguccccugucuggauccgcgcagcacguggaggagugcagcuguuauccucgguacccagaagugcgcugcgucuguagagacaacuggaagggcucgaauaggccgguucuuuauauaaacauggcagauuacucuguggaguccucauacguaugcagugguuuggugggggacacaccccggaaugaugacagcuuuuccucuagcaacugucgcgacccuaauaacgaacgaggagccccaggcgucaaaggcugggcuuucgaugacgggaaugauguguggaugggaagaaccauuaggaacgacucacggagugguuaugagacuuuucguguugugaauggcuggacaaccgccaacuccaagagccagaucaaucgccaggucaucguggauucugaaucauggaguggguacagcggaauuuucuccguagagggcaaaaacugcaucaauagauguuuuuauguugagcugauuaggggucggccccaagaaccucgagugugguggacgucuaacucgauaaucgucuucugcgggaccagcggcacauacggaacuggcuccuggccagacggggcaaauauuaacuuuaugcccaucuga

SEQ ID NO: 145606 - RNA, 1410 nt, Artificial Sequence
  derived and/or modified sequence opt3 from neuraminidase__InfluenzaA__AGQ81812
augaaccccaaucagaagaucauuaccauaggcagcgugucccugacaaucgccacuauuugcuuccucaugcaaaucgcuauucuugucacgaccaucacacugcacuuuaaacagaacgaguguucuauaccuucaaauaaccagguugugccaugcgaaccgaucauuguagagagaaauaucacugaaauuguguacuugaacaauaccacaaucgagaaggaauuaugucccaaacugaccgaguauagggacuggaguaagccucagugccaaauaacuggguucgcaccauuuagcaaagauaacuccauucggcuaucugccggaggugacaucugggucacacgcgagcccuacgugucguguucaccuaauaagugcuaucaguucgcgcucggccaggggaccacgcuggauaacaagcauagcaauggaacuauucacgaccgaaucccacaucguacccuucugaugaacgaauugggcguucccuuucaccucgguacaaaacagguguguaucgcuuggaguuccucuagcugccaugaugggaaggccuggcugcacgucugugugacuggagacgauagaaaugcaaccgccuccuucauuuacgacggcaugcugguagauucaauaggcaguuggagccaaaacauccucaggacacaggagucugaaugcguuuguauuaaugggaccugcacgguggucaugacugacggauccgcuucaggucgggcagauacacgcaucuuauuuauaaaagagggcaagauugugcacgugagcccucugagugggucugcccagcauaucgaggaaugcuccuguuauccaagauacccggacgucaggugcguuugucgggauaacuggaaaggaagcaaccgccccaucauugacaucaauguggcugacuauucgauugauucuuccuacguaugcucaggccuugugggugacaccccucgaaacgaugacaguagcuccaauucuaacuguaaggauccaaauaacgagagagggaaucccggagucaagggcugggccuucgacuacggcaacgauguguggauggggaggacuauaagcaaagacucacggaguggauaugaaacauuucguguuaucgguggcuggaccacggcaaauuccaagagccaggugaaccgccaagucauuguggauaauaacaauuggucuggguacucaggaaucuucaguguagagggcaaaagcugcaucaacagauguuuuuauguugaauugauuaggggucggccucaggagacccgagugugguggacauccaauucuauagucguguucugcgggacuucgggcaccuacggaacaggcagcuggccagacggggcgaacaucaacuuuaugcccauuuga

SEQ ID NO: 145607 - RNA, 1401 nt, Artificial Sequence
  derived and/or modified sequence opt3 from neuraminidase__InfluenzaA__AGQ81814
augaaccccaaucagaagaucauugccauaggcagcgugucccugaccaucgcuauuaugugcuuccucaugcaaaucgcaauucuuacaacuacgaugacccugcacuuuaaacagaacgaguguucuaauccuucaaacaaucaggucguuccaugcgaaccgaucuugauagagagaaacacagugcauuuaaauaguacuaccaucgaaaaggagguaugucccaaaguggccgaauacaagaacuggagcaaaccucagugccaaauuacaggguucgcgccauuuuccaaggacaauucuaucaggcugucggcuggaggugauauuugggucacccgggagcccuaugugucauguagccuaggcaagugcuaccaguucgcccucgggcagggaacuacacugaaaaacaaucacaguaacggcaccacgcaugaccgcacuccucaccgaacccuucugaugaaugaguuggguguuccauuucaucucgggacaaaacagguguguaucgcaugguccucuagcuccugcuaugauggaaaggccuggcugcacauaugugucacuggcgacgauaagaacgcuaccgcaucaauuaucuacgacggcaugcugguggauaguauugggagcuggucuaaaaauauccuccguacacaagaauccgagugcguauguaucaacggaaccugcgccguugugaugacggacgguucagcuagcggcaaggccgauacuagaauuuuauucauaagggaagggaagaucauuaacaucaguccccugucuggauccgcgcagcacgucgaggagugcagcuguuauccucgguacccagaagugcgcugcguguguagagacaauuggaaaggcucgaacaggccgguccuuuauauaaauauggcagauuacucuguugaguccucauacgugugcagugguuugguaggggacacaccccggaacgaugacagcuccucuagcucaaauugucgcgacccuaacaaugaacgaggagccccaggcgugaagggcugggcuuuugaugacgggaacgaugucuggaugggaagaaccauuaggaauaacagucgguccgguuaugagacuuuccgugugguuaauggcuggacaaccgccaacagcaaaucucagaucaaucgccaggugaucgucgacucagaaaacuggaguggguacagcggaaucuuuuccguggagggcaagaauugcauuaacagauguuucuauguagagcugauuaggggucggccccaagaaccucgaguuugguggacgucuaacucgauaaucguguuuugcgggaccagcggcacauacggaacuggcuccuggccagauggggcaaauauuaacuucaugcccaucuga

SEQ ID NO: 145608 - RNA, 1401 nt, Artificial Sequence
  derived and/or modified sequence opt3 from neuraminidase__InfluenzaA__AGQ81815
augaaccccaaucagaagaucauugccauaggcagcguuucccugaccaucgcuauuaucugcuuccucaugcaaauugcaauccuuacaacuacgaugacccugcacuuuaaacagaacgaguguucuaauccuucaaacaaucaggucguuccaugcgaaccgauauugaucgagagaaacacagugcauuuaaauaguacuaccauugaaaaggagguaugucccaaaguggccgaauacaagaacuggagcaaaccucagugccaaaucacaggguucgcgccauuuuccaaggacaauucuauuaggcugucggcuggaggugauaucugggucacccgggagcccuaugugucauguagccuaggcaagugcuaccaguucgcccucgggcagggaacuacacugaaaaacaagcacaguaauggcaccacgcaugaccgcacuccucaccgaacccuucugaugaacgaguuggguguuccauuucaucucgggacaaaacagguguguauagcaugguccucuagcuccugcuaugauggaaaggccuggcugcacauuugugucacuggcgacgauaaaaaugcuaccgcaucaaucauuuacgacggcaugcugguggauaguaucgggagcuggucuaagaacauccuccguacacaagaauccgagugcguauguauuaauggaaccugcgccguugugaugacggacgguucagcuagcggcaaggccgauacuagaauauuauucaucagggaagggaaaauuaucaacauaaguccccugucuggauccgcgcagcacgucgaggagugcagcuguuauccucgguacccagaagugcgcugcguguguagagacaacuggaagggcucgaauaggccgguccuuuauauuaacauggcagauuacucuguugaguccucauacgugugcagugguuugguaggggacacaccccggaaugaugacagcuccucuagcucaaacugucgcgacccuaauaacgaacgaggaaccccaggcgugaaaggcugggccuuugaugacgggaaugaugucuggaugggaagaacuaucaggaacgacagucgguccgguuaugagacauuccgugugaucaauggcuggaccacggcuaacagcaagucucagauuaaucgccagguuaucguggauucagaaaacuggaguggguacagcggaauauuuuccgucgagggcaaaaauugcauuaacagauguuucuauguggagcugaucaggggucggccccaagaaccucgaguaugguggaccucuaauucgauuaucguguuuugcgggacaagcggcacuuacggaaccggcuccuggccagacggggccaacaucaacuauaugcccauuuga

SEQ ID NO: 145609 - RNA, 1401 nt, Artificial Sequence
  derived and/or modified sequence opt3 from neuraminidase__InfluenzaA__AGQ81816
augaaccccaaucagaagaucauugccauaggcagcguuucccugaccaucgcuauuaucugcuuccucaugcaaauugcaauccuuacaacuacgaugacccugcacuuuaaacagaacggguguucuaauccuucaaacaaucaggucguuccaugcgagccgauauugaucgaaagaaacacagugcauuuaaauaguacuaccauugagaaggaaguaugucccaaaguggccgaguacaagaacuggagcaaaccucagugccaaaucacaggauucgcgccauuuuccaaggacaauucuauuaggcugucggcugguggcgauaucugggucacccgggaacccuaugugucauguagccuagggaagugcuaccaguucgcccucggacagggcacuacacugaaaaacaagcacaguaaugguaccacgcaugaccgcacuccucaccgaacccuucugaugaacgaguuggggguuccauuucaucucggaacaaaacagguguguauagcaugguccucuagcuccugcuaugauggcaaggccuggcugcacauuugugucacuggcgacgauaaaaaugcuaccgcaucaaucauuuacgacgggaugcugguggauaguaucggaagcuggucuaagaacauccuccguacacaagaguccgaaugcguauguauuaaugguaccugcgccguugugaugacggacggcucagcuagcgggaaggccgauacuagaauauuauucaucagggagggaaaaauuaucaacauaaguccccugucuggcuccgcgcagcacgucgaagagugcagcuguuauccucgguacccagaggugcgcugcguguguagagacaacuggaaggguucgaauaggccgguccuuuauauuaacauggcagauuacucuguugaauccucauacgugugcaguggguugguaggagacacaccccggaaugaugacagcuccucuagcucaaacugucgcgacccuaauaacgagcgaggcaccccaggcgugaaagggugggccuuugaugacggaaaugaugucuggauggguagaacuaucaggaacgacagucgguccggcuaugaaacauuccgugugaucaauggguggaccacggcuaacagcaagucucagauuaaucgccagguuaucguggauucagagaacuggaguggauacagcggcauauuuuccgucgaagguaaaaauugcauuaacagauguuucuauguggagcugaucagggggcggccccaagagccucgaguaugguggaccucuaauucgauuaucguguuuugcggcacaagcggaacuuacggcaccggguccuggccagacggagccaacaucaacuauaugcccauuuga

SEQ ID NO: 145610 - RNA, 1401 nt, Artificial Sequence; identical to SEQ ID NO: 145608
  derived and/or modified sequence opt3 from neuraminidase__InfluenzaA__AGQ81817

SEQ ID NO: 145611 - RNA, 1401 nt, Artificial Sequence; identical to SEQ ID NO: 145608
  derived and/or modified sequence opt3 from neuraminidase__InfluenzaA__AGQ81818

SEQ ID NO: 145612 - RNA, 1401 nt, Artificial Sequence; identical to SEQ ID NO: 145608
  derived and/or modified sequence opt3 from neuraminidase__InfluenzaA__AGQ81819

SEQ ID NO: 145613 - RNA, 1401 nt, Artificial Sequence
  derived and/or modified sequence opt3 from neuraminidase__InfluenzaA__AGQ81820
augaaccccaaucagaagaucauugccauaggcagcgugucccugaccaucgcuauuaucugcuuccucaugcaaauugcaauccuuacaacuacgaugacccugcacuuuaaacagaacgaguguucuaauccuucaaacaaucaggucguuccaugcgaaccgauauugaucgagagaaacacagugcauuuaaauaguacuaccauugaaaaggagguaugucccaaaguggccgaauacaagaacuggagcaaaccucagugccaaaucacaggguucgcgccauuuuccaaggacaauucuauuaggcugucggcuggaggugauaucugggucacccgggagcccuaugugucauguagccuaggcaagugcuaccaguucgcccucgggcagggaacuacacugaaaaacaagcacaguaauggcaccacgcaugaccgcacuccucaccgaacccuucugaugaacgaguuggguguuccauuucaucucgggacaaaacagguguguauagcaugguccucuagcuccugcuaugauggaaaggccuggcugcacauuugugucacuggcgacgauaaaaaugcuaccgcaucaaucauuuacgacggcaugcugguggauaguaucgggagcuggucuaagaacauccuccguacacaagaauccgagugcguauguauuaauggaaccugcgccguugugaugacggacgguucagcuagcggcaaggccgauacuagaauauuauucaucagggaagggaaaauuaucaacauaaguccccugucuggauccgcgcagcacgucgaggagugcagcuguuauccucgguacccagaagugcgcugcguguguagagacaacuggaagggcucgaauaggccgguccuuuauauuaacauggcagauuacucuaucgaguccucauacguuugcagugguuuggugggggacacaccccggaaugaugacagcuccucuagcucaaacugucgcgacccuaauaacgaacgaggaaccccaggcguaaaaggcugggccuuugaugacgggaaugauguguggaugggaagaacuaucaggaacgacagucgguccgguuaugagacauuccgugucauuaauggcuggaccacggcuaacagcaagucucagaucaaucgccaggugauuguugauucagaaaacuggaguggguacagcggaauauuuuccguggagggcaaaaauugcaucaacagauguuucuaugucgagcugauuaggggucggccccaagaaccuaaggugugguggaccucuaauucgaucaucguauuuugcgggacaagcggcacuuacggaaccggcuccuggccagacggggccaacauuaacuucaugcccauauga

SEQ ID NO: 145614 - RNA, 1401 nt, Artificial Sequence
  derived and/or modified sequence opt3 from neuraminidase__InfluenzaA__AGQ81822
augaaccccaaucagaagaucauugccauaggcagcgugucccugaccaucgcuauuaucugcuuccucaugcaaauugcaauccuuacaacuacgaugacccugcacuuuaaacagaacgaguguucuaauccuucaaacaaucaggucguuccaugcgaaccgauauugaucgagagaaacacagugcauuuaaauaguacuaccauugaaaagaaaguaugucccaagguggccgaguacaaaaacuggagcaagccucagugccaaaucacaggguucgcgccauuuuccaaggacaauucuauuaggcugucggcuggaggugauaucugggucacccgggaacccuaugugucauguagccuaggcaaaugcuaccaguucgcccucgggcagggaacuacacugaagaacaaacacaguaauggcaccacgcaugaccgcacuccucaccgaacccuucugaugaacgaguuggguguuccauuucaucucgggacaaagcagguuuguauagcaugguccucuagcuccugcuaugauggaaaagccuggcugcacauuugugucacuggcgacgauaagaaugcuaccgcaucaaucauuuacgacggcaugcugguggauaguaucgggagcuggucuaagaacauccuccguacacaagaguccgaaugcguauguauuaauggaaccugcgccguugugaugacggacgguucagcuagcggcaaagccgauacuagaauauuauucaucagggaggggaagauuaucaacauaaguccccugucuggauccgcgcagcacgucgaagagugcagcuguuauccucgguacccagaggugcgcugcguguguagagacaacuggaaaggcucgaauaggccgguccuuuauauuaacauggcagauuacucuguugaauccucauacgugugcagugguuugguaggggacacaccccggaaugaugacagcuccucuagcucaaacugucgcgacccuaauaacgagcgaggaaccccaggcgugaagggcugggccuuugaugacgggaaugaugucuggaugggaagaacuaucaggaacgacagucgguccgguuaugaaacauuccgugugaucaauggcuggaccacggcuaacagcaaaucucagauuaaucgccagguuaucguggauucagagaacuggaguggguacagcggaauauuuuccgucgaaggcaagaauugcauuaacagauguuucuauguggagcugaucaggggucggccccaagagccucgaguaugguggaccucuaauucgauuaucguguuuugcgggacaagcggcacuuacggaaccggcuccuggccagacggggccaacaucaacuauaugcccauuuga

SEQ ID NO: 145615 - RNA, 1401 nt, Artificial Sequence
  derived and/or modified sequence opt3 from neuraminidase__InfluenzaA__AGQ81823
augaaccccaaucagaagaucauugccauaggcagcgugucccugaccaucgcuauuaucugcuuccucaugcaaauugcaauccuuacaacuacgaugacccugcacuuuaaacagaacgaguguucuaauccuucaaacaaucaggucguuccaugcgaaccgauauugaucgagagaaacacagugcauuuaaauaguacuaccauugaaaaggagguaugucccaaaguggccgaauacaagaacuggagcaaaccucagugccaaaucacaggguucgcgccauuuuccaaggacaauucuauuaggcugucggcuggaggugauaucugggucacccgggagcccuaugugucauguagccuaggcaagugcuaccaguucgcccucgggcagggaacuacacugaaaaacaagcacaguaauggcaccacgcaugaccgcacuccucaccgaacccuucugaugaacgaguuggguguuccauuucaucucgggacaaaacagguguguauagcaugguccucuagcuccugcuaugauggaaaggccuggcugcacauuugugucacuggcgacgauaaaaaugcuaccgcaucaaucauuuacgacggcaugcugguggauaguaucgggagcuggucuaagaacauccuccguacacaagaauccgagugcguauguauuaauggaaccugcgccguugugaugacggacgguucagcuagcggcaaggccgauacuagaauauuauucaucagggaagggaaaauuaucaacauaaguccccugucuggauccgcgcagcacgucgaggagugcagcuguuauccucgguacccagaagugcgcugcguguguagagacaacuggaagggcucgaauaggccgguccuuuauauuaacauggcagauuacucuguugaguccucauacgugugcagugguuugguaggggacacaccccggaaugaugacagcuccucuagcucaaacugucgcgacccuaauaacgaacgaggagccccaggcgugaaaggcugggcuuuugaugacgggaaugaugucuggaugggaagaaccaucaggaacgacagucgguccgguuaugagacuuuccgugugguuaauggcuggacaaccgccaacagcaagucucagaucaaucgccaggugauugucgauucagaaaacuggaguggguacagcggaaucuuuuccguggagggcaaaaauugcauuaacagauguuucuauguagagcugauaaggggucggccccaagaaccucgaguuugguggacgucuaauucgaucauuguguuuugcgggaccagcggcacauacggaacuggcuccuggccagacggggcaaacaucaacuucaugcccaucuga

SEQ ID NO: 145616 - RNA, 1401 nt, Artificial Sequence; identical to SEQ ID NO: 145615
  derived and/or modified sequence opt3 from neuraminidase__InfluenzaA__AGQ81824

SEQ ID NO: 145617 - RNA, 1401 nt, Artificial Sequence; identical to SEQ ID NO: 145615
  derived and/or modified sequence opt3 from neuraminidase__InfluenzaA__AGQ81825

SEQ ID NO: 145618 - RNA, 1401 nt, Artificial Sequence
  derived and/or modified sequence opt3 from neuraminidase__InfluenzaA__AGQ81831
augaaccccaaucagaagauccuggccauuggcagcgugucccucaccauagcuaucauuugcuuccuuaugcaaaucgcaauucugacaacuacgaugaccuugcacuuuaaacagaacgaguguucuaauccuucaaacaaucaggucguuccaugcgaaccgaucuuaauagagagaaacacagugcaucugaauaguacuaccaucgaaaaggagguaugucccaaaguggccgaauacaagaacuggagcaaaccucagugccaaauuacaggguucgcgccauuuuccaaggacaauucuaucaggcuaucggcuggaggugauauuugggucacccgggagcccuaugugucauguagccucggcaagugcuaccaguucgcccuggggcagggaacuacacuuaaaaacaagcacaguaauggcaccacgcaugaccgcacuccucaccgaacccuguugaugaacgagcucgguguuccauuucaucuggggacaaaacagguguguaucgcaugguccucuagcuccugcuaugauggaaaggccuggcugcacauaugugucacuggcgacgauaaaaaugcuaccgcaucaauuaucuacgacggcaugcucguggauaguauugggagcuggucuaagaacaucuuacguacacaagaauccgagugcguauguaucaauggaaccugcgccguugugaugacggacgguucagcuagcggcaaggccgauacuaggauucuguucauaagagaagggaaaaucgucaacauuaguccccuuucuggauccgcgcagcacguggaggagugcagcuguuauccucgguacccagaagugcgcugcgucuguagagacaacuggaagggcucgaauaggccgguuuuguauaucaacauggcagauuacucuguggaguccucauacguaugcaguggucuggugggggacacaccccggaaugaugacagcuuuuccucuagcaacugucgcgacccuaauaacgaacgaggagccccaggcgucaaaggcugggcuuucgaugacgggaaugauguguggaugggaagaaccauaaggaacgacucacggagugguuaugagacuuuucguguugugaauggcuggacaaccgccaacuccaagagccagauuaaucgccaggucaucguggauucugaaucauggaguggguacagcggaaucuucuccguagagggcaaaaacugcauuaauagauguuuuuauguugagcuaaucaggggucggccccaagaaccucgagugugguggacgucuaacucgauuauagucuucugcgggaccagcggcacauacggaacuggcuccuggccagacggggcaaauaucaacuuuaugcccauuuga

SEQ ID NO: 145619 - RNA, 1401 nt, Artificial Sequence; identical to SEQ ID NO: 145608
  derived and/or modified sequence opt3 from neuraminidase__InfluenzaA__AGQ81837

SEQ ID NO: 145620 - RNA, 1401 nt, Artificial Sequence; identical to SEQ ID NO: 145608
  derived and/or modified sequence opt3 from neuraminidase__InfluenzaA__AGQ81838

SEQ ID NO: 145621 - RNA, 1401 nt, Artificial Sequence; identical to SEQ ID NO: 145615
  derived and/or modified sequence opt3 from neuraminidase__InfluenzaA__AGQ81839

SEQ ID NO: 145622 - RNA, 1401 nt, Artificial Sequence; identical to SEQ ID NO: 145615
  derived and/or modified sequence opt3 from neuraminidase__InfluenzaA__AGQ81840

SEQ ID NO: 145623 - RNA, 1401 nt, Artificial Sequence; identical to SEQ ID NO: 145608
  derived and/or modified sequence opt3 from neuraminidase__InfluenzaA__AGQ81841

SEQ ID NO: 145624 - RNA, 1410 nt, Artificial Sequence
  derived and/or modified sequence opt3 from neuraminidase__InfluenzaA__AGQ81843
augaaccccaaucagaagaucauuaccauaggcguggucaacacaacucugagcacgaucgcccuccuuauugggaucggaaaucugauuuucaacaccguuauccacgagaaaauaggugugcaucaaacaguaguguacccuacuaucaccccaccggucauucccaauugcuccgacacaaccaucacuuauaacaauacagugguuaacaauauuaccacgacuaucauaaacaaggcugaaaaacaguuuaagccuucuuugccauuaugucccuucagaggcuuuuucccuuuucacaaagauaaugcaauuaggcugggggagaacaaggacgugaucgucacccgggaaccauacgugucaugcgauaaugacgauuguuggaguuucgcccuagcgcagggagcucuccugggcacaaagcauagcaacgguacuauuaaagaccgcacccccuaucgaucccuuauccguuuuccuaucgggacagccccaguacugggaaauuacaaggagauuugcguugcauggucuucgucaagcuguuucgauggcaaagaauggaugcacgugugcaugaccggcaacgacaacgaugccagugggcagauaaucuaugcuggaaagaugacggacuccauuaaaucuuggagaagggauaucuugcggacucaagagagcgagugucagugcauagacgguacauguauugucgcagugaccgauggcccggccgcuuccucagccgaccaucgcaucuacuggaucagagaagggaagauuaucaaguaugaggacauucccaaaacuaagauacagcaccucgaagagugcaguuguuacguggauacagacgucuacugcaucugcagggauaauuggaaaggaagcaaccggccuuggaugcgcauuaauaacgagaccauccuggaaacgggcuauguuuguucuaaguuucacuccgacaccccacgacccgcggauccuucaacagugagcugcgacaguccaucuaauaucaacggugggcccggaguaaaaggcuucggcuuuagagcagggaaugauguguggcugggaaggacugucuccaccacaggucggagcggcuucgaggugauuaagguuacugaaggguggauaaacucgcucaaucaugccaaaucugugacccagacauuagucuccaacaaugacuggucaggauacaguggcagcuuuaucguggagaacaaugguuguuuccaaccgugcuucuauauugaacugauccgugggcgcccuaacagaaaugaugacguauccuggaccucuaacagcauuguuacuuuuuguggccuugauaacgagcccggaucaggcaauuggccagacgggaguaacaucggauucaugccuaaguga

SEQ ID NO: 145625 - RNA, 1410 nt, Artificial Sequence
  derived and/or modified sequence opt3 from neuraminidase__InfluenzaA__AGQ81845
augaaccccaaucagaagaucauuaccauaggcguggucaacacaacucugagcacgaucgcccuccuuauugggaucggaaaucugauuuucaacaccguuauccacgagaaaauaggugugcaucaaacaguaaucuacccuacuauuaccuccccaguggucccgaauugcucugacacaaccaucacuuauaacaauacagugguuaacaauauuaccacgacugugaucaacaaggcugaaaaacacuuuaagcccucauugccuuuauguccauucaaaggcuuuuuccccuuucauaaggauaaugcaauaagacugggggagaacaaggacgucauugugaccagggaaccuuacguaaguugcgauaaugacgauuguuggagcuucgcccuagcgcagggagcucuccugggcacaaaacacuccaacgguacuaucaaggaccggaccccauaucgcucucuuauucgauuucccaucgggacagccccuguucugggaaauuacaaagagaucugcguggcauggucgucaagcaguuguuucgauggcaaggaauggaugcaugucugcaugaccggcaacgacaacgaugccuccgggcagauuauauaugcuggaaaaaugacggacucuaucaagagcuggcguagagauauuuugaggacucaggaguccgagugucaaugcaucgacgguacauguauaguggcagugaccgauggcccagccgcuaauucagccgaccaccggauuuacuggauccgcgaagggaagaucauuaaauaugagaacaucccgaagacuaaaauucagcaccucgaagagugcaguuguuacgucgacacagauguuuacugcauaugcagagacaauuggaagggaagcaacaggcccuggaugcggaucaauaacgagaccauucuggaaacgggcuauguguguucuaaauuucauuccgauaccccucgcccagcggaccccucaacaguaagcugcgauaguccuucuaauaucaacggugggccaggagugaagggcuucggcuuucgaacugggaaugacgucuggcugggaagaaccguguccacaacugguaggagcggcuucgagguuaucaaagugaccgaaggguggauuaacucgcucaaucacgcaaagucugucacacagaccuuaguguccaacucagauuggaguggauacagcggcuccuuuauaguagagaauaacgguuguuuccagcccugcuucuauaucgaacugauucgggggcguccgaauaagaacgacgauguuucuuggacuagcaacucaaucgugacguuuuguggccuugacaaugagccuggaaguggcaacuggcccgauggguccaauauuggauucaugccaaaauga

SEQ ID NO: 145626 - RNA, 1410 nt, Artificial Sequence; identical to SEQ ID NO: 145625
  derived and/or modified sequence opt3 from neuraminidase__InfluenzaA__AGQ81846

SEQ ID NO: 145627 - RNA, 1410 nt, Artificial Sequence; identical to SEQ ID NO: 145625
  derived and/or modified sequence opt3 from neuraminidase__InfluenzaA__AGQ81847

SEQ ID NO: 145628 - RNA, 1410 nt, Artificial Sequence
  derived and/or modified sequence opt3 from neuraminidase__InfluenzaA__AGQ81848
augaaccccaaucagaagaucauuaccauaggcguggucaacacaacucugagcacgaucgcccuccuuauugggaucggaaaucugauuuucaacaccguuauccacgagaaaauaggugugcaucaaacaguaaucuacccuacuauuaccuccccaguggucccgaauugcucugacacaaccaucacuuauaacaauacagugguuaacaauauuaccacgacugugaucaacaaggcugaaaaacacuuuaagcccucauugccuuuauguccauucaaaggcuuuuuccccuuucauaaggauaaugcaauaagacugggggagaacaaggacgucauugugaccagggaaccuuacguaaguugcgauaaugacgauuguuggagcuucgcccuagcgcagggagcucuccugggcacaaaacacuccaacgguacuaucaaggaccggaccccauaucgcucucuuauucgauuucccaucgggacagccccuguucugggaaauuacaaagagaucugcguggcauggucgucaagcaguuguuucgauggcaaggaauggaugcaugucugcaugaccggcaacgacaacgaugccuccgggcagauuauauaugcuggaaaaaugacggacucuaucaagagcuggcguagagauauuuugaggacucaggaguccgagugucaaugcaucgacgguauauguauuguggcagugacagauggcccagccgcuaauucagccgaccaccggaucuacuggauccgcgaagggaagauuaucaaauaugagaacauuccgaagaccaaaauacagcaccucgaagagugcaguuguuacgucgacacugauguuuacugcaucugcagagacaauuggaagggaagcaacaggcccuggaugcggauuaauaacgagacaauccuggaaaccggcuauguguguucuaaauuucauuccgauacgccucgcccagcggaccccucaaccguaagcugcgauaguccuucuaauaucaacggugggccaggagugaagggcuucggcuuucgaacagggaaugacgucuggcugggaagaacuguguccaccacagguaggagcggcuucgagguuauuaaagugacugaaggguggauaaacucgcucaaucacgcaaagucugucacccagacauuaguguccaacucagauuggaguggauacagcggcuccuuuaucguagagaauaacgguuguuuccagcccugcuucuauauugaacugauccgggggcguccgaauaagaacgacgauguuucuuggaccagcaacucaauugugacuuuuuguggccuugacaaugagccuggaaguggcaacuggcccgauggguccaauaucggauucaugccaaaauga

SEQ ID NO: 145629 - RNA, 1410 nt, Artificial Sequence
  derived and/or modified sequence opt3 from neuraminidase__InfluenzaA__AGQ81850
augaaccccaaucagaagaucauuaccauaggcguggucaacacaacucugagcacgaucgcccuccuuauugggaucggaaaucugauuuucaacaccguuauccacgagaaaauaggugugcaucaaacaguaaucuacccuacuauuaccuccccaguggucccgaauugcucugacacaaccaucacuuauaacaauacagugguuaacaauauuaccacgacugugaucaacaaggcugaaaaacacuuuaagcccucauugccuuuauguccauucaaaggcuuuuuccccuuucauaaggauaaugcaauaagacugggggagaacaaggacgucauugugaccagggaaccuuacguaaguugcgauaaugacgauuguuggagcuucgcccuagcgcagggagcucuccugggcacaaaacacuccaacgguacuaucaaggaccggaccccauaucgcucucuuauucgauuucccaucgggacagccccuguucugggaaauuacaaagagaucugcguggcauggucgucaagcaguuguuucgauggcaaggaauggaugcaugucugcaugaccggcaacgacaacgaugccacggggcagauuauauaugcuggaaaaaugacugacuccaucaagucuuggcguagagauauuuugaggacacaggagagcgagugucaaugcaucgacgguaccuguauaguggcagugacugauggcccagccgcuaauuccgccgaccaccggauuuacuggauccgcgaagggaagaucauuaaauaugagaacaucccgaagacaaaaauucagcaccucgaagagugcucauguuacgucgacaccgauguuuacugcauaugcagagacaauuggaagggaaguaacaggcccuggaugcggaucaauaacgagacgauucuggaaaccggcuauguguguagcaaauuucauucugauacaccucgcccagcggaccccuccacuguaucaugcgauagcccuaguaauaucaacggugggccaggagugaagggcuucggcuuucgaaccgggaaugacgucuggcugggaagaacagugucuacuaccgguagguccggcuucgagguuaucaaagugacagaaggguggauuaacagccucaaucacgcaaagucggucacccagacuuuagugucuaacuccgauuggucaggauacaguggcagcuuuauaguagagaauaacgguuguuuccagcccugcuucuauaucgaacugauucgggggcguccgaauaagaacgacgauguuuccuggacgucuaacagcaucgugacauuuuguggccuugacaaugagccuggaucaggcaacuggcccgaugggaguaauauuggauucaugccaaaauga

SEQ ID NO: 145630 - RNA, 1410 nt, Artificial Sequence
  derived and/or modified sequence opt3 from neuraminidase__InfluenzaA__AGQ81852
augaaccccaaucagaagaucauuaccauaggcguggucaacacaacucugagcacgaucgcccuccuuauugggaucggaaaucugauuuucaacaccguuauccacgagaaaauaggugugcaucaaacaguaacuuacccuaccaucacauccccaguggucccgaauugcucugacaccacuauuacauauaacaauaccgugguuaacaauaucacgacuaccgugauuaacaaggcugaaaaacacuuuaagcccucauugccuuuauguccauucaaaggcuuuuuccccuuucauaaggauaaugcaaucagacugggggagaacaaggacgucauagugacaagggaaccuuacguaaguugcgauaaugacgauuguuggagcuucgcccuagcgcagggagcucuccugggcacuaaacacuccaacgguaccauuaaggaccggacaccauaucgcucucuuauccgauuucccauugggaccgccccuguucugggaaauuacaaagagaucugcguggcauggucgucaagcaguuguuucgauggcaaggaauggaugcaugucugcaugacgggcaacgacaacgaugccacugggcagaucauuuaugcuggaaaaaugacagacuccauaaagucuuggcguagagauaucuugaggacccaggagagcgagugucaaugcauugacgguacuuguaucguggcagugacagauggcccagccgcuaauuccgccgaccaccggauauacuggauucgcgaagggaagaucaucaaauaugagaacauuccgaagaccaaaauccagcaccucgaagagugcucauguuacgucgacacggauguuuacugcauuugcagagacaauuggaagggaaguaacaggcccuggaugcggauaaauaacgagaccauccuggaaacaggcuauguguguagcaaauuucauucugauacuccucgcccagcggaccccuccaccguaucaugcgauagcccuaguaauauuaacggugggccaggagugaagggcuucggcuuucgaacagggaaugacgucuggcugggaagaacugugucuaccacagguagguccggcuucgagguuaucaaagugaccgaaggguggaucaacagccucaaucacgcaaagucggucacucagacguuagugucuaacuccgauuggucaggauacaguggcagcuuuauuguagagaauaacgguuguuuccagcccugcuucuauauagaacugauccgggggcguccgaaucgcaacgacgauguuuccuggacaucuaacagcauugugaccuuuuguggccuugacaaugagccuggaucaggcaacuggcccgaugggaguaauaucggauucaugccaaaguga

SEQ ID NO: 145631 - RNA, 1410 nt, Artificial Sequence
  derived and/or modified sequence opt3 from neuraminidase__InfluenzaA__AGQ81853
augaaccccaaucagaagaucauuaccauaggcguggucaacacaacucugagcacgaucgcccuccuuauugggaucggaaaucugauuuucaacaccguuauccacgagaaaauaggugugcaucaaacaguaacuuacccuaccaucacauccccaguggucccgaauugcucugacaccacuauuacauauaacaauaccgugguuaacaauaucacgacuaccgugauuaacaaggcugaaaaacacuuuaagcccucauugccuuuauguccauucaaaggcuuuuuccccuuucauaaggauaaugcaaucagacugggggagaacaaggacgucauagugacaagggaaccuuacguaaguugcgauaaugacgauuguuggagcuucgcccuagcgcagggagcucuccugggcacuaaacacuccaacgguaccauuaaggaccggacaccauaucgcucucuuauccgauuucccauugggaccgccccuguucugggaaauuacaaagagaucugcguggcauggucgucaagcaguuguuucgauggcaaggaauggaugcaugucugcaugacgggcaacgacaacgaugccacugggcagaucauuuaugcuggaaaaaugacagacuccauaaagucuuggcguagagauaucuugaggacccaggagagcgagugucaaugcauugacgguacuuguaucguggcagugacagauggcccagccgcuaauuccgccgaccaccggauauacuggauucgcgaagggaagaucaucaaauaugagaacauuccgaagaccaaaauccagcaccucgaagagugcucauguuacgucgacacggauguuuacugcauuugcagagacaauuggaagggaaguaacaggcccuggaugcggauaaauaacgagaccauccuggaaacaggcuauguguguagcaaauuucauucugauacuccucgcccagcggaccccuccaccguaucaugcgauagcccuaguaauauuaacggugggccaggagugaagggcuucggcuuucgaacagggaaugacgucuggcugggaagaacugugucuaccacagguagguccggcuucgagguuaucaaagugaccgaaggguggaucaacagccucaaucacgcaaagucggucacucagacguuagugucuaacuccgauuggucaggauacaguggcagcuuuauuguagagaauaacgguuguuuccagcccugcuucuauauagaacugauccgggggcguccgaauaagaacgacgauguuuccuggacaucuaacagcauugugaccuuuuguggccuugacaaugagccuggaucaggcaacuggcccgaugggaguaauaucggauucaugccaaaauga

SEQ ID NO: 145632 - RNA, 1410 nt, Artificial Sequence; identical to SEQ ID NO: 145631
  derived and/or modified sequence opt3 from neuraminidase__InfluenzaA__AGQ81854

SEQ ID NO: 145633 - RNA, 1410 nt, Artificial Sequence; identical to SEQ ID NO: 145631
  derived and/or modified sequence opt3 from neuraminidase__InfluenzaA__AGQ81855

SEQ ID NO: 145634 - RNA, 1410 nt, Artificial Sequence; identical to SEQ ID NO: 145624
  derived and/or modified sequence opt3 from neuraminidase__InfluenzaA__AGQ81856

SEQ ID NO: 145635 - RNA, 1410 nt, Artificial Sequence
  derived and/or modified sequence opt3 from neuraminidase__InfluenzaA__AGQ81857
augaaccccaaucagaagaucauuaccauaggcguggucaacacaacucugagcacgaucgcccuccuuauugggaucggaaaucugauuuucaacaccguuauccacgagaaaauaggugugcaucaaacaguaguguacccuacuaucaccccaccggucauucccaauugcuccgacacaaccaucacuuauaacaauacagugguuaacaauauuaccacgacuaucauaaacaaggcugaaaaacaguuuaagccuucuuugccauuaugucccuucagaggcuuuuucccuuuucacaaagauaaugcaauuaggcugggggagaacaaggacgugaucgucacccgggaaccauacgugucaugcgauaaugacgauuguuggaguuucgcccuagcgcagggagcucuccugggcacaaagcauagcaacgguacuauuaaagaccgcacccccuaucgaucccuuauccguuuuccuaucgggacagccccaguacugggaaauuacaaggagauuugcguugcauggucuucgucaagcuguuucgauggcaaagaauggaugcacgugugcaugaccggcaacgacaacgaugccagugggcagauaaucuaugcuggaaagaugacggacuccauuaaaucuuggagaagggauaucuugcggacucaagagagcgagugucagugcauagacgguacauguauugucgcagugaccgauggcccggccgcuuccucagccgaccaucgcaucuacuggaucagagaagggaagauuaucaaguaugaggacauucccaaaacuaagauacagcaccucgaagagugcaguuguuacguggauacagacgucuacugcaucugcagggauaauuggaaaggaagcaaccggccuuggaugcgcauuaauaacgagaccauccuggaaacgggcuauguuuguucuaaguuucacuccgacaccccacgacccgcggauccuucaacagugagcugcgacaguccaucuaauaucaacggugggcccggaguaaaaggcuucggcuuuagagcagggaaugauguguggcugggaaggacugucuccaccacaggucggagcggcuucgaggugauuaagguuacugaaggguggauaaacucgcucaaucaugccaaaucugugacccagacauuagucuccaacaaugacuggucaggauacaguggcagcuuuaucguggaguccaacgguuguuuccaaccgugcuucuauauugaacugauccgugggcgcccuaauagaaacgaugacguaucuuggaccagcaauucaauuguuacuuuuuguggccuugauaacgagcccggaaguggcaacuggccagacggguccaauaucggauucaugccuaaguga

SEQ ID NO: 145636 - RNA, 1410 nt, Artificial Sequence
  derived and/or modified sequence opt3 from neuraminidase__InfluenzaA__AGQ81858
augaaccccaaucagaagaucauuaccauaggcguggucaacacaacucugagcacgaucgcccuccuuauugggguuggaaaucugaucuucaacaccgugauucacgagaaaaucggugaccaucaaauaguaguguacccuacaacuaccgcuuccgucgugccaaauugcucugauacaaucauuaccuauaacaauacuguugugaacaauaucacaaccacgauuaucacuaaggaagagacccacuuuaaaucaaguuugccguuaugucccuucagaggcuuuuucccuuuucauaaggacaacgcaauaaggcugggggaaaauaaagaugucauugugacacgggagccauacguaagcugcgacaacgaugacuguugguccuucgcccuagcgcagggagcucuccugggcacuaagcacucuaaugguaccaucaaggaucgcacacccuaucgaucgcuuauucguuuuccuaucgggaccgccccaguucugggaaacuacaaagaaaucugcguggcauggucaagcaguuccuguuucgacggcaaggaguggaugcaugucugcaugacgggcaaugauaacgacgccucugggcagauuauguaugcuggaaaaaugacugauagcauaaaguccuggagaaaagacaucuugaggacacaggagucagaaugucaaugcauugaugguaccuguaucguggcagugacugacggccccgccacaaacagugcugaccaccggauauacuggauucgcgaggggaagaucaucaaguaugaaaauauuccuaaaaccaagauccagcaccucgaggagugcagcuguuacgucgauauugacguuuacugcgugugcagagauaacuggaaaggaucuaauaggccauggaugcggauaaacaaugaaacgauccuggagaccggcuauguauguuccaaguuucauucagacacaccgcgccccgccgauccuagcacugugaguugcgacucuccauccaacgucaauggugggcccggagugaaaggcuucggcuuuaagaccgggaacgauguuuggcugggacgaacagugagcacuucggguagaucuggcuucgaaauuaucaaagucaccgagggguggaucaauuccccuaaccacgcgaagucagugacacagacccucguaaguaauaacgacuggagcggauacuccggcucuuuuauuguugaaaauaacgguuguuuccagccaugcuucuauauagaguuaaucagggggcggcccaauaagaacgaugacgugagcuggacuucaaacaguauugucacguuuuguggccuggauaaugagccgggauccggcaacuggccugacgggagcaauaucggauucaugcccaaauga

SEQ ID NO: 145637 - RNA, 1410 nt, Artificial Sequence
  derived and/or modified sequence opt3 from neuraminidase__InfluenzaA__AGQ81859
augaaccccaaucagaagaucauuaccauaggcguggucaacacaacucugagcacgaucgcccuccuuauugggaucggaaaucugauuuucaacaccguuauccacgagaaaauaggugugcaucaaacaguagugugcccuacuaucaccccaccggucgugcccaauuguuccgacacaaccauuacuuacaacaauacaguugugaacaauaucaccacgacuauuaucaacaaggcugaaaaacaguuuaagucuucauugccuuuaugcccauucagaggcuuuuuccccuuucacaaagauaaugcaauaaggcugggggagaacaaggacgucauugugacccgggaaccuuauguaaguugugauaaugacgauugcuggagcuucgcccuagcgcagggagcucuccugggcacaaagcauuccaacgguacuaucaaagaccgcaccccauaccgaucucuuauucguuuucccaucgggacagccccuguucugggaaauuauaaggagaucuguguggcauggucgucaagcaguugcuucgauggcaaagaauggaugcacauuuguaugaccggcaacgacaacgaugccuccgggcagauaaucuacgcuggaaagaugacggacucuauuaaaagcuggagaagggauaucuugcggacucaagaguccgagugccaguguauagacgguacaugcauugucgcaaucaccgauggcccagccgcuucaagugccgaccaucgcaucuauuggauuagagaagggaagaucauuaaguacgagaauauaccgaaaacuaagauccagcaccucgaagaguguagcugcuauguggacauugauguguacugcaucuguagggacaacuggaaaggaucuaaucggcccuggaugcgcaucaacaaugagacaauucuggaaaccggcuacgucugcuccaaguuucacucagauacgccucgaccagcggaccccagcaccguuaguugugauucuccuuccaacauaaauggugggccaggagugaaaggcuucggcuuuagagcagggaacgacguauggcugggaaggacagugagcacuaccggucggucgggcuucgaggucaucaaggugacagaaggguggauuaauucucucaaccaugccaaauccguuacucagaccuuagugucaaauagugauuggagcggauauuccggcucuuuuaucgucgagaacaaugguugcuuccaacccuguuucuacauugaacugauccgugggcgcccgaacagaaaugacgaugugagcuggacaucaaacaguauaguaaccuuuugcggccuugacaacgagccuggauccggcaauuggcccgaugggagcaacaucggauucaugccaaaguga

SEQ ID NO: 145638 - RNA, 1413 nt, Artificial Sequence
  derived and/or modified sequence opt3 from neuraminidase__InfluenzaA__AGQ81860
augaaccccaaucagaagaucauuugcauaagcgccaccggcaugacacuguccguggucucucuccuuaucgggauugcuaaccugggauugaauaucgguuuacacuacaaaguuggcgacacuccugaugugucaauuccaaacaugaaugagacgaacaguaccacaacuaucauaaauaacaauacccaaaacaauuucacaaacaucaccaauauuaucguaaacaagaaugaagagaaaacuuuucugaaccuaacaaagccgcucugugaagugaacagcuggcauauucuguccaaagacaaugcaaucagaauaggggaggaugcccacauucuugucaccagggaacccuaucugucuugcgacccucagggaugucggauguucgcguugucgcagggcacgacucuccgcggucgacaugcuaacgggaccauccacgaucguucaccauuuagagcccuggugagcugggagaugggacaggcacccaguccuuacaauguuaagguggagugcgucggcugguccucuacaagcugucaugacggcauuuccaggaugucaaucugcaugagugggccaaacaauaacgccagcgcugugguaugguauggaggucggcccguuacugaaaucccuucuugggcaggcaauauucugcgcacccaagaguccgaaugugugugccacaaggggauauguccagucgugaugacagauggaccggccaacaauagagcugccaccaaaaucauuuacuucaaggagggcaaaauccagaagauagaggaacucgcggguucagcacagcacauugaggaaugcagcuguuauggggccguggaggucaucaaaugcaucugcagggacaacuggaagggagcuaaucggcccguuauuacgaucaacccugaaaugaugacucauacaaguaaguacuuauguucuaaagugcugaccgauacuucccgcccaaaugaccccacaaacggcaauugcgaugccccuauuaccggcgggagcccagaccccggaguaaaggguuuugcauuccuugauggcgagaacucgugguuggggcgaacgauaucuaaagacuccagaucaggauaugagaugcugaaggugccgaacgcugaaaccgacacacagaguggcccuacuagccaccaagucaucgugaauaaccagaauugguccgguuacucuggggccuuuauugauuacugggcgaacaaagaguguuucaaucccugcuuuuauguugaacuaaucaggggccggccaaaggagagcucagugcucuggaccaguaacuccaucgucgcccuguguggaagcaaagaacgucuuggcucuuggucauggcaugacggggcagagauuauauacuucaaguga

SEQ ID NO: 145639 - RNA, 1413 nt, Artificial Sequence
  derived and/or modified sequence opt3 from neuraminidase__InfluenzaA__AGQ81861
augaaccccaaucagaagaucauuugcauaagcgccaccggcaugacacuguccguggucucucuccuuaucgggauugcuaaccugggauugaauaucgguuuacacuacaaaguuggcgacacuccugaugugucaauuccaaacaugaaugagacgaacaguaccacaacuaucauaaauaacaauacccaaaacaauuucacaaacaccacuaauaucauuguaaacaagaaugaagagaaaacauuucugaaccuaaccaagccgcucugugaagugaacagcuggcauauccuguccaaagacaaugcaauuagaaucggggaggaugcccacauacuugucacgagggaacccuaucugucuugcgacccucagggaugucggauguucgcguugucgcagggcacuacccuccgcggucgacaugcuaacgggacaauucacgaucguucaccauuuagagcccuggugagcugggagaugggacaggcacccaguccuuacaauguuaagguggagugcgucggcugguccucuacuagcugucaugacggcaucuccaggaugucaauuugcaugagugggccaaacaauaacgccagcgcugugguaugguauggaggucggcccguuaccgaaaucccuucuugggcaggcaauauccugcgcacacaagaguccgaaugugugugccacaaggggauuuguccagucgugaugaccgauggaccggccaacaauagagcugccacgaaaauaaucuacuucaaggagggcaaaauucagaagaucgaggaacucgcggguucagcacagcacauagaggaaugcagcuguuauggggccguggaggucauuaaaugcaucugcagggacaacuggaagggagcuaaucggcccguuaucacuauuaacccugaaaugaugacacauaccaguaaguacuuauguucuaaagugcugacugauacaucccgcccaaaugaccccaccaacggcaauugcgaugccccuaucacgggcgggagcccagaccccggaguaaaggguuuugcauuccuugauggcgagaacucgugguuggggcgaaccauuucuaaagacuccagaucaggauaugagaugcugaaggugccgaacgcugaaacagacacucagaguggcccuaccagccaccaagucauagugaauaaccagaauugguccgguuacucuggggccuuuaucgauuacugggcgaacaaagaguguuucaaucccugcuuuuauguugaacuaauuaggggccggccaaaggagagcucagugcucuggacaaguaacuccaucgucgcccuguguggaagcaaagaacgucuuggcucuuggucauggcaugacggggcagagaucauuuacuucaaguga

SEQ ID NO: 145640 - RNA, 1413 nt, Artificial Sequence
  derived and/or modified sequence opt3 from neuraminidase__InfluenzaA__AGQ81862
augaaccccaaucagaagaucauuugcauaagcgccacuggcaugacacuguccguggucucucuccuuaucgggauugcuaaccugggauugaauaucgguuuacacuacaaaguuggcgacacuccugaugugaacauuccaucaaugaaugagacgaacaguaccacaacuaucauaaauaacaauacccaaaacaauuucacaaacaucaccaauauuaucguaaacaaggaagaggggagaacuuuucugaaucuaacaaaaccgcucugugaagugaacagcuggcauauucuguccaaggacaacgcaaucaggauaggagaggaugcccacauucuugucacccgggaacccuaucugucuugcgacccucagggcugucgcauguucgcguugucgcaggguacgacucuccgagggcgucaugcuaauggaaccauccacgauagaucaccauuuagggcccuggugagcugggagaugggccaggcacccaguccuuacaacguucggguggagugcauuggcugguccucuacaagcugucaugacgggaucucccgcaugucaaucugcaugaguggaccaaauaacaaugccagcgcugucgugugguaugguggcagacccguaacugaaauuccuucuugggcagggaacauacugaggacccaagaguccgaauguguuugccacaaaggaaucuguccaguggucaugacagauggcccggccaauaaccgggcugccaccaagauuaucuacuucaaggaggguaaaauacagaagauugaggaacucgaggggaaugcgcagcacaucgaagagugcucauguuauggagcagccggcgugaucaaaugcauuugccgcgacaacuggaagggcgcuaaucgacccgugaucauuauagauccugaaaugaugacgcauacuagcaaauacuuauguaguagaguccugacagacaccucuaggccaaacgaucccacuuccgggaauugcgacgccccuaucacaggagguagcccagaucccggcguuaagggguuugcauuccuugacggagagaacucgugguugggccggaccauuucuaaggacucccguucagguuaugagaugcugaaagugccgaaugcugaaacggauacccagagugggccuacaagccaccaaguaaucgugaacaaccagaauugguccggcuacucuggagccuuuaucgacuacugggcgaacaaggaguguuucaaucccugcuuuuaugucgaacuaauucgcggcagaccaaaagagagcucagugcucuggaccaguaacuccauaguugcccugugugggagcaaggaaaggcuuggaucuuggucauggcaugauggugcagagaucauuuacuucaaauga

SEQ ID NO: 145641 - RNA, 1413 nt, Artificial Sequence
  derived and/or modified sequence opt3 from neuraminidase__InfluenzaA__AGQ81863
augaaccccaaucagaagaucauuugcauaagcgccaccggcaugacacuguccguggucucucuccuuaucgggauugcuaaccugggauugaauaucgguuuacacuacaaaguuggcgacacuccugaugugaacauuccaucaaugaaugagacgaacaguaccacaacuaucauaaauaacaauacccaaaacaauuucacaaacaucaccaauauuaucguaaacaaggaagaggaaagaacuuuucugaaucuaacaaaaccgcucugugaggugaacagcuggcauauucuguccaaggacaacgcaaucaggauaggggaagaugcccacauucuugucacccgggagcccuaucugucuugcgacccucagggaugucgcauguucgcguugucgcagggcacgacucuccgaggucgucaugcuaaugggaccauccacgauagaucaccauuuagggcccuggugagcugggagaugggacaggcacccaguccuuacaacguucggguggaaugcauuggcugguccucuacaagcugucaugacggcaucucccgcaugucaaucugcaugagugggccaaauaacaaugccagcgcugucgugugguauggagguagacccguaacugagauuccuucuugggcaggcaacauacugaggacccaagaauccgaguguguuugccacaaagggaucuguccaguggucaugacagauggaccggccaauaaccgggcugccaccaagauuaucuacuucaaggagggcaaaauacagaagauugaggaacucgaagguaaugcgcagcacaucgaggaaugcucauguuauggggcagccggagugaucaaaugcauuugccgcgacaacuggaagggcgcuaaucgacccgugaucauuauagauccugagaugaugacgcauacuagcaaauacuuauguaguagaguccugacagacaccucuaggccaaacgaucccaucuccggcaauugcgacgccccuauuacugggggaagcccagaucccgguguuaagggcuuugcauuccuugacggggagaacucgugguugggacggacaaucucuaaggacucccguucaggcuaugaaaugcugaaagugccgaaugcugagaccgauacgcagagugguccuaccagccaccaaguaaucgugaacaaccagaauugguccggguacucuggcgccuuuauugacuacugggcgaacaaggaauguuucaaucccugcuuuuaugucgagcuaauacgcggaagaccaaaagaaagcucagugcucuggacaaguaacuccaucguugcccuguguggcagcaaggagaggcuugggucuuggucauggcaugauggagcagagauuaucuacuucaaauga

SEQ ID NO: 145642 - RNA, 1416 nt, Artificial Sequence
  derived and/or modified sequence opt3 from neuraminidase__InfluenzaA__AGQ81864
augaaccccaaucagaagcuguucgcccucagcggcguggcuaucgcacuuuccguccugaacuuguuaauugggauaucuaauguuggacugaacgugucacuacaccucaaagagaaggguccuaaacaagaagagaauaguaccugcacaacuaucaaccagaauaacacgaccauuguagaaaauacauacgugaacaauacuaccaucauuagcaaggagacagaacugaaaccaccgaacuaucuucuguugaauaagucccucuguaacgucgagggcugggugguuaucgccaaggacaaugcggugagauuuggggagucugaacagauaaucgucaccagggagcccuacgugucgugcgauccuacuggauguaaaauguaugcucugcaucagggcacaaccauucggaacaagcacucaaacgguacgauccaugaccgcacugccuuccgagggcugauuagcaccccacucggaacacccccuacuguaaguaauuccgauuuuaucugcguuggcuggucuagcaccacaugucacgacggcauagggcguaugaccauuugcauccaaggaaacaaugauaacgcaacggccacuguguacuauaauagaagguuaacaaccacuauuaaaacaugggcucggaacauccugcgcacccaggaauccgagugugucugccauaaugguacgugugcaguggugaugaccgacggcucagccaguagccaggcuuacacaaaggucauguauuuccacaaagggcuuguuaucaaggaggaagccuugaagggaucugcgagacacauugaggaaugcuccuguuacggccauucacagaaagcaacuugcgugugcagggauaacuggcaaggugccaaucggccaauaaucgagauugacaugaacacccuggaacacacaagccgcuacguauguacugggauccuaaccgauacaagucgacccggagacaagucuuccggcgauugcagcaauccuauaaccggcucgccaggggcuccgggagugaaagguuuuggcuuccucaacggggacaauacuuggcugggaagaacgauuucucccaaguccaggucaggcuuugagaugcuuaaaaucccuaacgccgguacagauccaaauagucggaucgcagagcgucaggaaauugucgacaacaacaauuggagcggguauuccggcucuuucaucgacuacugggauaacgacagcgaguguuauaaucccugcuuuuacguggaacugauucgcggaagaccugaggaagcuaaguauguuugguggaccucaaacaguuugauagcccucuguggcuccccauuccccguggggagcggaucuuuuccggauggugcgcagauccaguacuucucauga

SEQ ID NO: 145643 - RNA, 1416 nt, Artificial Sequence
  derived and/or modified sequence opt3 from neuraminidase__InfluenzaA__AGQ81865
augaaccccaaucagaagcuguucgcccucagcggcguggcuaucgcacuuuccguccugaacuuguuaauugggcugucuaauguuggacuaaacgugucacuccaccugaaagagaccgguccuaagcaagaaggcaaucuuacaugcaugacuauaaaccagaauaacacgaccguaguggagaauacauacgucaacaauacuaccaucauuacaaaagaaaccgagagugaaacuccaaacuaucuguugcucaauaagagccuguguaacguggagggguggguugugaucgccaaagacaaugcggucagauuuggagaguccgaacagauuaucgugacaagggagccguacguaucuugcgaucccaacggcuguaagauguaugcucugcaucaggguaccacgauacggaacaagcacucgaaugggacuauccaugaccgcaccgccuuccgaggacucauuucaacaccuuuaggcacuccacccaccguuagcaacagugauuuuaucugcgugggcugguccucuacaaccugucacgacgggauuggacguaugacgaucugcauacaagguaauaacgauaaugcaacugccacagucuacuauaacagaaggcugaccacuacaauuaaaaccugggcucggaauauccuucgcacgcaggaaagcgagugugugugccauaacggcaccugugcaguggucaugacagacggguccgccucaagucaggcucacacuaagguuauguacuuccacaaaggauuggugguaaaggaggaagcccugaaaggcagcgcgagacauauugaggaaugcucuuguuauggucacaaucagaaggugaccugcgucugcagggauaacuggcaaggggcaaaucggccuaucaucgagauugacaugaacacacuagaacauacuucccgcuacguguguaccggaauacucacagauaccucacgaccaggcgacaagcccacuggcgauugcagcaauccuaucacggggaguccaggagccccggguguuaaaggcuuuggguuccugaacggaggcaauacauggcuugguagaaccauuucucccaggucccggagcggguuugagaugcugaagaucccuaacgcuggcacugacccaaacucgcguauagccgagcgccaggaaauuguggauaauucuaacugguccggauacucaggcaguuucaucgacuauuggaaugacaacagcgaguguuacaaucccugcuuuuaugucgaauugaucagagggaggccugaggaagcaaaauacgugugguggaccuccaacucucucauugcucuguguggaagcccauuccccguagguucaggcaguuuuccggauggggcccagauccaguauuucuccuga

SEQ ID NO: 145644 - RNA, 1416 nt, Artificial Sequence
  derived and/or modified sequence opt3 from neuraminidase__InfluenzaA__AGQ81868
augaaccccaaucagaagcuguucgcccucagcggcguggcuaucgcacuuuccguccugaacuuguuaauugggauaucuaauguuggacugaacgugucacuacaccucaaagagaaggguccuaaacaagaagagaauaguaccugcacaacuaucaaccagaauaacacgaccguaguggaaaauacauacgucaacaauacuaccauuaucacaaaggagaccgaacugaaaacuccaagcuaucuucuguugaacaagucccucuguaauguggagggcuggguugugauugccaaggacaacgcggucagauuuggggagucugaacagaucauagugacaagggagccguacguaucgugcgaucccaccggauguaaaauguaugcucugcaucagggcacgacuauccggaauaagcacucaaacgguaccauucaugaccgcacagccuuccgagggcugaucagcacuagccucggaaccccuccaacaauuuccaacucugauuuuaugugcguuggcuggagcuccaccacgugucacgacggcaucgggcguaugacuauaugcauucaaggaaauaacgauaaugcaacagccaccguguacuauaacagaagguuaacuacaaccaucaaaacgugggcucggaauauucugcgcacccaggaaucagagugugucugccauaacgguaucugugcaguggugaugacagacggcagugccagcucucaggcuuacacuaaggucauguauuuccacaaagggcuuguugugaaggaggaagccuugaagggauccgcgagacacaucgaggaaugcucauguuacggccauagccagaaaguaaccugcgugugcagggauaauuggcaaggugcaaaccggcccauuauagagaucgacaugaauacacuggaacacaccagucgcuacgucuguacugggauucuaacagauaccucucgaccuggagacaaguccagcggcgauugcucgaacccaaucgccggcucucccggggcuccuggagugaaagguuuuggcuuccucaauggggacaacacuuggcugggaagaacgauauccccaaggucacggaguggcuuugagaugcuuaagauuccgaaugccgguacagaucccaacagccguaucgcagggcgccaggagaucguugacaauaacaacugguccggcuauucuggaaguuucauugacuacuggaaugauaacucagaauguuauaauccuugcuuuuacguggagcugaucagaggcaggccagaagaggcuaaauaugucugguggaccaguaacuccuugauugcccucugugggagccccuucccugugggaucugguucauuuccagacggcgcgcagauacaguacuucaguuga

SEQ ID NO: 145645 - RNA, 1416 nt, Artificial Sequence
  derived and/or modified sequence opt3 from neuraminidase__InfluenzaA__AGQ81869
augaaccccaaucagaagcuguucgcccucagcggcguggcuaucgcacuuuccguccugaacuuguuaauugggauaucuaauguuggacugaacgugucacuacaccucaaagagaaggguccuaaacaagaagagaauaguacuugcacaacuaucaaccagaauaacacgaccauuguagaaaauacauacgugaacaauacuaccaucauuagcaaggagacagaacugaaaaccccauccuaucuucuguugaacaagucucucuguaaugucgagggcugggugguuaucgccaaggacaacgcggugagauuuggggagucggaacagauaaucgucacuagggagccguacgugucaugcgaucccacaggauguaaaauguaugcucugcaucagggcaccacgauucggaauaagcacagcaacgguacuauccaugaccgcaccgccuuccgagggcugauuaguacaccucucggaacuccacccaccguauccaacucugauuuuaucugcguuggcuggagcuccacaaccugucacgacggcauagggcguaugacgauuugcauccaaggaaauaacgauaaugcaacugccacaguguacuauaacagaagguuaaccacuacaauucggaccugggcucgcaauauccugagaacgcaggaaucagagugugucugccauaacgguaccugugcaguggugaugacagacggcagugccagcucucaggcuuacacuaaagucauguauuuccacaaggggcuuguuaucaaagaggaagccuugaagggauccgcgaggcacauugaggaaugcucauguuacggccauagccagaaggcaaccugcgugugccgggauaauuggcaaggugccaaccgcccuauaaucgagauugacaugaauacacuggaacacaccagucgauacguauguacugggauccuaacagauaccucuagaccaggagacaaauccagcggcgauugcucgaaccccauaacuggcucuccuggggcuccaggagugaaggguuuuggcuuccucaauggggacaacacguggcugggaaggacaauuuccccgcggucacguaguggcuuugagaugcuuaaaauccccaaugccgguaccgauccuaacagccgcaucgcagagagacaggaaauugucgacaauaacaacugguccggguauucuggcagcuucaucgacuacuggaauaacgauucagaguguuauaauccaugcuuuuacguggaacugauuaggggacggcccgaggaagcuaaguauguuugguggaccaguaacuccuugauagcccucuguggcagcccuuucccaguggggucuggaucauuucccgacggugcgcagauccaguacuucaguuga

SEQ ID NO: 145646 - RNA, 1416 nt, Artificial Sequence
  derived and/or modified sequence opt3 from neuraminidase__InfluenzaA__AGQ81870
augaaccccaaucagaagcuguucgcccucagcggcguggcuaucgcacuuuccguccugaacuuguuaauugggauaucuaauguuggacugaacgugucacuacaccucaaagagaaggguccuaaacaagaagagaauaguaccugcacaacuaucaaccagaauaacacgaccauuguagaaaauacauacgugaacaauacuaccaucauuagcaaggagacagaacugaaaccaccguccuaucuucuguugaacaagucucucuguaaugucgagggcugggugguuaucgccaaggacaacgcggugagauuuggggagucggaacagauaaucgucaccagggagcccuacgugucaugcgauccuacuggauguaaaauguaugcucugcaucagggcacaaccauucggaauaagcacagcaacgguacgauccaugaccgcacugccuuccgagggcugauuaguaccccacucggaacacccccuacuguauccaacucugauuuuaucugcguuggcuggagcuccaccacaugucacgacggcauagggcguaugaccauuugcauccaaggaaauaacgauaaugcaacggccacuguguacuauaacagaagguuaacaaccacuauucggacaugggcucgcaauauccugagaacccaggaaucagagugugucugccauaacgguacgugugcaguggugaugaccgacggcagugccagcucucaggcuuacacaaaagucauguauuuccacaaggggcuuguuaucaaagaggaagccuugaagggauccgcgaggcacauugaggaaugcucauguuacggccauagccagaaggcaacuugcgugugccgggauaauuggcaaggugccaaccgcccaauaaucgagauugacaugaauacccuggaacacacaagucgauacguauguacugggauccuaaccgauacaucuagacccggagacaaauccagcggcgauugcucgaacccuauaaccggcucuccaggggcuccgggagugaaggguuuuggcuuccucaauggggacaacacuuggcugggaaggacgauuucaccccggucccguaguggcuuugagaugcuuaaaaucccuaaugccgguacagauccaaacagccgcaucgcagagagacaggaaauugucgacaauaacaacugguccggguauucuggcagcuucaucgacuacuggaauaacgauucagaguguuauaaucccugcuuuuacguggaacugauuaggggacggccugaggaagcuaaguauguuugguggaccaguaacuccuugauagcccucuguggcagcccauuccccguggggucuggaucauuuccggacggugcgcagauccaguacuucaguuga

SEQ ID NO: 145647 - RNA, 1416 nt, Artificial Sequence
  derived and/or modified sequence opt3 from neuraminidase__InfluenzaA__AGQ81871
augaaccccaaucagaagcuguucgcccucagcggcguggcuaucgcacuuuccguccugaacuuguuaauugggauaucuaauguuggacugaacgugucacuacaccucaaagagaaggguccuaaacaagaagagaauaguacuugcacaacuaucaaccagaauaacacgaccauuguagaaaauacauacgugaacaauacuaccaucauuagcaaggagacagaacugaaaaccccauccuaucuucuguugaacaagucucucuguaaugucgagggcugggugguuaucgccaaggacaacgcggugagauuuggggagucggaacagauaaucgucacuagggagccguacgugucaugcgaucccacaggauguaaaauguaugcucugcaucagggcaccacgauucggaauaagcacagcaacgguacuauccaugaccgcaccgccuuccgagggcugauuaguacaccucucggaacuccacccaccguauccaacucugauuuuaucugcauaggcuggagcuccacaaccugucacgacggcauugggcguaugacgaucugcauucaaggaaauaacgauaaugcaacugccacaguuuacuauaacagaagguuaaccacuacaauccggaccugggcucgcaauauccugagaacgcaggaaucagagugugugugccauaacgguaccugugcagucgugaugacagacggcagugccagcucucaggcuuacacuaaagugauguauuuccacaaggggcuugucauuaaagaggaagccuugaagggauccgcgaggcacauagaggaaugcucauguuacggccauagccagaaggcaaccugcguuugccgggauaauuggcaaggugccaaccgcccuaucauugagaucgacaugaauacacuggaacacaccagucgauacguguguacugggauacuaacagauaccucuagaccaggagacaaauccagcggcgauugcucgaaccccauuacuggcucuccuggggcuccaggaguaaaggguuuuggcuuccucaauggggacaacacguggcugggaaggacaaucuccccgcggucacguaguggcuuugagaugcuuaaaauccccaaugccgguaccgauccuaacagccgcauugcagagagacaggaaaucguggacaauaacaacugguccggguauucuggcagcuucauugacuacuggaauaacgauucagaguguuauaauccaugcuuuuacgucgaacugauaaggggacggcccgaggaagcuaaguaugugugguggaccaguaacuccuugaucgcccucuguggcagcccuuucccaguugggucuggaucauuucccgacggugcgcagauucaguacuucaguuga

SEQ ID NO: 145648 - RNA, 1416 nt, Artificial Sequence
  derived and/or modified sequence opt3 from neuraminidase__InfluenzaA__AGQ81872
augaaccccaaucagaagcuguucgcccucagcggcguggcuaucgcacuuuccguccugaacuuguuaauugggauaucuaauguuggacugaacgugucacuacaccucaaagagaaggguccuaaacaagaagagaauaguaccugcacaacuaucaaccagaauaacacgaccauuguagaaaauacauacgugaacaauacuaccaucauuagcaaggagacagaacugaaaaccccauccuaucuucuguugaacaagucucucuguaaugucgagggcugggugguuaucgccaaggacaacgcggugagauuuggggagucggaacagauaaucgucacuagggagccguacgugucaugcgaucccacaggauguaaaauguaugcucugcaucagggcaccacgauucggaauaagcacagcaacgguacuauccaugaccgcaccgccuuccgagggcugauuaguacaccucucggaacuccacccuccguaucuaacagcgauuuuaucugcguuggcugguccucaaccacaugucacgacggcauagggcguaugaccauuugcauccaaggaaauaacgauaaugcaacggccacuguguacuauaacagaagguuaacaaccacuauucggacaugggcucgcaauauccugagaacccaggaaagugagugugucugccauaacgguacgugugcaguggugaugaccgacggcagcgccucuucccaggcuuacacaaaagucauguauuuccacaaggggcuuguuaucaaagaggaagccuugaagggaucagcgaggcacauugaggaaugcagcuguuacggccauagucagaaggcaacuugcgugugccgggauaauuggcaaggugccaaccgcccuauaaucgagauugacaugaauacccuggaacacacaucucgauacguauguacugggauccuaaccgauacauccagaccaggagacaaaagcucgggcgauugcucuaaccccauaaccggcuccccuggggcuccaggagugaaggguuuuggcuuccucaauggggacaacacuuggcugggaaggacgauuucaccgcggagucguagcggcuuugagaugcuuaaaauccccaaugccgguacagauccuaacucccgcaucgcagagagacaggaaauugucgacaauaacaacuggucuggguauagcggcucauucaucgacuacuggaauaacgauagugaguguuauaauccaugcuuuuacguggaacugauuaggggacggcccgaggaagcuaaguauguuugguggaccuccaacagcuugauagcccucuguggcucuccuuucccaguggggucaggaaguuuucccgacggugcgcagauccaguacuucagcuga

SEQ ID NO: 145649 - RNA, 1416 nt, Artificial Sequence
  derived and/or modified sequence opt3 from neuraminidase__InfluenzaA__AGQ81875
augaaccccaaucagaagcuguucgcccucagcggcguggcuaucgcacuuuccguccugaacuuguuaauugggauaucuaauguuggacugaacgugucacuacaccucaaagagaaggguccuaaacaagaagagaauaguaccugcaugacaaucaaccagaauaacacuacgguaguggaaaauaccuacgucaacaauacaacuauuaucaccaaggagacagaacuggagaccccaagcuaucuucuguugaacaaaggccucuguaauguggagggguggguugugauugccaaggacaacgcggucagauuuggagaaacugagcagaucauagugacaagggaaccguacguauccugcgaucccaauggcuguaagauguaugcucugcaucaggguaccacgauccggaacaaacacucuaacgggacuauucaugaccgcaccgccuuccgaggacugaucucgacaccucucggcacuccacccaccguuucaaauagcgauuuuauuugcgugggcuggaguuccacaaccugucacgacgggaucggacguaugacgauaugcauucaagguaacaaugauaacgcaacugccacagucuacuauaauagaagguuaaccacuacaaucaagaccugggcucggaacauucugcgcacgcaggagucugagugugugugccauaauggcaccugugcaguggucaugacagacgggagcgccuccucacaggcucacacuaaaguuaucuacuuccacaagggacuuaucgugaaagaagaggccuugaagggcagugcgagacauauugaagagugcagcuguuauggucacucucagaagguaaccugcgugugcagggauaacuggcaaggggcaaaucggccuauaaucgaaauugacaugaacacacuggagcauacuucccgcuacgucuguaccggaauccuaacagauaccucacgaccaggcgacaaaagcacuggcgauugcaguaaucccauaacggggucuccuggagccccaggugugaagggcuuuggguaccucaacggagacaauacauggcugggcagaaccauuuccccgaggagccggucggguuucgagaugcuuaaaauccccaacgcugggacugauccuaauucucguaucaccgaacgccaggagauuguugacaacaacaauugguccggcuauucaggaaguuuuguggacuacuggaacgauaauagcgaauguuauaacccaugcuucuacgucgagcugaucagaggcaggcccgaagaggccaaguaugugugguggacauccaauucuauuauagcauugugugggagcccuuuuccaguaggaucagguaguuuccccgacggcgcucagauccaguacuuuuccuga

SEQ ID NO: 145650 - RNA, 1416 nt, Artificial Sequence
  derived and/or modified sequence opt3 from neuraminidase__InfluenzaA__AGQ81876
augaaccccaaucagaagcuguucgcccucagcggcguggcuaucgcacuuuccguccugaacuuguuaauugggauaucuaauguuggacugaacgugucacuacaccucaaagagaaggguccuaaacaagaagagaauaguaccugcaugacaaucaaccagaauaacacuacgguaguggaaaauaccuacgucaacaauacaacuauuaucaccaaggagacagaacuggagaccccaagcuaucuucuguugaacaaaggccucuguaauguggagggguggguugugauugccaaggacaacgcggucagauuuggagaaacugagcagaucauagugacaagggaaccguacguauccugcgaucccaauggcuguaagauguaugcucugcaucaggguaccacgauccggaacaaacacucuaacgggacuauucaugaccgcaccgccuuccgaggacugaucucgacaccucucggcacuccacccaccguuucaaauagcgauuuuauuugcgugggcuggaguuccacaaccugucacgacgggaucggacguaugacgauaugcauucaaggugauaacgacaaugcaacugccacagucuacuauaacagaagguuaaccacuacaaucaagaccugggcucggaauauucugcgcacgcaggagucugagugugugugccauaacggcaccugugcaguggucaugacagaugggagcgccuccucacaggcucacacuaaaguuaucuacuuccacaagggacuuaucgugaaagaagaggccuugaagggcagugcgagacauauugaagagugcagcuguuauggucacucucagaagguaaccugcgugugcagggacaauuggcaaggggcaaaccggccuauaaucgaaauugauaugaauacacuggagcauacuucccgcuacgucuguaccggaauccuaacagacaccucacgaccaggcgauaaaagcacuggcgacugcaguaaccccauaacggggucuccuggagccccaggugugaagggcuuuggguaccucaauggagauaacacauggcugggcagaaccauuuccccgaggagccggucggguuucgagaugcuuaaaauccccaaugcugggacugacccuaacucucguaucaccgaacgccaggagauuguugacaauaacaacugguccggcuauucaggaaguuuuguggauuacuggaaugacaacagcgaauguuauaauccaugcuucuacgucgagcugaucagaggcaggcccgaagaggccaaguaugugugguggacauccaacucuauuauagcauugugugggagcccuuuuccaguaggaucagguaguuuccccgauggcgcucagauccaguacuuuuccuga

SEQ ID NO: 145651 - RNA, 1416 nt, Artificial Sequence
  derived and/or modified sequence opt3 from neuraminidase__InfluenzaA__AGQ81877
augaaccccaaucagaagcuguucgcccucagcggcguggcuaucgcacuuuccguccugaacuuguuaauugggauaucuaauguuggacugaacgugucacuacaccucaaagagaaggguccuaaacaagaagagaauaguacuugcacaacuaucaaccagaauaacacgaccguaguggaaaauacauacgucaacaauacuaccauuaucacaaaggagaccgaacugaaaacuccaagcuaucuucuguugaacaagucccucuguaauguggagggcuggguugugauugccaaggacaacgcggucagauuuggggagucugaacagaucauagugacaagggagccguacguaucgugcgaucccaccggauguaaaauguaugcucugcaucagggcacgacuauccggaauaagcacucaaacgguaccauucaugaccgcacagccuuccgagggcugaucagcacuagccucggaaccccuccaacaauuuccaacucugauuuuaugugcguuggcuggagcuccaccacgugucacgacggcaucgggcguaugacuauaugcauucaaggaaauaacgauaaugcaacagccaccguguacuauaacagaagguuaacuacaaccaucaaaacgugggcucggaauauucugcgcacccaggaaucagagugugucugccauaacgguaucugugcaguggugaugacagacggcagugccagcucucaggcuuacacuaaggucauguauuuccacaaagggcuuguugugaaggaggaagccuugaagggauccgcgagacacaucgaggaaugcucauguuacggccauagccagaaaguaaccugcgugugcagggauaauuggcaaggugcaaaccggcccauuauagagaucgacaugaauacacuggaacacaccagucgcuacgucuguacugggauucuaacagauaccucucgaccuggagacaaguccagcggcgauugcucgaacccaaucacuggcucucccggggccccuggagugaaagguuuuggcuuccucaauggggacaacacguggcugggaagaacaauauccccaaggucacggaguggcuuugagaugcuuaagauuccgaaugcugguaccgaucccaacagccguaucgccgggcgccaggagaucguugacaauaacaacugguccggcuauucuggaaguuucauugacuacuggaaugauaacucagaauguuauaauccuugcuuuuacguggagcugaucagaggcaggccagaagaggcaaaauaugucugguggaccaguaacuccuugauugcucucugugggagccccuucccugugggaucugguucauuuccagacggcgcccagauacaguacuucaguuga

SEQ ID NO: 145652 - RNA, 1416 nt, Artificial Sequence
  derived and/or modified sequence opt3 from neuraminidase__InfluenzaA__AGQ81878
augaaccccaaucagaagcuguucgcccucagcggcguggcuaucgcacuuuccguccugaacuuguuaauugggauaucuaauguuggacugaacgugucacuacaccucaaagagaaggguccuaaacaagaagagaaucugaccugcacaacuaucaaccagaauaacacgaccguaguggaaaauacauacgucaacaauacuaccauuaucacaaaggagaccgaccuuaaagccccaaguuaucuguugcucaacaagagccuguguaauguggaaggcuggguugugauugcgaaggauaacgcugucagauuuggggaguccgagcagaucauagugacuagggaaccguacguaucuugcgaccccacaggauguaaaauguaugcccugcaucagggcaccacgauccggaauaagcacucgaacgguacuauucaugaucgcaccgcauuccgagggcucaucucaacaccuuuaggaacuccacccaccguuagcaacagugacuuuaugugcgugggcugguccucuacaaccugucacgauggcauugggcguaugacgaucugcauacaaggaaauaacgacaaugccacugcuacagucuacuauaacagaaggcugaccacuacaauuaaaaccugggcacggaauauccuucgcacgcaggagagcgaaugugugugccauaacgguaccugugccguggucaugacagauggcuccgcuucaagucaggccuacacuaagguuauguauuuccacaaaggguuggugguaaaggaggaggcgcugaagggaagcgcaagacacauugaagagugcucuuguuacggccauucccagaaagugaccugcgucugcagggacaauuggcaaggugccaaccggccuaucaucgaaauugauaugaauacacuagagcacacuucacgcuacguguguaccgggauacucacagacaccagccgaccaggagauaagaguucuggcgacugcuccaaccccaucacuggcagcccuggggcuccaggaguuaaagguuuuggcuuccugaauggggauaacacguggcuuggaagaacaauuucgccgaggucucgguccggcuuugaaaugcugaagauccccaaugccgguaccgacccuaacucacguauagcagagcgccaggagauuguggacaauaacaacuggaguggguauagcggcuccuucaucgauuacuggaaugacaacucugaauguuauaauccaugcuuuuacgucgaguugaucagaggaaggcccgaagaggcuaaauaugugugguggacuagcaacucacucauugcccuguguggcaguccuuucccaaucggguccgguagcuuucccgauggagcgcagauucaguacuucucuuga

SEQ ID NO: 145653 - RNA, 1416 nt, Artificial Sequence
  derived and/or modified sequence opt3 from neuraminidase__InfluenzaA__AGQ81882
augaaccccaaucagaagcuguucgcccucagcggcguggcuaucgcacuuuccguccugaacuuguuaauugggauaucuaauguuggacugaacgugucacuacaccucaaagagaagggugccaaacaagaagagaaucugaccugcacaacuaucaaccagaauaacacgaccguaguggaaaauacauacgucaacaauacuaccgugauuacaaaggaggcggacuggaaaaccccuaguuaucuucuguugaacaagagccucuguaauguugaaggcuggguggucaucgcuaaggauaacgccauuagauuuggggaguccgagcagaucauagugacuagggaaccauacguaucuugcgacccgacaggauguaaaauguaugcacugcaucagggcaccacgauccggaauaagcacucgaacgguacuauucaugaucgcaccgccuuccgagggcugaucucaacaccccucggaacuccuccaaccguuagcaacagugacuuuaugugcgugggcugguccucuacaaccugucacgauggcauugggcguaugacgaucugcauacaaggaaauaacgacaaugcuacugcaacagucuacuauaacgguagauuaaccacuacaauuaaaaccugggccaggaauauccugcggacgcaggagagcgaaugugugugccauaacggcaccugugcuguggucaugacagauggguccgccucaagucaggcguacacuaagguuauguauuuccacaaaggacuugugauuaaggaggaggcauugaagggcagcgcccgccacaucgaagagugcucuuguuacggucauucccagaaaguaaccugcgugugcagagacaauuggcaaggggcuaacaggcccaucauugaaauagauaugaauacacuggagcacacuucacgguacgucuguaccggaauccuaacagacaccagccgcccuggcgauaagaguucuggcgacugcuccaacccaauuacugggagccccggagccccuggugugaaaggcuuuggguuccucaauggagauaacacguggcugggccgaacaaucucgccaagaucuagguccgguuuugaaaugcuuaagauaccgaaugcagggauugaccccaacucacggaucgcugagcgucaggagaucguugacaauaacaacuggaguggcuauagcggauccuucauugauuacuggaaugacaacucugaauguuauaauccuugcuuuuacguggagcugauccgcggcagaccagaagaggccaaauaugucugguggaccagcaacucauugauugcgcucugugggagucccuucccugugggauccgguagcuuuccagauggcgcccagauacaguacuucucuuga

SEQ ID NO: 145654 - RNA, 1416 nt, Artificial Sequence
  derived and/or modified sequence opt3 from neuraminidase__InfluenzaA__AGQ81883
augaaccccaaucagaagcuguucgcccucagcggcguggcuaucgcacuuuccguccugaacuuguuaauugggauaucuaauguuggacugaacgugucacuacaccucaaagagaaggguccuaaacaagaagagaaucugaccugcacaacuaucaaccagaauaacacgaccguaguggaaaauacauacgucaacaauacuaccgugauuacaaaggaggccgacuggaaaaccccaaguuaucuucuguugaacaagagccucuguaauguugaaggcuggguggucaucgcgaaggauaacgcuauuagauuuggggaguccgagcagaucauagugacuagggaaccguacguaucuugcgaccccacaggauguaaaauguaugcccugcaucagggcaccacgauccggaauaagcacucgaacgguacuauucaugaucgcaccgcauuccgagggcugaucucaacaccucucggaacuccacccaccguuagcaacagugacuuuaugugcgugggcugguccucuacaaccugucacgauggcauugggcguaugacgaucugcauacaaggaaauaacgacaaugccacugcuacagucuacuauaacgguagauuaaccacuacaauuaaaaccugggcaaggaauauccugcggacgcaggagagcgaaugugugugccauaacggcaccugugccguggucaugacagauggguccgcuucaagucaggccuacacuaagguuauguauuuccacaaaggacuugugauuaaggaggaggcguugaagggcagcgcacgccacaucgaagagugcucuuguuacggucauucccagaaaguaaccugcgugugcagagacaauuggcaaggggccaacaggccuaucauugaaauagauaugaauacacuggagcacacuucacgguacgucuguaccggaauccuaacagacaccagccgcccaggcgauaagaguucuggcgacugcuccaaccccauuacugggagcccuggagcuccaggugugaaaggcuuuggguuccucaauggagauaacacguggcugggccgaacaaucucgccgagaucuagguccgguuuugaaaugcuuaagauacccaaugccgggauugacccuaacucacggaucgcagagcgucaggagaucguugacaauaacaacuggaguggcuauagcggauccuucauugauuacuggaaugacaacucugaauguuauaauccaugcuuuuacguggagcugauccgcggcagacccgaagaggcuaaauaugucugguggaccagcaacucauugauugcccucugugggaguccuuucccagugggauccgguagcuuucccgauggcgcgcagauacaguacuucucuuga

SEQ ID NO: 145655 - RNA, 1416 nt, Artificial Sequence; identical to SEQ ID NO: 145654
  derived and/or modified sequence opt3 from neuraminidase__InfluenzaA__AGQ81884

SEQ ID NO: 145656 - RNA, 1416 nt, Artificial Sequence; identical to SEQ ID NO: 145654
  derived and/or modified sequence opt3 from neuraminidase__InfluenzaA__AGQ81885

SEQ ID NO: 145657 - RNA, 1416 nt, Artificial Sequence; identical to SEQ ID NO: 145654
  derived and/or modified sequence opt3 from neuraminidase__InfluenzaA__AGQ81886

SEQ ID NO: 145658 - RNA, 1356 nt, Artificial Sequence
  derived and/or modified sequence opt3 from neuraminidase__InfluenzaA__AGQ81888
augaaccccaaucagaagcuguucgcccucagcggcguggcuaucgcacuuuccguccugaacuuguuaauugggcugucuaauguuggacuaaacgugucacuccaccugaaagaggccgguccuaagcaagaagagaaucuuaccugcaugacaacuaaagaaacggagcugggcaccccaaguuacuugcuccugaacaagagccuguguaauguagaaggguggguggucauagcgaaagacaacgcugugagauuuggagaguccgagcagaucauuaucacaagggaaccguauguuucuugcgaucccaauggcuguaagauguacgcccuccaucaggguacuaccauucggaacaagcacucgaaugggacaauccaugaccgcaccgcauuccgaggauuaauaucaacuccucugggcacaccacccaccgugagcaacagugauuuuaucugcgucggcugguccucuacgacuugucacgacgggauuggacguaugaccaucugcauucaggguaauaacgauaaugccacagcuacuguguauuacaacagaaggcuuaccacaaccaucaaaacgugggcacggaacauauugcgcacucaagagagcgaauguguaugccauaauggcacaugugccguugugaugaccgacggguccgcuucaagucaggcccacacuaaggucauguauuuccacaaaggacugguggugaaggaggaggcgcuaaaaggcagcgcaaagcauauugaagagugcucuuguuacggucacaaccagaaggucacaugcguuugcagagauaauuggcagggggccaacaggccuaucauugaaaucgacaugaauacccucgagcauacgucccgguauguguguaccggaauccugacagauacuucacgcccaggcgacaaacccaccggcgauugcagcaacccuauuacagggaguccaggagcuccggguguaaagggcuuuggguuccuuaauggagacaacacuuggcugggccgaaccauaucucccagauccaggagcgguuuugaaauguugaaaaucccuaaugccgggauugauccaaacucgcggaucgcagagcgucaagagauaguggacaauucuaacugguccggcuacucaggaaguuucauugacuacuggaaugauaacagcgaauguuauaaucccugcuuuuacgucgagcucauccgcggcagaccugaagaggcuaaguaugugugguggacauccaacucucugaucgccuuaugugggagcccauuccccguuggaucagguaguuuuccggacggcgcgcagauucaguacuucuccuga

SEQ ID NO: 145659 - RNA, 1356 nt, Artificial Sequence
  derived and/or modified sequence opt3 from neuraminidase__InfluenzaA__AGQ81889
augaaccccaaucagaagcuguucgcccucagcggcguggcuaucgcacuuuccguccugaacuuguuaauugggcugucuaauguuggacuaaacgugucacuccaccugaaagagaccgguccuaagcaagaagagaaucuuacaugcaugacuacgaaagaaaccgagcugggcacaccaaguuacuugcuccugaacaagagccuguguaauguagaaggguggguggucauagccaaagacaacgcggugagauuuggagaguccgagcagaucauuaucacuagggaaccguauguuucuugcgaucccaauggcuguaagauguacgcucuccaucaggguaccacaauucggaacaagcacucgaaugggaccauccaugaccgcacugccuuccgaggauuaauaucaacaccucugggcaccccacccacggugagcaacagugauuuuaucugcgucggcugguccucuacuaccugucacgacgggauuggacguaugacaaucugcauucaggguaauaacgauaaugcaacugccaccguguauuacaacagaaggcuuacaaccacgaucaaaacuugggcucggaacauauugcgcacacaagagagcgaauguguaugccauaauggcaccugugcaguugugaugacugacggguccgccucaagucaggcucacacaaaggucauguauuuccacaaaggacugguggugaaggaggaggcccuaaaaggcagcgcgaagcauauugaagagugcucuuguuacggucacaaccagaagguuaccugcgucugcagagauaauuggcagggggcaaacaggccuaucauugaaaucgacaugaauacgcucgagcauaccucccgguauguguguacaggaauccugacugauaccucacgcccaggcgacaaacccacaggcgauugcagcaacccuauuacugggaguccaggagccccggguguaaagggcuuuggguuccuuaauggagacaacaccuggcugggccgaacaauaucucccagauccaggagcgguuuugaaauguugaaaaucccuaaugcugggauugauccaaacucgcggaucgccgagcgucaagagauaguggacaauucuaacugguccggcuacucaggaaguuucauugacuacuggaaugauaacagcgaauguuauaaucccugcuuuuacgucgagcucauccgcggcagaccugaagaggcaaaguaugugugguggaccuccaacucucugaucgcuuuaugugggagcccauuccccguuggaucagguaguuuuccggacggcgcccagauucaguacuucuccuga

SEQ ID NO: 145660 - RNA, 1356 nt, Artificial Sequence; identical to SEQ ID NO: 145659
  derived and/or modified sequence opt3 from neuraminidase__InfluenzaA__AGQ81890

SEQ ID NO: 145661 - RNA, 1356 nt, Artificial Sequence; identical to SEQ ID NO: 145659
  derived and/or modified sequence opt3 from neuraminidase__InfluenzaA__AGQ81891

SEQ ID NO: 145662 - RNA, 1356 nt, Artificial Sequence
  derived and/or modified sequence opt3 from neuraminidase__InfluenzaA__AGQ81893
augaaccccaaucagaagcuguucgcccucagcggcguggcuaucgcacuuuccguccugaacuuguuaauugggcugucuaauguuggacuaaacgugucacuccaccugaaagagaccgguccuaagcaagaagagaaucuuacaugcaugacuacgaaagaaaccgagcugggcacaccaaguuacuugcuccugaacaagagccuguguaauguagaaggguggguggucauagccaaagacaacgcggugagauuuggagaguccgagcagaucauuaucacuagggaaccguauguuucuugcgaucccaauggcuguaagauguacgcucuccaucaggguaccacaauucggaacaagcacucgaaugggaccauccaugaccgcacugccuuccgaggauuaauaucaacaccucugggcaccccacccacggugagcaacagugauuuuaucugcgucggcugguccucuacuaccugucacgacgggauuggacguaugacaaucugcauucaggguaauaacgauaaugcaacugccaccguguauuacaacagaaggcuuacaaccacgaucaaaacuugggcucggaacauauugcgcacacaagagagcgaauguguaugccauaauggcaccugugcaguugugaugacugacggguccgccucaagucaggcucacacaaaggucauguauuuccacaaaggacugguggugaaggaggaggcccuaaaaggcagcgcgaagcauauugaagagugcucuuguuacggucacaaccagaagguuaccugcgucugcagagauaauuggcagggggcaaacaggccuaucauugaaaucgacaugaauacgcucgagcauaccucccgguauguguguacaggaauccugacugauaccucacgcccaggcgacaaacccacaggcgauugcagcaacccuauuacugggaguccaggagccccggguguaaagggcuuuggguuccuuaauggagacaacaccuggcugggccgaacaauaucucccagauccaggagcgguuuugaaauguugaaaaucccuaaugcugggauugauccaaacucgcggaucgccgagcgucaagagauaguggacaauucuaacugguccggcuacucaggaaguuucauugacuacuggaaugauaacagcgaauguuauaaucccugcuuuuacgucgagcucauccgcggcagaccugaagaggcagaauaugugugguggaccuccaacucucugaucgcuuuaugugggagcccauuccccguuggaucagguaguuuuccggacggcgcccagauucaguacuucuccuga

SEQ ID NO: 145663 - RNA, 1356 nt, Artificial Sequence; identical to SEQ ID NO: 145659
  derived and/or modified sequence opt3 from neuraminidase__InfluenzaA__AGQ81894

SEQ ID NO: 145664 - RNA, 1356 nt, Artificial Sequence; identical to SEQ ID NO: 145659
  derived and/or modified sequence opt3 from neuraminidase__InfluenzaA__AGQ81895

SEQ ID NO: 145665 - RNA, 1356 nt, Artificial Sequence; identical to SEQ ID NO: 145659
  derived and/or modified sequence opt3 from neuraminidase__InfluenzaA__AGQ81896

SEQ ID NO: 145666 - RNA, 1356 nt, Artificial Sequence; identical to SEQ ID NO: 145659
  derived and/or modified sequence opt3 from neuraminidase__InfluenzaA__AGQ81897

SEQ ID NO: 145667 - RNA, 1356 nt, Artificial Sequence; identical to SEQ ID NO: 145659
  derived and/or modified sequence opt3 from neuraminidase__InfluenzaA__AGQ81898

SEQ ID NO: 145668 - RNA, 1356 nt, Artificial Sequence; identical to SEQ ID NO: 145659
  derived and/or modified sequence opt3 from neuraminidase__InfluenzaA__AGQ81899

SEQ ID NO: 145669 - RNA, 1356 nt, Artificial Sequence; identical to SEQ ID NO: 145659
  derived and/or modified sequence opt3 from neuraminidase__InfluenzaA__AGQ81900

SEQ ID NO: 145670 - RNA, 1356 nt, Artificial Sequence; identical to SEQ ID NO: 145659
  derived and/or modified sequence opt3 from neuraminidase__InfluenzaA__AGQ81901

SEQ ID NO: 145671 - RNA, 1356 nt, Artificial Sequence; identical to SEQ ID NO: 145659
  derived and/or modified sequence opt3 from neuraminidase__InfluenzaA__AGQ81902

SEQ ID NO: 145672 - RNA, 1356 nt, Artificial Sequence; identical to SEQ ID NO: 145659
  derived and/or modified sequence opt3 from neuraminidase__InfluenzaA__AGQ81903

SEQ ID NO: 145673 - RNA, 1356 nt, Artificial Sequence
  derived and/or modified sequence opt3 from neuraminidase__InfluenzaA__AGQ81904
augaaccccaaucagaagcuguucgcccucagcggcguggcuaucgcacuuuccguccugaacuuguuaauugggcugucuaauguuggacuaaacgugucacuccaccugaaagagaccgguccuaagcaagaagagaaucuuacaugcaugacuacgaaagaaaccgagcugggcacaccaaguuacuugcuccugaacaagagccuguguaauguagaaggguggguggucauagccaaagacaacgcggugagauuuggagaguccgagcagaucauuaucacuagggaaccguauguuucuugcgaucccaauggcuguaagauguacgcucuccaucaggguaccacaauucggaacaagcacucgaaugggaccauccaugaccgcacugccuuccgaggauuaauaucaacaccucugggcaccccacccacggugagcaacagugauuuuaucugcgucggcugguccucuacuaccugucacgacgggauuggacguaugacaaucugcauucaggguaauaacgauaaugcaacugccaccguguauuacaacagaaggcuuacaaccacgaucaaaacuugggcucggaacauauugcgcacacaagagagcgaauguguaugccauaauggcaccugugcaguugugaugacugacggguccgccucaagucaggcucacacaaaggucauguauuuccacaaaggacugguggugaaggaggaggcccuaaaaggcagcgcgaagcauauugaagagugcucuuguuacggucacaaccagaagguuaccugcgucugcagagauaauuggcagggggcaaacaggccuaucauugaaaucgacaugaauacgcucgagcauaccucccgguauguguguacaggaauccugacugauaccucacgcccaggcgacaaacccacaggcgauugcagcaacccuauuacugggaguccaggagccccggguguaaagggcuuuggguuccuuaauggagacaacaccuggcugggccgaacaauaucucccagauccaggagcgguuuugaaauguugaaaaucccuaaugcugggauugauccaaacucgcggaucaccgagcgucaagagauaguggacaauucuaacugguccggcuacucaggaaguuucauugacuacuggaaugauaacagcgaauguuauaaucccugcuuuuacgucgagcucauccgcggcagaccugaagaggccaaguaugugugguggacuuccaacucucugaucgcauuaugugggagcccauuccccguuggaucagguaguuuuccggacggcgcucagauucaguacuucuccuga

SEQ ID NO: 145674 - RNA, 1356 nt, Artificial Sequence; identical to SEQ ID NO: 145659
  derived and/or modified sequence opt3 from neuraminidase__InfluenzaA__AGQ81905

SEQ ID NO: 145675 - RNA, 1356 nt, Artificial Sequence
  derived and/or modified sequence opt3 from neuraminidase__InfluenzaA__AGQ81906
augaaccccaaucagaagcuguucgcccucagcggcguggcuaucgcacuuuccguccugaacuuguuaauugggcugucuaauguuggacuaaacgugucacuccaccugaaagagaccgguccuaagcaagaagagaaucuuacaugcaugacuacgaaagaaaccgagcugggcacaccaaguuacuugcuccugaacaagagccuguguaauguagaaggguggguggucauagccaaagacaacgcggugagauuuggagaguccgagcagaucauuaucacuagggaaccguauguuucuugcgaucccaauggcuguaagauguacgcucuccaucaggguaccacaauucggaacaagcacucgaaugggaccauccaugaccgcacugccuuccgaggauuaauaucaacaccucugggcaccccacccacggugagcaacagugauuuuaucugcgucggcugguccucuacuaccugucacgacgggauuggacguaugacaaucugcauucaggguaauaacgauaaugcaacugccaccguguauuacaacagaaggcuuacaaccacgaucaaaacuugggcucggaacauauugcgcacacaagagagcgaauguguaugccauaauggcaccugugcaguugugaugacugacggguccgccucaagucaggcucacacaaaggucauguauuuccacaaaggacugguggugaaggaggaggcccuaaaaggcagcgcgagacauauugaagagugcucuuguuacggucacaaccagaagguuaccugcgucugcagggauaauuggcagggggcaaaccggccuaucauugaaaucgacaugaauacgcucgagcauaccucccgcuauguguguacaggaauccugacugauaccucacgaccaggcgacaagcccacaggcgauugcagcaacccuauuacugggaguccaggagccccggguguaaaaggcuuuggguuccuuaauggagacaacaccuggcugggcagaacaauaucucccaggucccggagcgguuuugaaauguugaagaucccuaaugcugggauugauccaaacucgcguaucgccgagcgccaagagauaguggacaauucuaacugguccggcuacucaggaaguuucauugacuacuggaaugauaacagcgaauguuauaaucccugcuuuuacgucgagcucaucagaggcaggccugaagaggcaaaauaugugugguggaccuccaacucucugaucgcuuuaugugggagcccauuccccguuggaucagguaguuuuccggacggcgcccagauucaguacuucuccuga

SEQ ID NO: 145676 - RNA, 1356 nt, Artificial Sequence; identical to SEQ ID NO: 145659
  derived and/or modified sequence opt3 from neuraminidase__InfluenzaA__AGQ81907

SEQ ID NO: 145677 - RNA, 1356 nt, Artificial Sequence
  derived and/or modified sequence opt3 from neuraminidase__InfluenzaA__AGQ81908
augaaccccaaucagaagcuguucgcccucagcggcguggcuaucgcacuuuccguccugaacuuguuaauugggcugucuaauguuggacuaaacgugucacuccaccugaaagagaccgguccuaagcaagaagagaaucuuacaugcaugacuacgaaagaaaccgagcugggcacaccaaguuacuugcuccugaacaagagccuguguaauguagaaggguggguggucauagccaaagacaacgcggugagauuuggagaguccgagcagaucauuaucacuagggaaccguauguuucuugcgaucccaauggcuguaagauguacgcucuccaucaggguaccacaauucggaacaagcacucgaaugggaccauccaugaccgcacugccuuccgaggauuaauaucaacaccucugggcaccccacccacggugagcaacagugauuuuaucugcgucggcugguccucuacuaccugucacgacgggauuggacguaugacaaucugcauucaggguaauaacgauaaugcaacugccaccguguauuacaacagaaggcuuacaaccacgaucaaaacuugggcucggaacauauugcgcacacaagagagcgaauguguaugccauaauggcaccugugcaguugugaugacugacggguccgccucaaaccaggcucacacaaaggucauguauuuccacaaaggacugguggugaaggaggaggcccuaaaaggcagugcgaagcauauugaagagugcagcuguuacggucacaaucagaagguuaccugcgucugcagagauaacuggcagggggcaaauaggccuaucauugaaaucgacaugaacacgcucgagcauaccucucgguauguguguacaggaauccugacugauaccucccgcccaggcgacaaacccacaggcgauugcucaaauccuauuacugggagcccaggagccccggguguaaagggcuuuggguuccuuaacggagacaauaccuggcugggccgaacaauaagucccagaucuagguccgguuuugaaauguugaaaaucccuaacgcugggauugauccaaauagccggaucaccgagcgucaagagauaguggacaacucgaauuggucuggcuacuccggaucauucauugacuacuggaacgauaauagugaauguuauaaccccugcuuuuacgucgagcucauccgcggcagaccugaagaggccaaguaugugugguggacuagcaacucccugaucgcauuaugugggucuccauuccccguuggaagcgguucauuuccggacggcgcucagauucaguacuucaguuga

SEQ ID NO: 145678 - RNA, 1356 nt, Artificial Sequence; identical to SEQ ID NO: 145659
  derived and/or modified sequence opt3 from neuraminidase__InfluenzaA__AGQ81909

SEQ ID NO: 145679 - RNA, 1356 nt, Artificial Sequence
  derived and/or modified sequence opt3 from neuraminidase__InfluenzaA__AGQ81910
augaaccccaaucagaagcuguucgcccucagcggcguggcuaucgcacuuuccguccugaacuuguuaauugggcugucuaauguuggacuaaacgugucacuccaccugaaagagaccgguccuaagcaagaagagaaucuuacaugcaugacuacgaaagaaaccgagcugggcacaccaaguuacuugcuccugaacaagagccuguguaauguagaaggguggguggucauagccaaagacaacgcggugagauuuggagaguccgagcagaucauuaucacuagggaaccguauguuucuugcgaucccaauggcuguaagauguacgcucuccaucaggguaccacaauucggaacaagcacucgaaugggaccauccaugaccgcacugccuuccgaggauuaauaucaacaccucugggcaccccacccacggugagcaacagugauuuuaucugcgucggcugguccucuacuaccugucacgacgggauuggacguaugacaaucugcauucaggguaauaacgauaaugcaacugccaccguguauuacaacagaaggcuuacaaccacgaucaaaacuugggcucggaacauauugcgcacacaagagagcgaauguguaugccauaauggcaccugugcaguugugaugacugacggguccgccucaggacaggcucacacaaaggucauguauuuccacaaaggccugguggugaaggaggaggcccuaaaagguagugcgaagcauauugaagagugcagcuguuacgggcacaaccagaagguuaccugcgucugcagagauaauuggcagggagcaaacaggccuaucauugaaaucgacaugaauacgcucgagcauaccucuuccuauguguguacaggcauccugacugauaccucacggccaggcgacaaacccacaggggauugcagcaacccuauuacuggaaguccaggugccccgggcguaaagggguuuggauuccuuaauggcgacaacaccuggcugggucgcacaauaucuccccgauccagaagcggguuugaaauguugaaaaucccuaaugcuggcauugauccaaacucgaggaucgccgagcggcaagagauaguggacaauucuaacugguccggauacucaggcaguuucauugacuacuggaaugauaacagcgaauguuauaaucccugcuuuuacgucgagcucauccgugggcgcccugaagaggcaaaguaugugugguggaccuccaacucucugaucgcuuuauguggaagcccauuccccguugguucaggcaguuuuccggacggggcccagauucaguacuucuccuga

SEQ ID NO: 145680 - RNA, 1356 nt, Artificial Sequence
  derived and/or modified sequence opt3 from neuraminidase__InfluenzaA__AGQ81911
augaaccccaaucagaagcuguucgcccucagcggcguggcuaucgcacuuuccguccugaacuuguuaauugggcugucuaauguuggacuaaacgugucacuccaccugaaagagaccgguccuaagcaagaagagaaucuuacaugcaugacuacgaaagaaaccgagcugggcacaccaaguuacuugcuccugaacaagagccuguguaauguagaaggguggguggucauagccaaagacaacgcggugagauuuggagaguccgagcagaucauuaucacuagggaaccguauguuucuugcgaucccaauggcuguaagauguacgcucuccaucaggguaccacaauucggaacaagcacucgaaugggaccauccaugaccgcacugccuuccgaggauuaauaucaacaccucugggcaccccacccacggugagcaacagugauuuuaucugcgucggcugguccucuacuaccugucacgacgggauuggacguaugacaaucugcauucaggguaauaacgauaaugcaacugccaccguguauuacaacagaaggcuuacaaccacgaucaaaacuugggcucggaacauauugcgcacacaagagagcgaauguguaugccauaauggcaccugugcaguugugaugacugacggguccgccucaggacaggcucacacaaaggucauguauuuccacaaaggccugguggugaaggaggaggcccuaaaagguagugcgaagcauauugaagagugcagcuguuacgggcacaaccagaauguuaccugcgucugcagagauaacuggcagggagcaaauaggccuaucauugaaaucgacaugaacacgcucgagcauaccucucgguauguguguacaggcauccugacugauaccucccgcccaggcgacaagcccacaggggauugcucaaauccuauuacuggaagcccaggugccccgggcguaaaaggguuuggauuccuuaacggcgacaauaccuggcugggucgaacaauaagucccagaucuagguccggguuugaaauguugaagaucccuaacgcuggcauugauccaaauagccggaucgccgagcgucaagagauaguggacaacucgaauuggucuggauacuccggcucauucauugacuacuggaacgauaauagugaauguuauaaccccugcuuuuacgucgagcucauccgcgggagaccugaagaggcaaaauaugugugguggaccagcaacucccugaucgcuuuauguggaucuccauuccccguugguagcggcucauuuccggacggggcccagauucaguacuucaguuga

SEQ ID NO: 145681 - RNA, 1356 nt, Artificial Sequence; identical to SEQ ID NO: 145659
  derived and/or modified sequence opt3 from neuraminidase__InfluenzaA__AGQ81912

SEQ ID NO: 145682 - RNA, 1356 nt, Artificial Sequence
  derived and/or modified sequence opt3 from neuraminidase__InfluenzaA__AGQ81913
augaaccccaaucagaagcuguucgcccucagcggcguggcuaucacccuuuccguccugaacuuguuaauugggcugucuaauguuggacuaaacgugucacuccaccugaaagagacagguccuaagcaagaagagaaucuuacuugcaugacgaccaaagaaacagagcugggcacuccaaguuacuugcuccugaacaagagccuguguaauguagaaggguggguggucauagcaaaagacaacgccgugagauuuggagaguccgagcagaucauuaucaccagggaaccguauguuucuugcgaucccaauggcuguaagauguacgcgcuccaucaggguacaaccauucggaacaagcacucgaaugggacuauccaugaccgcacagcuuuccgaggauuaauaucaaccccucugggcacgccacccacugugagcaacagugauuuuaucugcgucggcugguccucuaccacaugucacgacgggauuggacguaugacuaucugcauucaggguaauaacgauaaugccaccgcaacaguguauuacaacagaaggcuuaccacgacuaucaaaacaugggcccggaacauauugcgcacccaagagagcgaauguguaugccauaauggcacuugugcuguugugaugacagacggguccgcaucaggacaggcccacaccaaggucauguauuuccacaaaggccugguggugaaggaggaggcucuaaaagguagugccaagcauauugaagagugcagcuguuacgggcacaaccagaaggucacgugcguuugcagagauaauuggcagggagcgaacaggccuaucauugaaaucgacaugaauacccucgagcauacaucucgguauguguguacuggcauccugaccgauacaucccgcccaggcgacaaacccacuggggauugcucaaacccuauuaccggaagcccaggugcaccgggcguaaagggguuuggauuccuuaauggcgacaacacauggcugggucgaaccauaagucccagaucuagguccggguuugaaauguugaaaaucccuaaugccggcauugauccaaacagccggaucgcugagcgucaagagauaguggacaauucgaacuggucuggauacuccggcucauucauugacuacuggaaugauaacagugaauguuauaaucccugcuuuuacgucgagcucauccgcgggagaccugaagaggccaaguaugugugguggacuagcaacucccugaucgcauuauguggaucuccauuccccguugguagcggcucauuuccggacggggcucagauucaguacuucaguuga

SEQ ID NO: 145683 - RNA, 1356 nt, Artificial Sequence; identical to SEQ ID NO: 145659
  derived and/or modified sequence opt3 from neuraminidase__InfluenzaA__AGQ81914

SEQ ID NO: 145684 - RNA, 1356 nt, Artificial Sequence; identical to SEQ ID NO: 145659
  derived and/or modified sequence opt3 from neuraminidase__InfluenzaA__AGQ81915

SEQ ID NO: 145685 - RNA, 1416 nt, Artificial Sequence
  derived and/or modified sequence opt3 from neuraminidase__InfluenzaA__AGQ81917
augaaccccaaucagaagcuguucgcccucagcggcguggcuaucgcacuuuccguccugaacuuguuaauugggcugucuaauguuggacuaaacgugucacuccaccugaaagagaccgguccuaagcaagaagagaaucuuacaugcaugacuauaaaccagaauaacacgaccguaguggaaaauacauacgucaacaauacuaccaucauuacaaaagagaccgaacuggagacuccaaacuauuugcuccugaauaagagucuguguaacguggagggcuggguuguggucgccaaagacaaugcggugagauuuggggaaagcgagcagaucauuguaacaagggaaccguacguuuccugcgaucccaacggauguaagauguaugcucuccaucagggcaccacgauccggaacaagcacucuaaugguacuauacaugaccgcaccgccuuccgaggguuaaucucgacaccucugggaacuccacccaccgugucaaacagcgauuuuauuugcgucggcuggaguuccacaaccugucacgacggcaucgggcguaugacgauuugcauccaaggaaauaacgauaaugcaacugccacaguguacuauaacagaaggcuuaccacuacaauaaaaaccugggcucggaauauuuugcgcacgcaggagucugagugugugugccauaacgguaccugugcagucguuaugacagacggcagcgccuccucacaggcucacacuaaggugauguacuuccacaaagggcugguaaucaaggaagaggcccuaaaaggaagugcgaagcauauugaagagugcagcuguuauggccacaaucagaaggugaccugcgucugcagagauaacuggcaaggugcaaauaggccuaucaucgaaauugacaugaacacacucgagcauacuucucgguacguguguaccgggauacugacagauaccucccgcccaggagacaaacccacuggcgauugcucaaauccuaucacgggcagcccaggggccccgggaguuaaggguuuuggcuuccuuaacggggacaauacauggcugggacgaaccauuagucccagaucuagguccggcuuugagauguugaaaaucccuaacgcugguauagauccaaacagccggauugccgaacgucaggagaucguggacaauucgaacuggucuggguacuccggcucauucaucgacuauuggaaugauaacagugaauguuacaaucccugcuuuuaugucgagcucauucgcggaagaccugaagaggcaaaguacgugugguggacuagcaacucccugaucgcuuuauguggcucuccauuccccguagggagcggaucauuuccggacggugcccagauucaguauuucaguuga

SEQ ID NO: 145686 - RNA, 1356 nt, Artificial Sequence
  derived and/or modified sequence opt3 from neuraminidase__InfluenzaA__AGQ81918
augaaccccaaucagaagcuguucgcccucagcggcguggcuaucgcacuuuccguccugaacuuguuaauugggcugucuaauguuggacuaaacgugucacuccaccugaaagagaccgguccuaagcaagaagagaaucuuacaugcaugacuacgaaagaaaccgagcugggcacaccaaguuacuugcuccugaacaaggggcuguguaauguagaaggauggguggucauagccaaagacaacgcggugagauuuggcgagagcgagcagaucauuaucacuagggaaccguauguuuccugcgaucccaaugguuguaagauguacgcucuccaucaggggaccacaauucggaacaagcacucuaauggaaccauccaugaccgcacugccuuccgaggcuuaauaucgacaccucugggcaccccacccacggugucaaacagcgauuuuaucugcgucggguggaguuccacuaccugucacgacggaauuggucguaugacaaucugcauucagggcaauaacgauaaugcaacugccaccguguauuacaacagaaggcuuacaaccacgaucaaaacuugggcucggaacauauugcgcacacaagagucugaauguguaugccauaaugggaccugugcaguugugaugacugacggaagcgccuccucacaggcucacacaaaggucauguauuuccacaaaggccugguggugaaggaggaggcccuaaaagguagugcgaagcauauugaagagugcagcuguuacgggcacaaccagaagguuaccugcgucugcagagauaauuggcagggagcaaacaggccuaucauugaaaucgacaugaauacgcucgagcauaccucucgguauguguguacaggcauccugacugauaccucccgcccaggcgacaaacccacaggggauugcucaaacccuauuacuggaagcccaggugccccgggcguaaagggguuuggauuccuuaauggcgacaacaccuggcugggucgaacaauaagucccagaucuagguccggguuugaaauguugaaaaucccuaaugcuggcauugauccaaacagccggaucgccgagcgucaagagauaguggacaauucgaacuggucuggauacuccggcucauucauugacuacuggaaugauaacagugaauguuauaaucccugcuuuuacgucgagcucauccgcgggagaccugaagaggcaaaguaugugugguggaccagcaacucccugaucgcuuuauguggaucuccauuccccguugguagcggcucauuuccggacggggcccagauucaguacuucaguuga

SEQ ID NO: 145687 - RNA, 1356 nt, Artificial Sequence; identical to SEQ ID NO: 145659
  derived and/or modified sequence opt3 from neuraminidase__InfluenzaA__AGQ81919

SEQ ID NO: 145688 - RNA, 1356 nt, Artificial Sequence; identical to SEQ ID NO: 145659
  derived and/or modified sequence opt3 from neuraminidase__InfluenzaA__AGQ81920

SEQ ID NO: 145689 - RNA, 1356 nt, Artificial Sequence
  derived and/or modified sequence opt3 from neuraminidase__InfluenzaA__AGQ81921
augaaccccaaucagaagcuguucgcccucagcggcguggcuaucgcacuuuccguccugaacuuguuaauugggcugucuaauguuggacuaaacgugucacuccaccugaaagagaccgguccuaagcaagaagagaaucuuacaugcaugacuacgaaagaaaccgagcugggcacaccaaguuacuugcuccugaacaagagccuguguaauguagaaggguggguggucauagccaaagacaacgcggugagauuuggagaguccgagcagaucauuaucacuagggaaccguauguuucuugcgaucccaauggcuguaagauguacgcucuccaucaggguaccacaauucggaacaagcacucgaaugggaccauccaugaccgcacugccuuccgaggauuaauaucaacaccucugggcaccccacccacggugagcaacagugauuuuaucugcgucggcugguccucuacuaccugucacgacgggauuggacguaugacaaucugcauucaggguaauaacgauaaugcaacugccaccguguauuacaacagaaggcuuacaaccacgaucaaaacuugggcucggaacauauugcgcacacaagagagcgaauguguaugccauaauggcaccugugcaguugugaugacugacggguccgccucaggacaggcucacacaaaggucauguauuuccacaaaggccugguggugaaggaggaggcccuaaaagguagugcgaagcauauugaagagugcagcuguuacgggcacaaccagaagguuaccugcgucugcagagauaauuggcagggagcaaacaggccuaucauugaaaucgacaugaauacgcucgagcauaccucucgguauguguguacaggcauccugacugauaccucccgcccaggcgacaaacccacaggggauugcucaaacccuauuacuggaagcccaggugccccgggcguaaagggguuuggauuccuuaauggcgacaacaccuggcugggucgaacaauaagucccagaucuagguccggguuugaaauguugaaaaucccuaaugcuggcauugauccaaacagccggaucgccgagcgucaagagauaguggacaauucgaacuggucuggauacuccggcucauucauugacuacuggaaugauaacagugaauguuauaaucccugcuuuuacgucgagcucauccgcgggagaccugaagaggcaaaguaugugugguggaccagcaacucccugaucgcuuuauguggaucuccauuccccguugguagcggcucauuuccggacggggcccagauucaguacuucaguuga

SEQ ID NO: 145690 - RNA, 1356 nt, Artificial Sequence; identical to SEQ ID NO: 145659
  derived and/or modified sequence opt3 from neuraminidase__InfluenzaA__AGQ81922

SEQ ID NO: 145691 - RNA, 1356 nt, Artificial Sequence; identical to SEQ ID NO: 145689
  derived and/or modified sequence opt3 from neuraminidase__InfluenzaA__AGQ81923

SEQ ID NO: 145692 - RNA, 1356 nt, Artificial Sequence
  derived and/or modified sequence opt3 from neuraminidase__InfluenzaA__AGQ81924
augaaccccaaucagaagcuguucgcccucagcggcguggcuaucgcacuuuccguccugaacuuguuaauugggcugucuaauguuggacuaaacgugucacuccaccugaaagagaccgguccuaagcaagaagagaaucuuacaugcaugacuacgaaagaaaccgagcugggcacaccaaguuacuugcuccugaacaagagccuguguaauguagaaggguggguggucauagccaaagacaacgcggugagauuuggagaguccgagcagaucauuaucacuagggaaccguauguuucuugcgaucccaauggcuguaagauguacgcucuccaucaggguaccacaauucggaacaagcacucgaaugggaccauccaugaccgcacugccuuccgaggauuaauaucaacaccucugggcaccccacccacggugagcaacagugauuuuaucugcgucggcugguccucuacuaccugucacgacgggauuggacguaugacaaucugcauucaggguaauaacgauaaugcaacugccaccguguauuacaacagaaggcuuacaaccacgaucaaaacuugggcucggaacauauugcgcacacaagagagcgaauguguaugccauaauggcaccugugcaguugugaugacugacggguccgccaacucacaggcucacacaaaggucauguauuuccacaaaggacugguggugaaggaggaggcccuaaaaggcagugcgaagcauauugaagagugcagcuguuacggucacaaucagaagguuaccugcgucugcagagauaacuggcagggggcaaauaggccuaucauugaaaucgacaugaacacgcucgagcauaccucucgguauguguguacaggaauccugacugauaccucccgcccaggcgacaaacccacaggcgauugcucaaauccuauuacugggagcccaggagccccggguguaaagggcuuuggguuccuuaacggagacaauaccuggcugggccgaacaauaagucccagaucuagguccgguuuugaaauguugaaaaucccuaacgcugggauugauccaaauagccggaucgccgagcgucaagagauaguggacaacucgaauuggucuggcuacuccggaucauucauugacuacuggaacgauaauagugaauguuauaaccccugcuuuuacgucgagcucauccgcggcagaccugaagaggcaaaguaugugugguggaccagcaacucccugaucgcuuuaugugggucuccauuccccguuggaagcgguucauuuccggacggcgcccagauucaguacuucaguuga

SEQ ID NO: 145693 - RNA, 1356 nt, Artificial Sequence; identical to SEQ ID NO: 145659
  derived and/or modified sequence opt3 from neuraminidase__InfluenzaA__AGQ81925

SEQ ID NO: 145694 - RNA, 1356 nt, Artificial Sequence; identical to SEQ ID NO: 145659
  derived and/or modified sequence opt3 from neuraminidase__InfluenzaA__AGQ81926

SEQ ID NO: 145695 - RNA, 1356 nt, Artificial Sequence; identical to SEQ ID NO: 145659
  derived and/or modified sequence opt3 from neuraminidase__InfluenzaA__AGQ81927

SEQ ID NO: 145696 - RNA, 1356 nt, Artificial Sequence; identical to SEQ ID NO: 145659
  derived and/or modified sequence opt3 from neuraminidase__InfluenzaA__AGQ81928

SEQ ID NO: 145697 - RNA, 1356 nt, Artificial Sequence; identical to SEQ ID NO: 145659
  derived and/or modified sequence opt3 from neuraminidase__InfluenzaA__AGQ81929

SEQ ID NO: 145698 - RNA, 1413 nt, Artificial Sequence
  derived and/or modified sequence opt3 from neuraminidase__InfluenzaA__AGQ81930
augaaccccaaucagaagaucauuaccauaggcagcaucucccuggggcucguggucuucaacguucuucugcacgugguaucuauuaucgugacagucuugguguuaggaagagguggcaauucagggauuugcaacgagacuguugugagggaauacaaugagacgguccggaucgagaaaauaacccaauggcauaacacaagugugguagaauauguuccuuacuggagcgaaggaaauuauaugaacaauacugaggccaucugugacgugaagggcuuugcuccauucuccaaagauaacgguauucgcaucgggucucgaggacacgucuuugugauucgugagccguucgugucgugcucacccaccgaauguagaacauuuuuccugacccagggcagccuacucaaugacaagcauaguaacggcacugucaaagauagguccccuuuucggacacugaugucuguugagguggggcagagcccaaauguauaccaggcacgcuucgaagccguggcgugguccgcuaccgccugccacgacggaaagaaguggaugacgaucggugucacuggccccgauucaaaagcaguggccguugugcauuaugggggagucccuaccgacgugguaaacaguugggcuggcgauauacuuagaacacaagagagcucuuguacuugcauucaggguaauuguuacuggguuaugaccgacgggccagcaaacaggcaggcccaguaucggaucuacaaggcuaaccaaggaaaaauugugggccagacagauaucuccuuuaauggcgggcacaucgaggaaugcucauguuaccccaacgacggaaaggucgagugcgugugucgcgauaauuggaccgguacgaaccgaccuguccuggugauuagcccagacuugaguuauagaguuggcuaccucugcgccgggcugccgucugauacucccaggggagaagacgcgcaguucacaggcuccugcaccagcccuauggguaaucagggguauggcgugaaaggauuuggcuuccggcaagggacugacguauggaugggacguacaauaucgcgcaccucuagauccgguuuugagauccugaggauuaagaacggcuggacgcagaccucaaaggaacagguccggaaacaagugguuguggauaaucucaacuggaguggguacagcggauccuucacauuaccagucgagcugucuggcaaggacugucuugugcccugcuucuggguagagaugauccgagguaaaccugaagagaagacuauauggaccagcucaaguuccauugugaugugugggguugauuaugaagucgcagacuggagcuggcacgauggcgccaucuugccauuugacaucgauaaaauguga

SEQ ID NO: 145699 - RNA, 1413 nt, Artificial Sequence
  derived and/or modified sequence opt3 from neuraminidase__InfluenzaA__AGQ81931
augaaccccaaucagaagaucauuaccauaggcagccugucccucgggcuugugguccugaacaucuuguuacacauuaucucuauuacaaucacuguucuggugauaccuagaaauggaaacacggguucaugcaaugagaccguaaucagggaauacaacgagacagugcggauugagaaaaucacucaauggcauaauaccaacauuaucgaauauauagaaaagccagagaaugaccuauucaugaacaauacaggcccgcucugugaugccaaaggguuugcucccuucaguaaggacaacggcauucgcaucggaagcaaaggucacgucuuugugauucgagagccuuucguuuccugcucuccaaccgaaugucguacauuuuuccugacucaggggucgcuucugaaugauaagcauucaaacggaaccgugaaggacagaagccccuacaggacguugaugagugucgagaucggccaguccccuaauguguaucaggcacgguuugaagccguagcguggucugcuacugccugccacgauggcaaaaaguggaugaccaucgggguuacaggaccagacgcaaaagccguggcugucgugcauuacgguggcauucccacugaugugauaaacagcugggcaggggacauccuccgcacccaagaguccucauguacaugcauucagggagaguguuauugggucaugaccgauggcccugccaacagacaggcucaguacagggccuucaaggcgaaacaagguaagaucauagggcagacggaaauuaguuuuaauggaggccacaucgaggaaugcagcuguuauccaaacgagggcaagguugaaugcgugugucgggacaauuggacugggacaaaccgcccgguacuggugaucucuuccgaucugucauaccgagucggauaccucugcgcagguuuacccagcgacaccccuagaggcgaggauagucaguucacugggucuugcacauccccaaugggaaaucagggcuauggugugaaaggguuuggcuucaggcaaggaaacgacguuuggaugggccggaccauuagccguacgucgcgcucuggguuugagauccugaagauuagaaauggauggauacagaacuccaaagaacagaucaagaggcaaguggucguggacaauucaaacuggagugguuacagcggcuccuucacccuucccguagaguugacacggcgaaauugucugguuccuugcuucuggguggaaaugauucgcgggaaaccagaggaaaagacuaucuggaccucuagcucaaguaucgucauguguggaguggaucacgagauugccaacugguccuggcaugacggcgcuauacuacccuuugauaucgacaaaauguga

SEQ ID NO: 145700 - RNA, 1413 nt, Artificial Sequence
  derived and/or modified sequence opt3 from neuraminidase__InfluenzaA__AGQ81932
augaaccccaaucagaagaucauuaccauaggcagcaucucccuggggcucguggucuucaacguucuucugcacgugguaucuauuaucgugacagucuugauuuuaggaagagguggcaauaacgggaucugcaaugagacugugguuagggaauacaacgagacggugcggauagagaaaaucacccaauggcauaauacaucagucguggaauauguaccuuacuggaacgaaggaacuuauaugaauaacaccgaggccauuugugacguuaagggcuuugcuccauucaguaaagauaaugguauccgcauugggagccgaggacacguguuugucauccgugagccguucguguccugcucucccacagaauguagaaccuuuuuccugacucagggcucgcuacucaacgacaagcauucaaauggcacagugaaagauaggagcccuuuucggacccugaugagugucgagguugggcaguccccaaacguguaccaggcacgcuucgaagccguagcguggucugcuacggccugccacgacggaaagaaguggaugacuauaggugugaccggcagcgauuccaaagcagucgccgugguucauuaugggggagugcccacagacgucgugaauagcugggcuggcgauauucuuagaacucaagagaguagcuguaccugcauccaggguaacuguuacuggguaaugacagacgggccugcaaacaggcaggcccaguaucggauuuacaaggcuaaucaaggaaaaguuaucggccagaccgauaucucuuuuaacggcgggcacauugaggaaugcuccuguuacccaaaugacggaaagguggagugcgucugucgcgauaacuggacggguacuaaucgacccgugcuggucauaucaccugacuugagcuauagagugggcuaccucugcgccgggcugccaagugauacaccgaggggagaagacgcgcaguucaccggcucuugcacuucccccauggguaaccagggguauggcguuaaaggauuuggcuuccggcaagggacagacguguggaugggacguaccaucagccagacgucgcgcucugguuuugagauucugagaguaaagaauggcuggacccagacauccaaggaacaagucaggaaacaggugguuguggauaaccucaauuggucaggguacaguggaucauucacuuuaccuaucgagcuguccggcaaggacugucuugucccaugcuucuggguggagaugauacgggguaaacccgaagagaagucuauuuggaccagcucaaguuccaucguaaugugugggguggauuaugaaguugcagacuggagcuggcacgauggcgccaucuugccuuuugacauugauaaaauguga

SEQ ID NO: 145701 - RNA, 1413 nt, Artificial Sequence
  derived and/or modified sequence opt3 from neuraminidase__InfluenzaA__AGQ81934
augaaccccaaucagaagauccugugcaccagcgccacagcuauugugauaggcacuaucgcaguccucauugggaucgccaaccuuggacugaauauugguuugcacuuaaaaccuuccuguaacugcucucauucacaaccagagacgaccaauacaagucagacuaucauaaacaauuacuauaacgaaaccaauaucacacagauuagcaacaccaauauccagauggaggaaagagcguccagggacuucaacaaucugacuaagggccuauguacaauuaacucuuggcacaucuacgggaaagauaaugcuguucggauaggagagaacucggacgugcucguaacccgcgaaccguaugugucaugcgaucccgacgagugucgauuuuacgcccugagccaaggcacgacuauucgugguaagcauaguaacgggaccauccacgauagaucccaguauagggcacuuauuucuuggccucugagcuccccacccacagucuacaauucacggguggagugcaucggauggaguagcacuucuugucaugacggcaaaucccgcaugucaaucugcauuagcggcccuaacaauaacgccagugcuguugugugguauaauagaaggccagucgcagaaauaaacaccugggcccggaauaucuugcgcacacaggagucugaaugugugugccacaacgggguaugucccguuguguucaccgauggauccgcuacggguccugccgacacucgaauuuacuacuuuaaggagggcagaauccucaagugggagagccugacagggaccgcgaaacacauagaagagugcucgugcuauggagaaaggacuggcauuacauguaccugccgggauaauuggcaggguucuaaccguccagucauccgcaucgacccgguggcaaugacgcauaccucccaauacauuuguucacccgugcugacagauaauccuagaccaaacgaccccaaugucgggaagugcaacgauccuuauccaggaaauaacaacaauggcguuaaaggcuucaguuaccucgacggggugaacacuugguuaggaaggaccaucagcacagccucccggucugguuaugagaugcugaagguacccaaugcucuuacugacgaucgaagcaaaccgauucagggccagaccauaguguugaacacagacuggucaggguacaguggauccuuuauggauuauugggccgaaggcgacuguuaccgcgcaugcuucuacgucgagcugaucagagguaggccuaaggaggauaaggugugguggaccagcaauucuauuguuucaauguguaguagcacugaauuucuagggcagugggacuggcccgauggcgcuaaaaucgaguauuuccucuga

SEQ ID NO: 145702 - RNA, 1413 nt, Artificial Sequence; identical to SEQ ID NO: 145701
  derived and/or modified sequence opt3 from neuraminidase__InfluenzaA__AGQ81935

SEQ ID NO: 145703 - RNA, 1413 nt, Artificial Sequence; identical to SEQ ID NO: 145701
  derived and/or modified sequence opt3 from neuraminidase__InfluenzaA__AGQ81936

SEQ ID NO: 145704 - RNA, 1413 nt, Artificial Sequence; identical to SEQ ID NO: 145701
  derived and/or modified sequence opt3 from neuraminidase__InfluenzaA__AGQ81937

SEQ ID NO: 145705 - RNA, 1413 nt, Artificial Sequence; identical to SEQ ID NO: 145701
  derived and/or modified sequence opt3 from neuraminidase__InfluenzaA__AGQ81938

SEQ ID NO: 145706 - RNA, 1413 nt, Artificial Sequence; identical to SEQ ID NO: 145701
  derived and/or modified sequence opt3 from neuraminidase__InfluenzaA__AGQ81939

SEQ ID NO: 145707 - RNA, 1413 nt, Artificial Sequence
  derived and/or modified sequence opt3 from neuraminidase__InfluenzaA__AGQ81940
augaaccccaaucagaagauccugugcaccagcgccacagcuauuauaaucggcgcaauugccgugcucaucgggauugcgaaccuuggacugaauaucgguuugcacuuaaaaccuuccuguaacugcucucauucacaaccagagacuacgaauaccagucagacaauaaucaacaauuacuauaacgaaacuaauauuacccagaucagcaacacaaauauucagauggaggaaagagcuuccaagggcuucaacaaucugaccaaagggcuauguacuaucaacucuuggcacauauacggaaaggacaaugccgucaggauuggcgagucgucagauguucucgugacacgggaaccguauguaagcugcgaccccgaugagugucgcuuuuacgcacugagucaagguaccacgauccgagggaaacauuccaacggaacuauucacgaccguucucaguauagagcccuuaucagcuggccucuguccucaccacccaccguguacaacaguagggucgagugcaucggcuggagcucuacauccugucaugauggcaagucacggaugagcauuugcauaagugggccuaauaacaaugcuucugcagugguuugguauaaccgcagaccaguggccgaaaucaauacuugggcuaggaacauuuugcggacccaggaguccgaaugugucugccacaauggagugugucccguaguuuucacagacgguagcgccaccggcccugcggauacgcgcaucuacuacuuuaaggaggggaaaauacucaagugggagucgcuggcaggaacugccaaacacauugaagagugcucuugcuauggcgaacgaacagguaucaccuguacuugcagagacaacuggcagggguccaauaggccagugauccaaauugauccggucgcuaugacacauaccucacaguacaucuguagucccgugcugacggacaacccucggccaaaugaucccaacauuggaaagugcaaugacccuuauccaggcaacaauaacaacggcgugaaaggguucagcuaccucgauggagccaauaccugguuaggucguacaauauccacugcaucucgcagcggcuaugagaugcugaagguccccaacgcucuuaccgacgacagaucaaagccgauccaggggcagacaauuguuuugaauacugauuggaguggauacuccggcagcuuuauggacuauugggccgaaggugauuguuacagggcgugcuucuacguggagcugauccgggggcgaccuaaagaggacaagguaugguggaccucuaacucaaucgugaguauguguagcuccacagaauuucuaggccaauggaauuggcccgauggagccaaaauugaguauuuccucuga

SEQ ID NO: 145708 - RNA, 1413 nt, Artificial Sequence
  derived and/or modified sequence opt3 from neuraminidase__InfluenzaA__AGQ81941
augaaccccaaucagaagauccugugcaccagcgccacagcuauuauaaucggcacuauugcagugcucaucggggucgccaaccuuggacugaauauugguuugcacuuaaaaccuggcuguaacugcucccauucucaaccagaggcgacgaauaccucacagacaaucauaaacaauuacuauaacgaaacuaauaucacccagauuaguaacacaaauauccagauggaggaaagaccgaacaggggguucaauaaccugaccaagggacuauguacuauuaauagcuggcacaucuacggcaaagacaacgcuguucggauaggugagaacuccgaugugcucguaacacgcgaacccuaugugucuugcgacccugaugagugucgauuuuacgcccugucgcaagggaccacgauucguggaaagcauucaaauggcacuauccacgacagaagccaguauagggcacuuauuaguuggccacuguccucucccccuaccgucuacaacagccggguggagugcaucggcugguccucaacaaguugucaugaugggaaaagccgcaugucuaucugcauuuccggaccaaauaacaaugccucagcuguugugugguauaacagaaggcccgucgcagaaauaaauacuugggcccggaacaucuugcgcacccaggagagcgaaugugugugccacaaugguguauguccuguuguguucacagacggcagugcuaccgggccagccgauacgcgagucuacuacuuuagagagggaaagauucucaagugggagucucugacuggcacagcgaggcacaucgaagagugcuccugcuauggugaacggaccgggauaacuuguacaugccgugacaacuggcagggaagcaaucgcccggugauucaaaucgaucccguggcaaugacccauacgucgcaguacaucuguucuccuguccugaccgacaacccaagacccaaugauccuaacguuggcaaaugcaaugacccauaucccggcaacaacaauaacggggugaagggauucuccuaccucgaugguguaaauacaugguuaggcaggacuauuucaaccgccagucggagcggguaugagaugcugaaagugccgaacgcucuuacagacgaccgauccaagccuauccagggacagacuauugucuugaauaccgauuggucuggcuacagcgguucauuuauggacuauugggccgaaggggauuguuaccgcgcaugcuucuacguggagcugauaagaggcaggcccaaagaggacaagguuugguggacaaguaacuccaucgugagcauguguucuucaaccgaauuucuaggacaaugggauuggccagacggcgcuaagauugaguauuuccucuga

SEQ ID NO: 145709 - RNA, 1413 nt, Artificial Sequence
  derived and/or modified sequence opt3 from neuraminidase__InfluenzaA__AGQ81942
augaaccccaaucagaagauccugugcaccagcgccacagcuauuauaaucggcacuauugcagugcucaucggggucgccaaccuuggacugaauauugguuugcacuuaaaaccuggcuguaacugcucccauucucaaccagaggcgacgaauaccucacagacaaucauaaacaauuacuauaacgaaacuaauaucacccagauuaguaacacaaauauccagauggaggaaagaccgagcaggggguucaacaaucugaccaagggacuauguacuauuaacuccuggcacaucuacggcaaagacaaugcuguucggauaggugagaacucugaugugcucguaacacgcgaacccuaugugucgugcgacccugaugagugucgauuuuacgcccugucacaagggaccacgauucguggaaagcauagcaacggcacuauccacgacagaagucaguauagggcacuuauuuccuggccacugucuagcccucccaccgucuacaauucccggguggagugcaucggcuggucaaguacaagcugucaugaugggaaaucucgcauguccaucugcauuucaggaccaaacaauaacgccagcgcuauaguuugguauaauagaaggcccguggcagaaaucaacacuugggcccggaauauuuugcgcacccaggagagugaaugugucugccacaacgguguguguccuguaguuuucacagacggcucugcuaccgggccagccgauacgcgaguguacuacuuuagagagggaaagauccucaagugggagucccugacuggcacagcgaggcacauagaagagugcagcugcuauggugaacggaccgggauuacuuguacaugccgugacaauuggcagggaucgaaccgcccggucauccaaaucgaucccguggcaaugacccauacgucucaguacauuuguuccccugugcugaccgacaauccaagacccaacgauccuaaugucggcaaaugcaacgacccauaucccggcaauaacaacaaugggguuaagggauucucauaccucgauggugugaacacaugguuaggcaggacuaucaguaccgccagccgguccggguaugagaugcugaaaguaccgaaugcucuuacagacgaccgaucuaagccuauucagggacagacuauaaucuugaacaccgauuggagcggcuacucagguaguuuuauggacuauugggccgaaggggauuguuaccgcgcaugcuucuacguggagcugauuagaggcaggcccaaagaggacaaggucugguggacauccaauagcaucgugucuauguguucaaguaccgaauuucuaggacaaugggauuggccagacggcgcuaagaucgaguauuuccucuga

SEQ ID NO: 145710 - RNA, 1413 nt, Artificial Sequence
  derived and/or modified sequence opt3 from neuraminidase__InfluenzaA__AGQ81943
augaaccccaaucagaagauccugugcaccagcgccacagcuauuauaaucggcgcaauugccgugcucaucgggauugcgaaccuuggacugaauaucgguuugcacuuaaaaccuuccuguaacugcucucauucacaaccagagacuacgaauaccagucagacaauaaucaacaauuacuauaacgaaacuaauauuacccagaucagcaacacaaauauucagauggaggaaagaaccuccaggggcuucaacaaucugacuaaggggcuauguacaaucaacucuuggcacauauacggaaaagacaaugcuauucggaucggcgagucgucagauguccucguuacccgcgaaccguaugugagcugcgaccccgaugagugucgauuuuacgcccugagucaagguacgacuauucgugggaagcauuccaacggaaccauccacgacagaucucaguauagggcacuuaucagcuggccucuguccucaccacccacaguauacaacagucggguggagugcauuggcuggagcucuacuuccugucaugauggcaaaucacgcaugagcauaugcaucagugggccuaauaacaaugccucugcugucgugugguauaacagaaggccaguugcagaaauuaauaccugggcccggaacaucuugcgcacacaggaguccgaaugugugugccacaauggagucugucccgugguauucaccgacgguagcgcuacgggcccugccgauacucgaauauacuacuuuaaggaggggaggauucucaagugggagucgcugacaggaaccgcgaaacacaucgaagagugcucuugcuauggcgaaagaacugguaucacauguaccugccgggacaacuggcagggguccaaucguccaguuauucaaaucgauccgguggcaaugacgcauaccucacaguacauuuguagucccguccugacagacaacccucgcccaaaugaucccaacauaggaaagugcaaugacccuuauccaggcaacaauaacaacggcgugaaaggguucagcuaccucgauggagccaauacuugguuagguagaaccaucuccacagcuucuaggagcggcuaugagaugcugaaggugcccaacgcccuuacugacgaccggucaaaaccgauucaggggcagaccaucgucuugaauacagauuggaguggauacuccggcagcuuuauggacuauugggcagaaggugauuguuaccgagcuugcuucuacguugagcugauccgcgggagaccuaaggaggacaaggugugguggaccucuaacucaauuguaaguauguguagcuccacugaauuucuaggccaauggaauuggcccgauggagccaaaauagaguauuuccucuga

SEQ ID NO: 145711 - RNA, 1413 nt, Artificial Sequence; identical to SEQ ID NO: 145701
  derived and/or modified sequence opt3 from neuraminidase__InfluenzaA__AGQ81944

SEQ ID NO: 145712 - RNA, 1413 nt, Artificial Sequence
  derived and/or modified sequence opt3 from neuraminidase__InfluenzaA__AGQ81947
augaaccccaaucagaagauccugugcaccagcgccacagcucucgugauuggcacuauagcaguccuuaucgggauugccaaccugggauugaauaucgguuuacaccugaaaccuuccuguaacugcucucauucacaaccagaggcgacgaauaccagucagacaauuaucaacaauuacuauaacgaaacuaauauaacccagaucagcaacacaaauauucagauggaggaaagagcuuccaggucuuucaacaaucuaaccaagggccucuguacuaucaacucguggcacauuuacgggaaagacaaugccauccggauaggagagaacucagauguucuggugacacgcgaaccguauguaagcugcgaccccgaugagugucgauuuuacgcacuuagucaaggcaccacgauucgugguaagcauuccaacgggacuauccacgacagaucucaguauagggcccugauuagcuggccuuuguccucaccacccaccguguacaauagucgggucgagugcaucggauggagcucuacauccugucaugauggcaaaucacgcaugagcaucugcauuaguggcccuaacaauaacgcuucugcagugguuugguauaauagaaggccaguggccgaaauaaacacuugggcucggaauauccuccgcacccaggaguccgaaugugucugccacaacggggugugucccguaguuuucacagacggaagcgccaccgguccugcggauacgcgaauuuacuacuuuaaggagggcaagauccugaaaugggagucgcugacugggacagcaaagcacauagaagagugcucuugcuauggagaaagaaccggcauuacuuguacaugcagggacaauuggcaggguuccaaccggccagugauccaaaucgauccggucgccaugacccauacgucacaguacauuuguagucccgugcucaccgacaauccucguccaaacgaucccaauguggggaaaugcaacgacccuuauccaggaaauaacaacaauggcgucaagggcuucagcuacuuagaugggguuaacacauggcugggacgcacuaucuccaccgcuucuagaagcgguuaugagaugcuuaaagugcccaaugccuugacagacgacaggucaaagccgauucagggccagacuauaguacugaacaccgauuggaguggguacuccggcagcuuuauggacuauugggcagaaggagauuguuaccgggcuugcuucuacguggagcuaauccgaggucgcccuaaggaggacaaagucugguggacaucuaauucaauugugaguauguguagcuccaccgaauuucucgggcaauggaacuggcccgauggcgccaagaucgaguauuuccuguga

SEQ ID NO: 145713 - RNA, 1413 nt, Artificial Sequence
  derived and/or modified sequence opt3 from neuraminidase__InfluenzaA__AGQ81948
augaaccccaaucagaagauccugugcaccagcgccacagcuauuauaaucggcgcaauugccgugcucaucgggauugcgaaccuuggacugaauaucgguuugcacuuaaaaccuuccuguaacugcucucauucacaaccagagacuacgaauaccagucagacaauaaucaacaauuacuauaacgaaacuaauauuacccagaucagcaacacaaauauucagauggaggaaagaaccuccaggggcuucaacaaucugacuaaggggcuauguacaaucaacucuuggcacauauacggaaaagacaaugcuauucggaucggcgagucgucagauguccucguuacccgcgaaccguaugugagcugcgaccccgaugagugucgauuuuacgcccugagucaagguacgacuauucgugggaagcauuccaacggaaccauccacgacagaucucaguauagggcacuuaucagcuggccucuguccucaccacccacaguauacaacagucggguggagugcauuggcuggagcucuacuuccugucaugauggcaaaucacgcaugagcauaugcaucagugggccuaauaacaaugccucugcugucgugugguauaacagaaggccaguugcagaaauuaauaccugggcccggaacaucuugcgcacacaggaguccgaaugugugugccacaauggagucugucccgugguauucaccgacgguagcgcuacgggcccugccgauacucgaauauacuacuuuaaggaggggaggauucucaagugggagucgcugacaggaaccgcgaaacacaucgaagagugcucuugcuauggcgaaagaacugguaucacauguaccugccgggacaacuggcagggguccaaucguccaguuauucaaaucgauccgguggcaaugacgcauaccucacaguacauuuguagucccguccugacagacaacccucgcccaaaugaucccaacauaggaaagugcaaugacccuuauccaggcaacaauaacaacggcgugaaaggguucagcuaccucgauggagccaauacuugguuagguagaaccaucuccacagcuucuaggagcggcuaugagaugcugaaggugcccaacgcccuuacugacgaccggucaaaaccgauucaggggcagaccaucgucuugaauacagauuggaguggauacuccggcagcuuuauggacuauugggcagaaggugaguguuaccgagcuugcuucuacguugagcugauccgcgggagaccuaaggaagauaaggugugguggaccucuaacucaauuguaaguauguguagcuccacugaguuucuaggccaauggaauuggcccgacggagccaaaauagaauauuuccucuga

SEQ ID NO: 145714 - RNA, 1413 nt, Artificial Sequence
  derived and/or modified sequence opt3 from neuraminidase__InfluenzaA__AGQ81951
augaaccccaaucagaagauccugugcaccagcgccacagcuauugugauaggcacuaucgcaguccucauugggguugccaaccuuggacugaauaucgguuugcacuuaaaaccuggcuguaacugcucccaaucucagccagaggcgacgaauaccucacagacaauuaucaacaauuacuauaacgaaacuaauauaacccagaucaguaacacaaauauucaaauggaggaaagagcuaacaggggguucaauaaccugaccaagggacuauguacuaucaauagcuggcauauuuacggcaaagacaacgccgugcggaucggugagaacuccgauguacucgugacacgcgaaccguaugucucuugcgaccccgaugagugucgauuuuacgcacugucgcaggggaccacgauacguggaaagcacucaaauggcacuauucaugacagaagccaguauagggcccuuaucaguuggccucuguccucuccacccaccguguacaacagccggguugagugcauuggcugguccucaacaaguugucacgaugggaaaagccgcaugucuaucugcaucuccggaccuaauaacaaugcuucagcaguggucugguauaacagaaggccaguggccgaaauuaauacuugggcucggaacauauugcgcacccaggagagcgaauguguaugccauaaugguguuugucccguggucuucacagacggcagugccaccgggccugcggauacgcgaguguacuacuuuagagagggaaagauccucaagugggagucucugacuggcacagcaaaacacauugaagagugcuccugcuauggugaaaggaccgggaucacuuguacaugccgggacaacuggcaaggaagcaaucguccagugauacagauugauccggucgccaugacccacacgucgcaguacaucuguucucccguucugaccgacaacccucgcccaaaugaucccaacgugggcaagugcaaugacccuuauccaggcaacaacaauaacgggguaaaaggauucuccuaccucgauggugugaauacaugguuaggcagaacuaucucaaccgcuaguaggagcggguaugagaugcugaagguccccaacgcccuuacagacgaccgguccaaaccgauucagggacaaacuaucguguugaauaccgauuggucuggcuacagcgguucauuuauggacuauugggcagaaggggauuguuaccgagcuugcuucuacguugagcugauucgcggcagaccuaaggaggacaaggugugguggacaaguaacuccauagucagcauguguucuucaaccgaauuucuaggacaguggaauuggcccgauggcgccaaaaucgaguauuuccucuga

SEQ ID NO: 145715 - RNA, 1413 nt, Artificial Sequence
  derived and/or modified sequence opt3 from neuraminidase__InfluenzaA__AGQ81952
augaaccccaaucagaagauccugugcaccagcgccacagcuauugugauaggcacuaucgcaguccucauugggguugccaaccuuggacugaauaucgguuugcacuuaaaaccuggcuguaacugcucccauucucaaccagaggcgacgaauaccucacagacaauuaucaacaauuacuauaacgaaacuaauauaacccagaucaguaacacaaauauucagauggaggaaagagcuaacaggggguucaauaaccugaccaagggacuauguacuaucaauagcuggcacauuuacggcaaagacaacgccgugcggaucggugagaacuccgauguacucgugacacgcgaaccguaugucucuugcgaccccgaugagugucgauuuuacgcacugucgcaagggaccacgauacguggaaagcauucaaauggcacuauucacgacagaagccaguauagggcccuuaucaguuggccucuguccucuccacccaccguguacaacagccggguugagugcauuggcugguccucaacaaguugucaugaugggaaaagccgcaugucuaucugcaucuccggaccuaauaacaaugcuucagcaguggucugguauaacagaaggccaguggccgaaauuaauacuugggcucggaacauauugcgcacccaggagagcgaauguguaugccacaaugguguuugucccguggucuucacagacggcagugccaccgggccugcggauacgcgaguguacuacuuuagagagggaaagauccucaagugggagucucugacuggcacagcaaaacacauugaagagugcuccugcuauggugaaaggaccgggaucacuuguacaugccgggacaacuggcagggaagcaaucguccagugauacaaauugauccggucgccaugacccauacgucgcaguacaucuguucucccguucugaccgacaacccucgcccaaaugaucccaacgugggcaagugcaaugacccuuauccaggcaacaacaauaacgggguaaaaggauucuccuaccucgauggugugaauacaugguuaggcagaacuaucucaaccgcuaguaggagcggguaugagaugcugaagguccccaacgcccuuacagacgaccgguccaaaccgauucagggacagacuaucguguugaauaccgauuggucuggcuacagcgguucauuuauggacuauugggcagaaggggauuguuaccgagcuugcuucuacguugagcugauucgcggcagaccuaaggaggacaaggugugguggacaaguaacuccauagucagcauguguucuucaaccgaauuucuaggacaauggaauuggcccgauggcgccaaaaucgaguauuuccucuga

SEQ ID NO: 145716 - RNA, 1413 nt, Artificial Sequence
  derived and/or modified sequence opt3 from neuraminidase__InfluenzaA__AGQ81954
augaaccccaaucagaagauccugugcaccagcgccacagcuauugugauaggcacuaucgcaguccucauugggguugccaaccuuggacugaauaucgguuugcacuuaaaaccuuccuguaacugcucucauucacaaccagaggcgacgaauaccagucagacaauuaucaacaauuacuauaacgaaacuaauauaacccagaucagcaacacaaauauucagauggaggaaagagcuuccaggggcuucaacaaucugaccaaggggcuauguacuaucaacucuuggcacauuuacggaaaagacaaugccgugcggaucggcgagaacucggauguacucgugacacgcgaaccguaugucucaugcgaccccgaugagugucgauuuuacgcacugagccaagguaccacgauacgugggaagcauaguaacggaacuauucacgacagaucccaguauagggcccuuaucucuuggccucugagcuccccacccaccguguacaauucacggguugagugcauuggcuggaguagcacaucuugucaugauggcaaaucccgcaugucaaucugcaucagcgggccuaacaauaacgcuagugcaguggucugguauaauagaaggccaguggccgaaauuaacacuugggcucggaauauauugcgcacccaggagucugaauguguaugccacaacggaguuugucccguggucuucacagacgguuccgccaccggcccugcggauacgcgaguguacuacuuuaaggaggggaagauccucaaaugggagagccugacuggaacagcaaagcacauugaagagugcucgugcuauggcgaaagaaccgguaucacuuguacaugcagggacaauuggcaggggucuaaccggccagugauacaaauugauccggucgccaugacccauacgucccaguacaucuguucacccguucugaccgacaauccucguccaaacgaucccaaugugggaaaaugcaacgacccuuauccaggcaauaacaacaauggcguaaagggguucaguuaccucgauggagugaacacaugguuaggucgcacuaucagcaccgcuuccagaucuggcuaugagaugcugaaaguccccaaugcccuuacagacgacaggagcaagccgauucaggggcagacuaucguguugaacaccgauuggucaggauacaguggcuccuuuauggacuauugggcagaaggugauuguuaccgggcuugcuucuacguugagcugauucgagggcgcccuaaggaggacaaagugugguggacaagcaauucuauagucucaauguguaguagcaccgaauuucuaggccaauggaacuggcccgauggagccaagaucgaguauuuccucuga

SEQ ID NO: 145717 - RNA, 1413 nt, Artificial Sequence
  derived and/or modified sequence opt3 from neuraminidase__InfluenzaA__AGQ81956
augaaccccaaucagaagauccugugcaccagcgccacagcuauugugauaggcacuaucgcaguccucauugggguugccaaccuuggacugaauaucgguuugcacuuaaaaccuuccuguaacugcucucauucacaaccagaggcgacgaauaccagucagacaauuaucaacaauuacuauaacgaaacuaauauaacccagaucagcaacacaaauauucagauggaggaaagagcuuccaggggcuucaacaaucugaccaaggggcuauguacuaucaacucuuggcacauuuacggaaaagacaaugccgugcggaucggcgagaacucggauguacucgugacacgcgaaccguaugucucaugcgaccccgaugagugucgauuuuacgcacugagccaagguaccacgauacgugggaagcauaguaacggaacuauucacgacagaucccaguauagggcccuuaucucuuggccucugagcuccccacccaccguguacaauucacggguugagugcauuggcuggaguagcacaucuugucaugauggcaaaucccgcaugucaaucugcaucagcgggccuaacaauaacgcuagugcaauugugugguauaauagaaggccagucgccgaaauaaacacuugggcucggaauaucuugcgcacccaggagucugaaugugugugccacaacggaguaugucccguuguguucacagacgguuccgccaccggcccugcggauacgcgagucuacuacuuuaaggaggggaagauucucaaaugggagagccugacuggaacagcaaagcacaucgaagagugcucgugcuauggcgaaagaaccgguauaacuuguacaugcagggacaauuggcaggggucuaaccggccagugauucaaaucgauccgguggccaugacccauacgucccaguacaucuguucacccguccugaccgacaauccucguccaaacgaucccaauguuggaaaaugcaacgacccuuauccaggcaauaacaacaauggcgugaagggguucaguuaccucgauggaguaaacacaugguuaggucgcacuauuagcaccgcuuccagaucuggcuaugagaugcugaaagugcccaaugcccuuacagacgacaggagcaagccgauccaggggcagacuauugucuugaacaccgauuggucaggauacaguggcuccuuuauggacuauugggcagaaggugauuguuaccgggcuugcuucuacguggagcugauacgagggcgcccuaaggaggacaaaguuugguggacaagcaauucuaucgugucaauguguaguagcaccgaauuucuaggccaauggaacuggcccgauggagccaagauugaguauuuccucuga

SEQ ID NO: 145718 - RNA, 1413 nt, Artificial Sequence
  derived and/or modified sequence opt3 from neuraminidase__InfluenzaA__AGQ81957
augaaccccaaucagaagauccugugcaccagcgccacagcuauugugauaggcacuaucgcaguccucauugggaucgccaaccuuggacugaauauugguuugcacuuaaaaccuuccuguaacugcucucauucacaaccagaggcgacgaauaccagucagaucauaaucaacaauuacuauaacgaaacaaauauuacucagguuagcaacaccaauauccagauggaggaaagagcuuccaggggcuucaacaaucugacaaaggggcuauguaccauuaacucuuggcacaucuacggaaaagacaaugccgugcggauaggcgagaacucggauguacucgugacucgcgaaccguaugucucaugcgaccccgaugagugucgauuuuacgcacugagccaagguacaaccauucgugggaagcauaguaacggaacgauccacgacagaucccaguauagggcccuuauuucuuggccucugagcuccccacccacuguguacaauucacggguugagugcaucggcuggaguagcaccucuugucaugauggcaaaucccgcaugucaaucugcauuagcgggccuaacaauaacgcuagugcaguggucugguauaauagaaggccaguggccgaaauaaacacaugggcucggaauaucuugcgcacucaggagucugaauguguaugccacaacggaguuugucccguggucuucaccgacgguuccgccacaggcccugcggauacccgaauuuacuacuuuaaggaggggaagauccucaaaugggagagccugacgggaacugcaaagcacauagaagagugcucgugcuauggcgaaagaacagguauuaccuguacuugcagggacaauuggcaggggucuaaccggccagugauccaaaucgauccgguggccaugacacauaccucccaguacauuuguucacccguccugacggacaauccucguccaaacgaucccaauguuggaaaaugcaacgacccuuauccaggcaauaacaacaauggcgugaagggguucaguuaccucgauggaguaaacaccugguuaggucgcacaaucagcacugcuuccagaucuggcuaugagaugcugaaagugcccaaugcccuuaccgacgacaggagcaagccgguccaggggcagacaauuguguugaacacugauuggucaggauacaguggcuccuuuauggacuauugggcagaaggugauuguuaccgggcuugcuucuacguugagcugauacgagggcgcccuaaggaggacaaagugugguggaccagcaauucuaucgucucaauguguaguagcacagaauuucuaggccaauggaacuggcccgauggagccaagauugaguauuuccucuga

SEQ ID NO: 145719 - RNA, 1413 nt, Artificial Sequence; identical to SEQ ID NO: 145701
  derived and/or modified sequence opt3 from neuraminidase__InfluenzaA__AGQ81958

SEQ ID NO: 145720 - RNA, 1413 nt, Artificial Sequence; identical to SEQ ID NO: 145701
  derived and/or modified sequence opt3 from neuraminidase__InfluenzaA__AGQ81959

SEQ ID NO: 145721 - RNA, 1413 nt, Artificial Sequence
  derived and/or modified sequence opt3 from neuraminidase__InfluenzaA__AGQ81960
augaaccccaaucagaagauccugugcaccagcgccacagcuauugugauaggcacuaucgcaguccucauugggaucgccaaccuuggacugaauauugguuugcacuuaaaaccuaacuguaauugcuccagaucucaaccagagacgaccaacacaucacagacuaucauaaauaacuacuauaaugaaaccaacaucacacagauuaguaauaccaacauccagauggaggaaagggcgagccgggacuucaauaaccugacuaagggccuauguacaauuaauuccuggcauaucuacgggaaagauaacgcuguucgcauaggagagaacucugacgugcucguaacccgagaaccguaugugucgugcgaucccaaugagugucguuuuuacgcccugucacaaggcacgacuauuagagguaagcacagcaacgggaccauccaugacaggagucaguaucgggcacuuauuuccuggccucugucuagcccacccacagucuacaauucccgcguggagugcaucggauggucaaguacuagcugucacgauggcaaaucuagaauguccaucugcauuucaggcccuaacaauaacgccagcgcuguugugugguauaauaggcggccagucgcagaaauaaacaccugggcccgcaauaucuugcgaacacaggagagugaaugugugugccauaacgggguaugucccguuguguucaccgacggaucugcuacggguccugccgauacuagaauuuacuacuuuaaggagggcaagauccucaaaugggagucccugacagggaccgcgaagcacauagaagagugcagcugcuauggagaaaggacugagauuacauguaccugccgggacaauuggcagggcucgaaccguccagucauccaaaucgauccgguggcaaugacgcacaccucucaguacauuuguucccccgugcugacagacaauccucgcccaaacgaucccaaugucgguaaaugcaacgacccuuauccagggaacaauaacaauggaguuaagggcuucucauaccucgauggcgugaacacuugguuagggagaaccaucaguacagccagcagguccggauaugaaaugcugaaaguacccaaugcucuuacugacgaccggucuaagccgauucagggucagaccauaguguugaacacagauuggagcggcuacucagggaguuuuauggacuauugggccgagggagauuguuaccgagcaugcuucuacgucgagcugauccgcggcagaccuaaggaagacaaagugugguggaccuccaauagcauuguuucuauguguucaaguacugaguuucuaggucaaugggauuggcccgacggggcuaagaucgaauauuuccucuga

SEQ ID NO: 145722 - RNA, 1413 nt, Artificial Sequence; identical to SEQ ID NO: 145714
  derived and/or modified sequence opt3 from neuraminidase__InfluenzaA__AGQ81961

SEQ ID NO: 145723 - RNA, 1413 nt, Artificial Sequence; identical to SEQ ID NO: 145714
  derived and/or modified sequence opt3 from neuraminidase__InfluenzaA__AGQ81962

SEQ ID NO: 145724 - RNA, 1413 nt, Artificial Sequence
  derived and/or modified sequence opt3 from neuraminidase__InfluenzaA__AGQ81963
augaaccccaaucagaagauccugugcaccagcgccacagcuauugugauaggcacuaucgcaguccucauugggaucgccaaccuuggacugaauauugguuugcacuuaaaaccuuccuguaacugcucucauucacaaccagaggaaacgaauaccagucagacaaucauaaacaauuacuauaacgagacuaauaucacccagauuagcaacacaaauauccagauggaagagagagcguccaggggcuucaacaaucugaccaaggggcuauguacuauuaacucuuggcacaucuacggaaaagacaaugcuguucggauaggcgaaaacucggaugugcucguaacacgcgagccguaugugucaugcgaccccaacgagugucgauuuuacgcccugagccaagguaccacgauucgugggaagcauaguaauggaacuauccacgauagaucccaguauagggcacuuauuucuuggccucugagcuccccacccaccgucuacaacucacggguggaaugcaucggcuggaguagcacaucuugucaugacggcaaaucccgcaugucaguuugcaucagcgggccuaaugauaacgccagugcuguggucugguauaauagaaggccaguggcagagauuaacacuugggcccggaauauauugcgcacccaggaaucugaguguguaugccacaacggaguuugucccguggucuucacagacgguuccgcuaccggcccugcccacacgcgaaucuacuacuuuaaggaggggaagauucucaaaugggaaagccugacuggaacagcgaagcauaucgaggaaugcucgugcuauggcgagagaaccgguauaacuuguacaugcagggauaauuggcaggggucuaaccggccagugauucaaaucgacccgguggcaaugacccacacgucccaguacaucuguucacccguccugaccgauaauccucguccaaacgaccccaauguuggaaaaugcaacgauccuuauccaggcaauaacaacaauggcgugaagggguucaguuaccucgacggaguaaacacaugguuaggucgcacuauuagcaccgccuccagaucuggcuaugaaaugcugaaagugcccaaugcucuuacagaugacaggagcaagccgauccaggggcagacuauugucuugaacaccgacuggucaggauacaguggcuccuuuauggauuauuggacagagggugacuguuaccgggccugcuucuacguggagcugauacgagggcgcccuaaggaagauaaaguuugguggaccagcaauucuaucgugucaauguguaguagcacugaguuucuaggccaaugggacuggcccgauggagcaaagauugaauauuuccucuga

SEQ ID NO: 145725 - RNA, 1413 nt, Artificial Sequence
  derived and/or modified sequence opt3 from neuraminidase__InfluenzaA__AGQ81964
augaaccccaaucagaagauccugugcaccagcgccacagcuauugugauaggcacuaucgcaguccucauugggaucgccaaccuuggacugaauauugguuugcacuuaaaaccuuccuguaacugcucucauucaaagccagaggaaacgaaugcgagucaaaccaucauaaacaauuacuauaacgagacaaauaucacucagauuagcaacaccaauauccagauggaagagagagcuuccaggggcuucaacaaucugacaaaagggcuauguaccauuaacucuuggcacaucuacggaaaggacaaugccguucggauaggcgaaucgucagaugugcucguaacucgcgagccguaugugagcugcgaccccgaugagugucgauuuuacgcacugagucaggguacaaccauucgugggaaacauuccaacggaacgauccacgacagaucucaauauagggcccuuauuagcuggccucuguccucaccacccacugucuacaacagucggguggaaugcaucggcuggagcucuaccuccugucaugauggcaagucacgcaugagcaucugcauuagugggccuaauaacaaugcuucugcaguugugugguauaacagaaggccagucgccgagauaaauacaugggcucggaacaucuugcgcacucaggaauccgagugugugugccacaauggaguaugucccguuguguucaccgacgguagcgccacaggcccugcggauacccgaauuuacuacuuuaaggaggggaaaauccucaagugggaaucgcugacgggaacugcaaaacacauagaggaaugcucuugcuauggcgagagaacagguauuaccuguacuugcagggacaacuggcagggguccaaucggccagucauccagaucgauccgguggccaugacacauaccucacaauacauuuguagucccgugcugacggacaacccucguccaaaugaucccaacgucggaaagugcaaugacccuuauccaggcaacaauaacaacggcguuaaaggguucagcuaccucgauggagugaauaccugguuaggucgcacaacuuccaccacaucuagaagcggcuaugaaaugcugaagguacccaacgcucuuacugacgacaggucaaagccgauccaggggcagaccauuguguugaauacagauuggaguggauacuccggcagcuuuauggacuauugggccgagggugauuguuaccgggcaugcuucuacgucgagcugauacgagggcgcccuaaagaagacaaggugugguggaccucuaacucaaucguuaguauguguagcuccacugaguuucuaggccaguggaauuggcccgauggagcuaaaauugaauauuuccucuga

SEQ ID NO: 145726 - RNA, 1413 nt, Artificial Sequence
  derived and/or modified sequence opt3 from neuraminidase__InfluenzaA__AGQ81966
augaaccccaaucagagaauccugugcaccagcgccacagcuauugugauaggcacuaucgcaguccucauugggguugccaaccuuggacugaauaucgguuugcacuuaaagccuggcuguaacugcucccauucucaaccagaggcgacgaauaccucacagacaauuaucaacaauuacuauaacgaaacuaauauaacccagaucaguaacacaaauauucagauggaggaaagggcuaaccggggguucaauaaccugaccaaaggacuauguacuaucaauagcuggcacauuuacggcaaggacaacgccgugcgcaucggugagaacuccgauguacucgugacacgagaaccguaugucucuugcgaccccgaugagugucguuuuuacgcacugucgcaagggaccacgauaagaggaaaacauucaaauggcacuauucacgacaggagccaguaucgggcccuuaucaguuggccucuguccucuccacccaccguguacaacagccgcguugagugcauuggcugguccucaacaaguugucaugauggaaagagcagaaugucuaucugcaucuccgggccuaauaacaaugcuucagcaguggucugguauaacaggcggccaguggccgaaauuaauacuugggcucgcaacauauugcgaacccaggagagcgaauguguaugccacaaugguguuugucccguggucuucacagacggcagugccaccgggccugcggauacgagaguguacuacuuuagggagggaaaaauccucaagugggagucucugacuggcacagcaaagcacauugaagagugcuccugcuauggugaacggaccgggaucacuuguacaugccgugacaacuggcagggaagcaaucgcccagugauacaaauugauccggucgccaugacccauacgucgcaguacaucuguucucccguucugaccgacaacccuagaccaaaugaucccaacgugggcaaaugcaaugacccuuauccaggcaacaacaauaacgggguaaagggauucuccuaccucgauggugugaauacaugguuaggcaggacuaucucaaccgcuagucggagcggguaugagaugcugaaaguccccaacgcccuuacagacgaccgauccaagccgauucagggacagacuaucguguugaauaccgauuggucuggcuacagcgguucauuuauggacuauugggcagaaggggauuguuaccgcgcuugcuucuacguugagcugauuagaggcaggccuaaagaggacaaggugugguggacaaguaacuccauagucagcauguguucuucaaccgaauuucuaggacaauggaauuggcccgauggcgccaagaucgaguauuuccucuga

SEQ ID NO: 145727 - RNA, 1413 nt, Artificial Sequence
  derived and/or modified sequence opt3 from neuraminidase__InfluenzaA__AGQ81967
augaaccccaaucagaagauccugugcaccagcgccacagcuauugugauaggcaucauugcaguccucaucgggauugccaaccuuggacugaauaucgguuugcacuuaaaaccuuccuguaacugcucucauucacaaccagaggcgacuaaugcuagucagacgauaaucaacaauuacuauaacgaaaccaauauuacacagaucagcaacacuaauauucagauggaggaaagagccuccaggggcuucaacaaucugaccaaggggcuauguacaaucaacucuuggcacauauacggaaaagacaaugcaguucggauuggcgagaacucggaugugcucguaacccgcgaaccguaugugucaugcgaccccgaugagugucgauuuuacgcccugagccaagguacuacaauccgugggaagcauaguaacggaaccauucacgacagaucccaguauagggcucuuaucucuuggccucugagcuccccacccacggucuacaauucacggguggagugcaucggcuggaguagcacuucuugucaugauggcaaaucccgcaugucaauuugcauaagcgggccuaacaauaacgcaagugccguugugugguauaauagaaggccagucgcugaaaucaacaccugggcccggaauauuuugcgcacacaggagucugaaugugugugccacaacggaguaugucccguuguguucacugacgguuccgcgaccggcccugcagagacacgaaucuacuacuuuaaggaggggaagauacucaaaugggaaagccugaccggaacggccaagcacauugaggaaugcucgugcuauggcgagagaacugguaucacauguaccugcagggauaauuggcaggggucuaaccggccagucauccaaauugacccgguggcuaugacucauacaucccaguacaucuguucacccgugcugaccgauaauccucguccaaacgaccccaaugucggaaaaugcaacgauccuuauccaggcaauaacaacaauggcguuaagggguucaguuaccucgacggagugaacacgugguuaggucgcaccauuagcacagccuccagaucuggcuaugaaaugcugaaaguacccaaugcacuuacugaugacaggagcaagccgauacaggggcagaucauuguguugaacaccgacuggucaggauacaguggcuccuuuauggauuauugggcugagggugacuguuaccgggccugcuucuacgucgagcugauccgagggcgcccuaaggaagauaaagugugguggacaagcaauucuaucguuucaauguguaguagcacugaguuucuaggccaauggaacuggcccgacggagcgaagauugaauauuuccucuga

SEQ ID NO: 145728 - RNA, 1413 nt, Artificial Sequence
  derived and/or modified sequence opt3 from neuraminidase__InfluenzaA__AGQ81968
augaaccccaaucagaagauccugugcaccagcgccacagcuauugugauaggcaucauugcaguccucaucgggauugccaaccuuggacugaauaucgguuugcacuuaaaaccuuccuguaacugcucucauucacaaccagaggcgacuaaugcuagucagacgauaaucaacaauuacuauaacgaaaccaauauuacacagaucagcaacacuaauauucagauggaggaaagagccuccaggggcuucaacaaucugaccaaggggcuauguacaaucaacucuuggcacauauacggaaaagacaaugcaguucggauuggcgagaacucggauauccucgugacccgcgaaccguauguaucaugcgaccccgaugagugucgauuuuacgcccugagccaagguacuacaauucgugggaagcauaguaacggaaccauccacgacagaucccaguauaggucucuuaucagcuggccucuguccucaccacccacgguguacaauagucgggucgagugcauuggcuggagcucuacuuccugucaugauggcaaaucacgcaugagcauaugcaucagugggccuaacaauaacgcuucugcagugguuugguauaauagaaggccaguggccgaaauuaacaccugggcucggaauaucuugcgcacacaggaguccgaaugugucugccacaacggagugugucccguaguuuucacugacgguagcgccaccggcccugcggagacacgaauauacuacuuuaaggaggggaagauucucaaaugggaaucgcugaccggaacggcaaagcacaucgaggaaugcucuugcuauggcgagagaacugguaucacauguaccugcagggauaauuggcagggguccaaccggccagugauucaaaucgacccggucgccaugacucauacaucacaguacauuuguagucccgugcugaccgauaauccucguccaaacgaccccaaugugggaaaaugcaacgauccuuauccaggcaauaacaacaauggcgucaagggguucagcuaccucgacggaguuaacacgugguuaggucgcaccauauccacagcuucuagaagcggcuaugaaaugcugaaagugcccaaugcccuuacugaugacaggucaaagccgauccaggggcagaccauuguauugaacacagacuggaguggauacuccggcagcuuuaucgauuauugggcagagggugacuguuaccgggcuugcuucuacguggagcugauccgagggcgcccuaaggaagauaaagucugguggacuucuaauucaauugugaguauguguagcuccaccgaguuucuaggccaauggaacuggcccgacggagccaagauagaauauuuccucuga

SEQ ID NO: 145729 - RNA, 1413 nt, Artificial Sequence
  derived and/or modified sequence opt3 from neuraminidase__InfluenzaA__AGQ81969
augaaccccaaucagaagauccugugcaccagcgccacagcuauugugauaggcaucauugcaguccucaucgggauugccaaccuuggacugaauaucgguuugcacuuaaaaccuuccuguaacugcucucauucacaaccagaggaaacuaaugcgagucagacgauaaucaacaauuacuauaacgagaccaauauuacacagaucagcaacacuaauauucagauggaagagagagcuuccaggggcuucaacaaucugaccaaggggcuauguacaaucaacucuuggcacauauacggaaaagacaaugccguucggauuggcgaaaacucggaugugcucguaacccgcgagccguaugugucaugcgaccccgaugagugucgauuuuacgcacugagccaagguacuacaauccgugggaagcauaguaacggaaccauucacgacagaucccaguauagggcccuuaucucuuggccucugagcuccccacccacggucuacaauucacggguggaaugcaucggcuggaguagcacuucuugucaugauggcaaaucccgcaugucaauuugcauaagcgggccuaacaauaacgcuagugcaguugugugguauaauagaaggccagucgccgagaucaacaccugggcucggaauauuuugcgcacacaggaaucugagugugugugccacaacggaguaugucccguuguguucacugacgguuccgccaccggcccugcggagacacgaaucuacuacuuuaaggaagggaagauacucaaaugggagagccugaccggaacggcaaagcacauugaagagugcucgugcuauggcgaaagaacugguaucacauguaccugcagggauaauuggcaggggucuaaccggccagucauccaaauugacccgguggccaugacucauacaucccaguacaucuguucacccgugcugaccgauaauccucguccaaacgaccccaaugucggaaaaugcaacgauccuuauccaggcaauaacaacaauggcguuaagggguucaguuaccucgacggagugaacacgugguuaggucgcaccauuagcacagcuuccagaucuggcuaugagaugcugaaaguacccaaugcccuuacugaugacaggagcaagccgauacaggggcagaucauuguguugaacaccgacuggucaggauacaguggcuccuuuauggauuauugggcagagggugacuguuaccgggcuugcuucuacgucgaacugauccgagggcgcccuaaggaggauaaagugugguggacaagcaauucuaucguuucaauguguaguagcacugaauuucuaggccaauggaacuggcccgacggagccaagauugaguauuuccucuga

SEQ ID NO: 145730 - RNA, 1413 nt, Artificial Sequence
  derived and/or modified sequence opt3 from neuraminidase__InfluenzaA__AGQ81970
augaaccccaaucagaagauccugugcaccagcgccacagcuauugugauaggcacuaucgcaguccucauugggaucgccaaccuuggacugaauauugguuugcacuuaaaaccuuccuguaacugcucucauucacaaccagaggaaacgaaugcgagucagaccaucauaaacaauuacuauaacgagacaaauaucacucagauuagcaacaccaauauccagauggaagagagagcuuccaggggcuucaacaaucugacaaaggggcuauguaccauuaacucuuggcacaucuacggaaaagacaaugccguucggauaggcgaaaacucggaugugcucguaacucgcgagccguaugugucaugcgaccccgaugagugucgauuuuacgcacugagccaagguacaaccauucgugggaagcauaguaacggaacgauccacgacagaucccaguauagggcccuuauuucuuggccucugagcuccccacccacugucuacaauucacggguggaaugcaucggcuggaguagcaccucuugucaugauggcaaaucccgcaugucaaucugcauuagcgggccuaacaauaacgcuagugcaguugugugguauaauaagagaccagucgccgagauaaacacaugggcuaggaauaucuugcggacucaggaaucugagugugugugccacaacggaguaugucccguuguguucaccgacgguuccgccacaggcccugcggauacccgcauuuacuacuuuaaggaggggaaaauccucaagugggaaccacugacgggaacugcaaaacacauagaggaaugcagcugcuauggcgagcgaacagguauuaccuguacuugcagagacaauuggcaggggucgaacaggccggucauccaaaucgaucccguggccaugacacauaccucucaguacauuuguuccccugugcugacggacaauccacggcccaacgauccuaaugucggaaagugcaacgacccauaucccggcaauucaaacaacggcguuaaaggguucaguuaccucgauggagugaauaccugguuaggucguacaaucagcacugcuucccgcucuggcuaugaaaugcugaagguaccgaacgcccuuaccgacgacagaagcaagccuauucaggggcagacaauaguguugaauacugauuggucaggauacaguggcuccuuuauggacuauugggcagagggugauuguuacagggcuugcuucuacgucgagcugauccgggggcgacccaaagaagacaaggugugguggaccagcaacucuauuguuucaauguguaguagcacagaguuucuaggccaauggaauuggccagauggagccaaaaucgaauauuuccucuga

SEQ ID NO: 145731 - RNA, 1413 nt, Artificial Sequence
  derived and/or modified sequence opt3 from neuraminidase__InfluenzaA__AGQ81971
augaaccccaaucagaagauccugugcaccagcgccacagcuauuauaaucggcgcaauugccgugcucaucgggauugcgaaccuuggacugaauaucgguuugcacuuaaaaccuuccuguaacugcucucauucacaaccagagacuacgaauaccagucagacaauaaucaacaauuacuauaacgaaacuaauauuacccagaucagcaacacaaauauucagauggaggaaagaaccuccaggggcuucaacaaucugacuaaggggcuauguacaaucaacucuuggcacauauacggaaaagacaaugcuguccggauuggcgagucgucagauguucucgugacccgcgaaccguauguaagcugcgaccccgaugagugucgauuuuacgcccugagucaagguacgacuauccgugggaagcauuccaacggaaccauucacgacagaucucaguauagggcacuuaucagcuggccucuguccucaccacccacaguguacaguagccgggucgagugcaucggcuggucuuccacuucaugucaugauggcaaaagccgcaugaguauuugcauaucugggccuaacaauaacgccuccgcugugguuugguauaauagaaggccaguggcagaaaucaacaccugggcccggaauauuuugcgcacacaggagagcgaaugugucugccacaacggagugugucccguaguuuucaccgacgguucggcuacgggcccugccgauacucgaaucuacuacuuuaaggaggggaagauacucaaaugggagucucugacaggaaccgcgaagcacauugaagagugcuccugcuauggcgaaagaacugguaucacauguaccugcagggacaauuggcaggggucaaaccggccagugauccaaauugauccggucgcaaugacgcauaccagucaguacaucuguagccccgugcugacagacaauccucguccaaacgaucccaauauuggaaaaugcaacgacccuuauccaggcaauaacaauaacggcgugaagggguucuccuaccucgauggagccaacacuugguuaggucgcaccauaucuacagcuagcagaucaggcuaugagaugcugaaaguccccaaugcccuuacugacgacaggaguaagccgauccaggggcagaccauuguuuugaacacagauugguccggauacagcggcucuuuuauggacuauugggcagaaggugauuguuaccgggcuugcuucuacguggagcugauccgagggcgcccuaaggaggacaaaguaugguggaccucaaauaguaucgugagcauguguuccucuacugaauuucuaggccaauggaacuggcccgauggagccaagauugaguauuuccucuga

SEQ ID NO: 145732 - RNA, 1413 nt, Artificial Sequence
  derived and/or modified sequence opt3 from neuraminidase__InfluenzaA__AGQ81972
augaaccccaaucagaagauccugugcaccagcgccacagcuauuauaaucggcgcaauugccgugcucaucgggauugcgaaccuuggacugaauaucgguuugcacuuaaaaccuuccuguaacugcucucauucacaaccagagacuacgaauaccagucagacaauaaucaacaauuacuauaacgaaacuaauauuacccagaucagcaacacaaauauucagauggaggaaagagcuuccaggggcuucaacaaucugaccaaggggcuauguacuaucaacucuuggcacauauacggaaaagacaaugccguccggauuggcgagucgucagauguucucgugacacgcgaaccguauguaagcugcgaccccgaugagugucgauuuuacgcacugagucaagguaccacgauccgugggaagcauuccaacggaacuauucacgacagaucucaguauagggcccuuaucagcuggccucuguccucaccacccaccguguacaacagucgggucgagugcaucggcuggagcucuacauccugucaugauggcaaaucacgcaugagcauuugcauaagugggccuaauaacaaugcuucugcagugguuugguauaacagaaggccaguggccgaaaucaauacuugggcucggaacauuuugcgcacccaggaguccgaaugugucugccacaauggagugugucccguaguuuucacagacgguagcgccaccggcccugcggauacgcgaaucuacuacuuuaaggaggggaagauacucaaaugggagucgcugacuggaacagcaaagcacauugaagagugcucuugcuauggcgaaagaaccgguaucacuuguacaugcagggacaacuggcagggguccaaucggccagugauccaaauugauccggucgccaugacccauacgucacaguacaucuguagucccgugcugaccgacaacccucguccaaaugaucccaacauuggaaaaugcaaugacccuuauccaggcaacaauaacaacggcgugaagggguucagcuaccucgauggagcuaauacaugguuaggucgcacuauauccaccgccucuagaagcggcuaugagaugcugaaaguccccaacgcacuuacagacgacaggucaaagccgauccaggggcagacuauuguuuugaauaccgauuggaguggauacuccggcagcuuuauggacuauugggcugaaggugauuguuaccgggccugcuucuacguggagcugauccgagggcgcccuaaggaggacaaaguaugguggacaucuaacucaaucgugaguauguguagcuccaccgaauuucuaggccaauggaauuggcccgauggagcgaagauugaguauuuccucuga

SEQ ID NO: 145733 - RNA, 1413 nt, Artificial Sequence
  derived and/or modified sequence opt3 from neuraminidase__InfluenzaA__AGQ81973
augaaccccaaucagaagauccugugcaccagcgccacagcuauuauaaucggcgcaauugccgugcucaucgggauugcgaaccuuggacugaauaucgguuugcacuuaaaaccuuccuguaacugcucucauucacaaccagagacuacgaauaccagucagacaauaaucaacaauuacuauaacgaaacuaauauuacccagaucagcaacacaaauauucagauggaggaaagaaccuccaggggcuucaacaaucugacuaaggggcuauguacaaucaacucuuggcacauauacggaaaagacaaugcuguccggauuggcgagucgucagauguucucgugacccgcgaaccguauguaagcugcgaccccgaugagugucgauuuuacgcccugagucaagguacgacuauccgugggaagcauuccaacggaaccauucacgacagaucucaguauagggcacuuaucagcuggccucuguccucaccacccacaguguacaacagucgggucgagugcaucggcuggagcucuacuuccugucaugauggcaaaucacgcaugagcauuugcauaagugggccuaauaacaaugccucugcugugguuugguauaacagaaggccaguggcagaaaucaauaccugggcccggaacauuuugcgcacacaggaguccgaaugugucugccacaauggagugugucccguaguuuucaccgacgguagcgcuacgggcccugccgauacucgaaucuacuacuuuaaggaggggaagauacucaaaugggagucgcugacaggaaccgcgaagcacauugaagagugcucuugcuauggcgaaagaacugguaucacauguaccugcagggacaacuggcagggguccaaucggccagugauccaaauugauccggucgcaaugacgcauaccucacaguacaucuguagucccgugcugacagacaacccucguccaaaugaucccaacauuggaaaaugcaaugacccuuauccaggcaacaauaacaacggcgugaagggguucagcuaccucgauggagccaauacuugguuaggucgcaccauauccacagcuucuagaagcggcuaugagaugcugaaaguccccaacgcccuuacugacgacaggucaaagccgauccaggggcagaccauuguuuugaauacagauuggaguggauacuccggcagcuuuauggacuauugggcagaaggugauuguuaccgggcuugcuucuacguggagcugauccgagggcgcccuaaggaggacaaaguaugguggaccucuaacucaaucgugaguauguguagcuccacugaauuucuaggccaauggaauuggcccgauggagccaagauugaguauuuccucuga

SEQ ID NO: 145734 - RNA, 1413 nt, Artificial Sequence; identical to SEQ ID NO: 145714
  derived and/or modified sequence opt3 from neuraminidase__InfluenzaA__AGQ81974

SEQ ID NO: 145735 - RNA, 1398 nt, Artificial Sequence
  derived and/or modified sequence opt3 from neuraminidase__InfluenzaA__AGQ81975
augaaccccaaucagaagauccugugcaccagcgccacagcuauuauaaucggcgcaauugccgugcucaucgggauugcgaaccuuggacugaauaucgguuugcacuuaaaaccuggcuguaacugcucccauucucaaccagagacuacgaauaccucacagacaauaaucaacaauuacuauaacgaaacuaauauuaccaacauccagauggaggaaagaacaaguaggaauuucaacaaucugaccaaguggcuauguacuauuaacagcuggcacaucuacgggaaagacaaugcuguccggauaggagagaacuccgauguucucgugacacgcgaaccguauguaucuugcgaccccgaugagugucgauuuuacgcccugucgcagggcaccacgauucgugguaagcauucaaacgggacuauccacgacagaagccaauauagggcacuuauuaguuggccucuguccucuccacccaccguguacaauagccgggucgagugcaucggaugguccucaacaaguugucaugauggcaaaagccgcaugucuaucugcauuuccggcccuaacaauaacgccucagcugugguuugguauaauagaaggccaguggcagaaauaaacacuugggcccggaauaucuugcgcacccaggagagcgaaugugucugccacaacggggugugucccguaguuuucacagacggaagugcuaccgguccugccgauacgcgaauuuacuacuuuaaggagggcaagauccucaaaugggagucucugacugggacagcgaagcacauagaagagugcuccugcuauggagaaagaaccggcauuacuuguacaugcagggacaauuggcaggguagcaaccggccagugauccagaucgauccggucgcaaugacccauacgucgcaauacauuuguucucccgugcugaccgacaauccucguccagaugaccccaacaucgggaaaugcaaugauccuuauccaggaaacaauaacaacggcgugaagggcuucuccuaccucgacggggccaauacaugguuaggacgcacuauuucaaccgcuaguagaagcgguuaugagaugcugaaaguccccaacgcccuuacagacgauagguccaagccgauacagggccagacuaucguuuugaaugcagacuggucuggguacagcggaucauuuauggauuauugggcugacggcgauuguuaccgggccugcuucuacguggaacugauucgaggucgcccuaaggaggacaaaguaugguggaccaguaacuccaucgugagcauguguucuucaacagaguuucuagggcaguggaauuggcccgauggcgcgaagaucgaauauuuccucuga

SEQ ID NO: 145736 - RNA, 1398 nt, Artificial Sequence
  derived and/or modified sequence opt3 from neuraminidase__InfluenzaA__AGQ81977
augaaccccaaucagaagauccugugcaccagcgccacagcuauuauaaucggcgcaauugccgugcucaucgggauugcgaaccuuggacugaauaucgguuugcacuuaaaaccuggcuguaacugcucccauucucaaccagagacuacgaauaccucacagacaauaaucaacaauuacuauaacgaaacuaauauuaccaacauccagauggaggaaagaacaaguaggaauuucaacaaucugaccaaggggcuauguacuauuaacagcuggcacaucuacggaaaagacaaugcuguccggauaggcgaguccucugauguucucgugacacgcgaaccguauguaucgugcgaccccgaugagugucgauuuuacgcccugucacaggguaccacgauucgugggaagcauagcaacggaacuauccacgacagaagucaauauagggcacuuauuuccuggccucugucuagcccacccaccguguacaacucccgggucgagugcaucggcuggucaaguacaagcugucaugauggcaaaucucgcauguccaucugcauuucagggccuaauaacaaugccagcgcugugguuugguauaacagaaggccaguggcagaaauaaauacuugggcccggaacaucuugcgcacccaggagagugaaugugucugccacaauggagugugucccguaguuuucacagacgguucugcuaccggcccugccgauacgcgaauuuacuacuuuaaggaggggaagauccucaaaugggagucccugacuggaacagcgaagcacauagaagagugcagcugcuauggcgaaagaaccgguauuacuuguacaugcagggacaacuggcaggggucgaaucggccagugauccagaucgauccggucgcaaugacccauacgucucaauacauuuguucccccgugcugaccgacaacccucguccagaugaccccaauaucggaaaaugcaacgauccuuauccaggcaauaacaauaacggcgugaagggguucucauaccucgacggagccaacacaugguuaggucgcacuauuaguaccgcuagcagauccggcuaugagaugcugaaaguccccaaugcccuuacagacgauaggucuaagccgauacaggggcagacuaucguuuugaacgcagacuggagcggauacucaggcaguuuuauggauuauugggcugacggugauuguuaccgggccugcuucuacguggaacugauucgagggcgcccuaaggaggacaaaguaugguggaccuccaauagcaucgugucuauguguucaaguacagaguuucuaggccaguggaacuggcccgauggagcgaagaucgaauauuuccucuga

SEQ ID NO: 145737 - RNA, 1398 nt, Artificial Sequence
  derived and/or modified sequence opt3 from neuraminidase__InfluenzaA__AGQ81979
augaaccccaaucagaagauccugugcaccagcgccacagcuauuauaaucggcgcaauugccgcgcucaucgggauugcuaaccuuggacugaauaucgguuugcacuuaaaaccuggcuguaacugcucccauucucaaccagagacuacgaauaccucacagacaauaaucaacaauuacuauaacgaaacuaauauuaccaacauccagauggaggaaagaacaaguaggaauuucaacaaucugaccaaggggcuauguacuauuaacagcuggcacaucuacggaaaagacaaugccgugcggauaggcgaguccucugauguccucguuacacgcgaaccguaugugucgugcgaccccgaugagugucgauuuuacgcacugucacaggguaccacgauucgugggaagcauagcaacggaacuauccacgacagaagucaauauagggcccuuauuuccuggccucugucuagcccacccaccguauacaacucccggguggagugcaucggcuggucaaguacaagcugucaugauggcaaaucucgcauguccaucugcauuucagggccuaauaacaaugcuagcgcagucgugugguauaacagaaggccaguugccgaaauaaauacuugggcucggaacaucuugcgcacccaggagagugaaugugugugccacaauggagucugucccgugguauucacagacgguucugccaccggcccugcggauacgcgaauuuacuacuuuaaggaggggaagauccucaaaugggagucccugacuggaacagcaaagcacauagaagagugcagcugcuauggcgaaagaaccgguauuacuuguacaugcagggacaacuggcaggggucgaaucggccaguuauccagaucgauccgguggccaugacccauacgucucaauacauuuguucccccguccugaccgacaacccucguccagaugaccccaauaucggaaaaugcaacgauccuuauccaggcaauaacaauaacggcgugaagggguucucauaccucgacggagcuaacacaugguuaggucgcacuauuaguaccgccagcagauccggcuaugagaugcugaaagugcccaaugcacuuacagacgauaggucuaagccgauacaggggcagacuaucgucuugaacgcugacuggagcggauacucaggcaguuuuauggauuauugggccgacggugauuguuaccgggcgugcuucuacguugaacugauucgagggcgcccuaaggaggacaaagugugguggaccuccaauagcaucguaucuauguguucaaguacagaguuucuaggccaguggaacuggcccgauggagccaagaucgaauauuuccucuga

SEQ ID NO: 145738 - RNA, 1398 nt, Artificial Sequence; identical to SEQ ID NO: 145736
  derived and/or modified sequence opt3 from neuraminidase__InfluenzaA__AGQ81980

SEQ ID NO: 145739 - RNA, 1350 nt, Artificial Sequence
  derived and/or modified sequence opt3 from neuraminidase__InfluenzaA__AGQ88501
augaaccccaaucagaagaucgugaccauuggcagcauaugcauggucaucgggauuguuucccugaugcuccaaaucggaaacaugauuucuaucugggugucacacaguauacagacagguaaucagcaucagacugagccuaucagaaacacgaauuuccuuaccgaaaacgccguagcuagcguggcacuguccggcaauucuucguuguguccaauuagggggugggccguccacucaaaagacaacagcauccggauuggaaguaagggcgauguguuuguuauccgcgagccguucauauccugcucuaauuuagaaugucgaacauuuuuccugacucaaggugcgcuacucaacgacaaacauagcaaugggaccgugaaggaucguucaccccacagaacacugauguccugcccuauuggagaggcuccaagucccuacaacagcagguuugaaucugucgccugguccgcaucagccugucaugacggcaucagcuggcuuaccauuggcaucagugggccugauaauggagcuguggcaguacugaaauauaacgguaucauuacugacacaauaaagucuuggcggaauaacaucuugcgcacccaggaguccgagugcacguguguuaacggcagcugcuucacugugaugaccgaugggccaucgaauggacaggccucuuacaagauuuuuaaaaucgaaaagggcaaagucgugaaguccguggagcucaacgcucccaauuaucacuacgaagaguguucaugcuauccugacgccggugagauaauuugugucugcagagauaacuggcacgggaguaauaggccauggguuagcuucaaccagaaucuggaauaccaaaucggauauaucugcuccggcguguuuggcgacaacccgcggcccaaugauggggagggaucuugugguccuguaagcccaaacggcgcguacggggugaaaggauucucauuuaaguacggcaauggugucuggauugggcgcacaaagaguacucauucccgaagcggcuucgaaaugaucugggaccccaacggauggaccggcacagauucugaguuuucaaugaaacaggacauuguggcaauaaccgacuggaguggguauagcggauccuucguucagcacccugaacugacgggucucgauugcaucagaccauguuucuggguggaguuaauuaggggccggcccaaggagucuacuaucuggacaucggggagcuccaucucauuuugcggagucaauagugacaccgugucuuggagcuggccggauggcgccgaacugccuuucacuauugacaaauga

SEQ ID NO: 145740 - RNA, 1401 nt, Artificial Sequence; identical to SEQ ID NO: 145618
  derived and/or modified sequence opt3 from neuraminidase__InfluenzaA__AGR33906

SEQ ID NO: 145741 - RNA, 1401 nt, Artificial Sequence
  derived and/or modified sequence opt3 from neuraminidase__InfluenzaA__AGR33908
augaaccccaaucagaagaucaccgccauuggcagcgugucccugauaaucgcuauuaucugccuccuuaugcaaauugcaauccugacaacuacgaugaccuugcacuucagacagaacgaguguucuaauccuucaaacaaucaggucaugccaugcgaaccgauaaucauugagaggaacacaguucauuuaaauaguacuaccaucgaacgggagauuugucccaaaguggccgaauacaagaacuggagcaaaccucagugccaaaucacaggguuugcgccauucuccaaggacaauucuauacgccugucggcuggaggugauauuuggguaacccgagagcccuaugugucauguagcccugacaaaugcuaccaguuugcccuaggccaggggacuacacucaagaacaagcacaguaauggaaccacgcaugaucguacuccacacagaacccugcuuaugaacgagcugggcguccccuuccauuuggguacaaaacagguguguaucgcaugguccucuagcuccugcuaugacgggaaggccuggcuccacauuuguguuacuggagaugacaaaaaugcuaccgcaucaaucaucuacgauggcaugcugguggacaguauuggcagcuggucuaagaacauacugaggacacaagaauccgagugcgucuguaucaaugggaccugcgccgugguaaugacggauggaucagcuagcggugaagccgacacucggauucucuuuauccgcgagggcaaaauaauuaacaucaguccuuuaucuggguccgcgcagcacguugaggaaugcagcuguuauccaagauacccggaggugaggugcgucugucgggauaacuggaagggaucgaaucgccccaucauuuauaucaacaugguggacuacucuauugaaucccgauacgugugcucaggccuggucggugauacaccuagaaaugacgacaguaccagcuccucuaacuguagggauccaaauaacgagcguggggcacccggaguuaagggcugggccuucgacgauggcaaugacguguggauggggcggacuaucaaaaacggaagccgcucagguuaugaaacauuuagaguaauaaauggcuggaccauggcuaacaguaagucccagauuaauaggcaagugaucgucgauagcgacaacuggucuggguacucaggaaucuucaguguggagggcaaaaagugcauuaaucgguguuuuuauguugagcuuauacgaggucgcccucaggaaccaagagugugguggacgagcaacuccaucauugucuucugcgggaccucuggcacauacggaacuggcucguggcccgauggggccgacaucaauuuuaugccgauuuga

SEQ ID NO: 145742 - RNA, 1401 nt, Artificial Sequence
  derived and/or modified sequence opt3 from neuraminidase__InfluenzaA__AGR33910
augaaccccaaucagaagaucauugccauaggcagcgugucccugaccaucgcuauuaucugcuuccucaugcaaauugcaauccuuacaacuacgaugacccugcacuuuaaacagaacgaguguucuaagccuucaaauaaccaggucguuccaugcgaaccgauauugaucgagagaaauacagugcauuuaaacaguacuaccauugaaaaagagguaugucccaagguggccgaauacaaaaauuggagcaagccucagugccaaaucacaggguucgcgccauuuuccaaggacaacucuauuaggcugucggcuggaggugauaucugggucacccgggagcccuaugugucauguagcuucggcaaaugcuaccaguuugcccuagggcagggaacuacacucaagaauaaacacaguaacggcaccacgcaugaccgcacuccucaccgaacccugcuuaugaaugagcuggguguuccauuccauuuggggacaaaacagguguguauagcaugguccucuagcuccugcuaugauggaaaggccuggcuccacauuugugucacuggcgacgauaagaacgcuaccgcaucaaucauuuacgacggcaugcugguggauaguaucgggagcuggucuaagaauauccugcguacacaagaauccgagugcguauguauuaacggaaccugcgccguugugaugacggacgguucagcuagcggcaaagccgauacuagaauacucuuuaucagggaagggaagauuaucaauauacggcccuuaaguggaucugcgcagcacgucgaggagugcuccuguuauccucgcuacccagaagugagaugcguguguagggacaacuggaaaggcagcaaccggccgguccuguauauuaauauggcagauuacucgguugagucuuccuacgugugcucaggucuuguaggggacacaccccgcaacgaugacaguagcuccucuagcaauugucgagacccuaacaaugaaagaggagccccaggcgugaagggcugggcuuucgaugacgggaacgaugucuggaugggaaggaccauccggaaugacucacguagugguuaugagacuuuucgcgugguuaacggcuggacaaccgccaauuccaaaagccagaucaacagacaggugauugucgauucugaaaauuggucaggguacaguggaaucuucagcguggagggcaagaacugcauuaauagguguuuuuauguagaguugauacggggucgaccccaagaaccucgcguuugguggacguccaacucuaucauuguguucugcgggaccucgggcacauacggaacuggcagcuggccagacggggcaaauaucaacuuuaugcccaucuga

SEQ ID NO: 145743 - RNA, 1401 nt, Artificial Sequence
  derived and/or modified sequence opt3 from neuraminidase__InfluenzaA__AGR33911
augaaccccaaucagaagaucauugccauaggcagcgugucccugaccaucgcuauuaucugcuuccucaugcaaauugcaauccuuacaacuacgaugacccugcacuuuaaacagaacgaguguucuaauccuucaaacaaucaggucguuccaugcgaaccgauauugaucgagagaaacacagugcauuuaaauaguacuaccauugaaaaggagguaugucccaaaguggccgaauacaagaacuggagcaaaccucagugccaaaucacaggguucgcgccauuuuccaaggacaauucuauuaggcugucggcuggaggugauaucugggucacccgggagcccuaugugucauguagccuaggcaagugcuaccaguucgcccucgggcagggaacuacacugaaaaacaaucacaguaacggcaccacgcaugaccgcacuccucaccgaacccuucugaugaaugaguuggguguuccauuucaucucgggacaaagcagguuuguauagcaugguccucuagcuccugcuaugauggaaaagccuggcugcacauuugugucacuggcgacgauaagaacgcuaccgcaucaaucauuuacgacggcaugcugguggauaguaucgggagcuggucuaaaaauauccuccguacacaagaauccgagugcguauguauuaacggaaccugcgccguugugaugacggacgguucagcuagcggcaaggccgauacuagaauauuauucaucagggaagggaagauuaucaacauaaguccccugucuggauccgcgcagcacgucgaggagugcagcuguuauccucgguacccagaagugcgcugcguguguagagacaauuggaaaggcucgaacaggccgguccuuuauauuaauauggcagauuacucuaucgaguccucauacguuugcagugguuuggugggggacacaccccggaacgaugacagcuccucuagcucaaauugucgcgacccuaacaaugaacgaggagccccaggcguaaagggcugggcuuuugaugacgggaacgauguguggaugggaagaaccaucaggaauaacagucgguccgguuaugagacuuuccgugucgugaauggcuggacaaccgccaacagcaaaucucagauuaaucgccagguuaucguggacucagaaaacuggaguggguacagcggaauauuuuccgucgagggcaagaauugcauuaacagauguuucuauguggagcugaucaggggucggccccaagaaccucgaguaugguggacgucuaacucgauuaucguguuuugcgggaccagcggcacauacggaacuggcuccuggccagauggggcaaauaucaacuucaugcccauuuga

SEQ ID NO: 145744 - RNA, 1356 nt, Artificial Sequence; identical to SEQ ID NO: 145659
  derived and/or modified sequence opt3 from neuraminidase__InfluenzaA__AGR33912

SEQ ID NO: 145745 - RNA, 1356 nt, Artificial Sequence; identical to SEQ ID NO: 145689
  derived and/or modified sequence opt3 from neuraminidase__InfluenzaA__AGR33913

SEQ ID NO: 145746 - RNA, 1356 nt, Artificial Sequence; identical to SEQ ID NO: 145659
  derived and/or modified sequence opt3 from neuraminidase__InfluenzaA__AGR33915

SEQ ID NO: 145747 - RNA, 1356 nt, Artificial Sequence
  derived and/or modified sequence opt3 from neuraminidase__InfluenzaA__AGR33916
augaaccccaaucagaagcuguucgccagcuccggcguggcuaucgcacucucuguccuuaaccuguugauuggguuaucaaauguuggacugaacgugagucuacaccucaaagagaccgguccuaagcaagaagagaaucugacaugcaugacuacgaaagaaaccgagcuuggcacaccaagcuaccuguugcucaacaagucccuguguaauguagaaggguggguggucauagccaaagacaacgcggugagauuuggagagucugagcagaucauuaucacuagggaaccguauguuucgugcgaucccaauggcuguaagauguacgcucugcaucaggguaccacaauucggaacaagcacucaaaugggaccauccaugaccgcacugccuuccgaggacucauaagcacaccuuuaggcaccccacccacggugaguaacuccgauuuuaucugcgucggcuggucuagcacuaccugucacgacgggauuggacguaugacaaucugcauucaggguaauaacgauaaugcaacugccaccguguauuacaacagaaggcugacaaccacgaucaaaacuugggcucggaacauacuucgcacacaagaguccgaauguguaugccauaauggcaccugugcaguugugaugacugacgggucagccaguagccaggcucacacaaaggucauguauuuccacaaaggauugguggugaaggaggaggcccugaaaggcucugcgaagcauauugaagagugcuccuguuacggucacaaccagaagguuaccugcgucugcagagauaauuggcagggggcaaacaggccuaucauugaaaucgacaugaauacgcuagagcauaccucacgguauguguguacaggaauccucacugauaccagccgcccaggcgacaaacccacaggcgauugcaguaacccuauuacugggucuccaggagccccggguguaaagggcuuuggguuccugaauggagacaacaccuggcuuggccgaacaauaucccccagaagcaggucggguuuugaaaugcugaaaaucccuaaugcugggauugauccaaacucucggaucgccgagcgucaagagauaguggacaauuccaacuggucaggcuacaguggcagcuucauugacuacuggaaugauaacuccgaauguuauaaucccugcuuuuacgucgaguugauccgcggaagaccugaagaggcaaaguaugugugguggaccucuaacagccucaucgcucugugugggucaccauuccccguuggaagugguuccuuuccggacggcgcccagauucaguacuucagcuga

SEQ ID NO: 145748 - RNA, 1356 nt, Artificial Sequence; identical to SEQ ID NO: 145689
  derived and/or modified sequence opt3 from neuraminidase__InfluenzaA__AGR33917

SEQ ID NO: 145749 - RNA, 1356 nt, Artificial Sequence; identical to SEQ ID NO: 145659
  derived and/or modified sequence opt3 from neuraminidase__InfluenzaA__AGR33918

SEQ ID NO: 145750 - RNA, 1398 nt, Artificial Sequence; identical to SEQ ID NO: 145736
  derived and/or modified sequence opt3 from neuraminidase__InfluenzaA__AGR33919

SEQ ID NO: 145751 - RNA, 1413 nt, Artificial Sequence
  derived and/or modified sequence opt3 from neuraminidase__InfluenzaA__AGR45094
augaaccccaaucagaagaucauuaccauaggcagcaucuccauggccauugggaucauuucucugauccuccaaauaggaaacaucauuucaaucugggcuagucacagcauucagacagguucccagaaucauacuggcaucugcaaccagagaauaauuacguacgaaaauucuaccugggugaaccaaacauaugucaauaucaacaauacuaacguuguggcagggaaagacaagaccucgguaacacuugccggaaauucaagccuguguccuauuaggggcugggcgaucuacaccaaagauaacaguauccggauugguuccaagggggacguguucgucauacgcgagccauuuaucucuugcagccacuuggagugucgaacuuucuuuuuaacacagggagcucugcuaaaugauaaacauuccaacggcaccgugaaggaccguucaccguauagagcccucaugaguugcccccugggcgaagcaccuagcccauacaauucuagguucgaguccguugccuggucagcuagcgcaugucacgaugggaugggauggcuuacgauugguaucaguggccccgacaacggggccguggcuguccugaaguauaacggaauaauuacugaaaccaucaaaucuuggaagaaacggaucuugcgcacacaggaguccgagugcguguguguaaauggcagcugcuuuacuauuaugaccgaugguccuucgaacgggccagccucuuacagaaucuucaagauugaaaaaggaaagauaacaaaguccaucgagcucgacgcgcccaauuaucauuacgaagaguguucaugcuacccugauaccggcacgguuaugugugugugcagggacaacuggcacggcaguaaucggccaugggucagcuuuaaccagaaucuggauuaucaaauuggguacaucugcuccggaguguucggugacaacccgcgccccaaagauggcgaggggucuuguaauccugugacugucgacggagcagacggcguuaaggguuuuagcuaucgauacgggaacggcguguggaucggaagaacaaaaucaaauaguuccaggaagggcuucgaaaugauuugggauccaaacggguggaccgacacugauagcgacuuuucuguaaaacaggaugugguccccaugacagacuggucaggauauagugguagcuucgugcagcacccugagcugaccggccucgauugcaugcggccauguuuuuggguugaauuaauacgugggcgccccagagagaauacgaccaucuggacauccggaucuucgauuagcuucugcggcgugaacuccgacacugccaauuggucauggccggaugacgcugaacugccucuuaccaucgauaaguga

SEQ ID NO: 145752 - RNA, 1413 nt, Artificial Sequence; identical to SEQ ID NO: 140946
  derived and/or modified sequence opt3 from neuraminidase__InfluenzaA__AGR49780

SEQ ID NO: 145753 - RNA, 1410 nt, Artificial Sequence
  derived and/or modified sequence opt3 from neuraminidase__InfluenzaA__AGR49804
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacugaccggaaauucgucauugugcccugugagcggaugggccauauacaguaaggacaacuccguuagaauuggcucuaaaggugauguguuugucaucagggagccauucauuagcuguuccccguuagaaugccggacauuuuuccugacccagggggcgcuacucaaugacaagcauucaaacggaacuaucaaagaucgcagucccuaucgaacacugaugagcuguccuaucggcgaggugccaucucccuacaacucccguuuugaaucaguagcuuggagcgccagugcaugccacgacggcauuaauuggcuuaccauagggaucucuggaccugauaacggugccguugcugugcugaaguauaauggcauuaucacggacacuauaaaguccuggagaaacaauauuuugaggacccaagagagcgagugugcaugcgucaacgggucguguuucacagugaugacugauggaccaucuaauggccaggccuccuacaaaaucuuucggaucgaaaaggguaaaauugugaagucagucgagaugaacgcucccaauuaucauuacgaagagugcaguuguuacccugacagcuccgagauuaccugcguuugccgcgauaacuggcacgggucuaauagaccaugggugagcuucaaccagaaucucgaauaucagaucggauacauauguucaggcaucuuuggcgacaacccgaggcccaaugauaaaacagggaguugcggaccuguauccagcaacggugccaacggcgugaagggguucucuuuuaaguauggaaauggcgucuggauuggucggaccaaaucaaucaguagccgcaacggguucgagaugaucugggacccaaauggcuggacgggaacugauaacaauuuuuccauuaagcaagacauagugggcaucaacgaauggucuggguacucggggagcuucguucagcaucccgagcugacaggucuggacuguauucgaccuugcuucuggguggaacucaucagaggcaggccaaaagagaauaccauuuggacuuccgggucaaguaucucuuuuuguggagucaacagcgauacagugggcugguccuggcccgacggugcggaguuaccguucaccauagauaaguga

SEQ ID NO: 145754 - RNA, 1413 nt, Artificial Sequence; identical to SEQ ID NO: 140946
  derived and/or modified sequence opt3 from neuraminidase__InfluenzaA__AGR49820

SEQ ID NO: 145755 - RNA, 1410 nt, Artificial Sequence; identical to SEQ ID NO: 138106
  derived and/or modified sequence opt3 from neuraminidase__InfluenzaA__AGR49832

SEQ ID NO: 145756 - RNA, 1413 nt, Artificial Sequence; identical to SEQ ID NO: 140946
  derived and/or modified sequence opt3 from neuraminidase__InfluenzaA__AGR49844

SEQ ID NO: 145757 - RNA, 1413 nt, Artificial Sequence; identical to SEQ ID NO: 140946
  derived and/or modified sequence opt3 from neuraminidase__InfluenzaA__AGR49856

SEQ ID NO: 145758 - RNA, 1413 nt, Artificial Sequence; identical to SEQ ID NO: 140946
  derived and/or modified sequence opt3 from neuraminidase__InfluenzaA__AGR49868

SEQ ID NO: 145759 - RNA, 1410 nt, Artificial Sequence; identical to SEQ ID NO: 138744
  derived and/or modified sequence opt3 from neuraminidase__InfluenzaA__AGR49880

SEQ ID NO: 145760 - RNA, 1410 nt, Artificial Sequence; identical to SEQ ID NO: 140500
  derived and/or modified sequence opt3 from neuraminidase__InfluenzaA__AGR49891

SEQ ID NO: 145761 - RNA, 1410 nt, Artificial Sequence
  derived and/or modified sequence opt3 from neuraminidase__InfluenzaA__AGR49903
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcaucacaggggacgauaagaaugcaaccgccagcuucaucuacaacggaagacugguggacuccauuguaucauggaguaaagagauacugaggacgcaggaaagcgaguguguuugcaucaauggcacuuguacaguggucaugaccgauggcucugcuuccgggaaggcagacacuaaaauucucuuuaucgaggaaggaaagauagugcacacaucaaccuuaagcgguagugcccaacacguggaggaaugcucuugcuauccucgguacccaggcguccgcuguguuugcagagauaacuggaagggguccaacaggccgauuguggacaucaauaucaaagaccauagcauuguaucgucuuacguguguuccggacuggucggcgauacgccccggaagaacgacucaaguagcuccggucacugccuugauccuaauaacgaggaagggggacauggcgugaaaggcugggcuuucgacgaugggaaugacguuuggaugggacgcaccaucucugaaaagagccgauuggguuaugagacauuuaaagugauugagggcuggucaaacccaaagaguaaacugcagauaaauagacaggucaucguggauagggggaaccgguccggauacagcggcauuuucucuguagaggguaagucauguaucaaucguugcuuuuauguugaacuaauccgcgggagaaaggaggaaacugaggugcucuggaccaguaacagcauugucguguucuguggcacauccggaacuuacggcaccgggucuuggcccgacggagccgauauaaaucugaugccuaucuga

SEQ ID NO: 145762 - RNA, 1410 nt, Artificial Sequence; identical to SEQ ID NO: 138106
  derived and/or modified sequence opt3 from neuraminidase__InfluenzaA__AGR49915

SEQ ID NO: 145763 - RNA, 1410 nt, Artificial Sequence; identical to SEQ ID NO: 138106
  derived and/or modified sequence opt3 from neuraminidase__InfluenzaA__AGR49927

SEQ ID NO: 145764 - RNA, 1410 nt, Artificial Sequence
  derived and/or modified sequence opt3 from neuraminidase__InfluenzaA__AGR49939
augaaccccaauaagaaaaucauuaccauaggcagcgugucccugacaaucucuacuauuugcuucuuuaugcagaucgccauucucaucacgaccgucacacuucacuucaagcaauacgaguuuaacucaccuccaaauaaccagguuaugcugugugaaccgacuauaaucgagagaaauauuaccgaaaucguguauuugacaaacaccacuauugagaaagaaaucugccccaaguuagcugaguacaggaauuggaguaaaccucagugugacauaacaggguucgcaccauuuagcaaggauaacuccauucggcugucugccggaggugacaucuggguaacccgcgagcccuaugugucgugcgauccugacaaguguuaccaguucgcgcuaggccaagggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaaaaaugcaaccgccagcuucaucuacaacggaaggcugguggacuccauuguaucauggaguaaggagauacugcggacgcaggaaagcgaguguguuugcaucaauggcacuuguacaguggucaugaccgauggcucugcuuccgggaaagcagacacuaagauucucuuuaucgaggaaggaaagauagugcauacaucaaccuuaagcgguagugcccagcacguggaggaaugcucuugcuauccucgcuacccaggcgucagauguguuugcagggauaacuggaaaggguccaaccggccgauuguggacaucaauaucaaggaccacagcauuguaucgucuuacguguguuccggacuggucggcgauacgccccgcaaaaacgacucaaguagcuccggucauugccuugauccuaauaacgaggaagggggacacggcgugaagggcugggcuuucgacgaugggaaugacguuuggaugggacgaaccaucucugagaaaagcagauuggguuaugagacauuuaaggugauugaaggcuggucaaacccaaaaaguaagcugcaaauaaauaggcaggucaucguggaucgggggaaccguuccggauacagcggcauuuucucuguagaggguaagucauguaucaaucgcugcuuuuauguugaacuaaucagagggaggaaagaggaaacugaggugcucuggaccaguaacagcauugucguguucuguggcacauccggaacuuacggcaccgggucuuggcccgacggagccgauauaaaucugaugccuaucuga

SEQ ID NO: 145765 - RNA, 1410 nt, Artificial Sequence; identical to SEQ ID NO: 138701
  derived and/or modified sequence opt3 from neuraminidase__InfluenzaA__AGR49951

SEQ ID NO: 145766 - RNA, 1410 nt, Artificial Sequence
  derived and/or modified sequence opt3 from neuraminidase__InfluenzaA__AGR49963
augaaccccaauaagaaaaucauuaccauaggcagcgugucccugacaaucucuacuauuugcuucuuuaugcagaucgccauucucaucacgaccgucacacuucacuucaagcaauacgaguuuaacucaccuccaaauaaccagguuaugcugugugaaccgacuauaaucgagagaaauauuaccgaaaucguguauuugacaaacaccacuauugagaaagaaaucugccccaaguuagcugaguacaggaauuggaguaaaccucagugugacauaacaggguucgcaccauuuagcaaggauaacuccauucggcugucugccggaggugacaucuggguaacccgcgagcccuaugugucgugcgauccugacaaguguuaccaguucgcgcuaggccaagggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaaaaaugcaaccgccagcuucaucuacaacggaaggcugguggacuccauuguaucauggaguaaggagauacugcggacgcaggaaagcgaguguguuugcaucaauggcacuuguacaguggucaugaccgauggcucugcuuccgggaaagcagacacuaagauucucuuuaucgaggaaggaaagauagugcauacaucaaccuuaagcgguagugcccagcacguggaggaaugcucuugcuauccucgcuacccaggcgucagauguguuugcagggauaacuggaaaggguccaaccggccgauuguggacaucaauaucaaggaccacagcauuguaucgucuuacguguguuccggacuggucggcgauacgccccgcaaaaacgacucaaguagcuccggucauugccuugauccuaauaacgaggaagggggacacggcgugaagggcugggcuuucgacgaugggaaugacguuuggaugggacgaaccaucucuaaaaagagcagauuggguuaugagacauuuaaagugauugagggcuggucaaacccaaagaguaagcugcaaauaaauaggcaggucaucguggaucgggggaaccguuccggauacagcggcauuuucucuguagaagguaaaucauguaucaaucgcugcuuuuauguugagcuaaucagagggaggaaggaagagacugaagugcucuggaccaguaacagcauugucguguucuguggcacauccggaacuuacggcaccgggucuuggcccgacggagccgauauaaaucugaugccuaucuga

SEQ ID NO: 145767 - RNA, 1410 nt, Artificial Sequence; identical to SEQ ID NO: 138744
  derived and/or modified sequence opt3 from neuraminidase__InfluenzaA__AGR49975

SEQ ID NO: 145768 - RNA, 1413 nt, Artificial Sequence; identical to SEQ ID NO: 140946
  derived and/or modified sequence opt3 from neuraminidase__InfluenzaA__AGR49986

SEQ ID NO: 145769 - RNA, 1413 nt, Artificial Sequence; identical to SEQ ID NO: 140946
  derived and/or modified sequence opt3 from neuraminidase__InfluenzaA__AGR49998

SEQ ID NO: 145770 - RNA, 1410 nt, Artificial Sequence; identical to SEQ ID NO: 138744
  derived and/or modified sequence opt3 from neuraminidase__InfluenzaA__AGR50010

SEQ ID NO: 145771 - RNA, 1410 nt, Artificial Sequence; identical to SEQ ID NO: 138744
  derived and/or modified sequence opt3 from neuraminidase__InfluenzaA__AGR50021

SEQ ID NO: 145772 - RNA, 1410 nt, Artificial Sequence; identical to SEQ ID NO: 138754
  derived and/or modified sequence opt3 from neuraminidase__InfluenzaA__AGR50032

SEQ ID NO: 145773 - RNA, 1410 nt, Artificial Sequence
  derived and/or modified sequence opt3 from neuraminidase__InfluenzaA__AGR50043
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagacauucugcggacgcaggagagcgaaugugugugcauaaacggcacuuguacagucgugaugaccgauggcucugcuuccgggaaggcagacacuaaaauccucuuuauugaggagggaaagaucgugcauacaucaaccuuaagcgguagugcccaacacgucgaagagugcucuugcuauccucgcuacccaggcguuagaugugugugcagggauaacuggaagggguccaaucggccgauaguagacauuaacaucaaagaccacagcaucgugucgucuuacgucuguuccggacuggugggcgauacgccccgcaagaaugacucaaguagcuccucucauugccuugauccuaacaaugaagagggugggcacggaguuaaaggcugggcuuucgacgauggcaacgacguguggauggggcgaaccauuagcgaaaagucaagauugggauaugagacauuuaaagucaucgaggguuggaguaauccaaaguccaaacugcagauuaacaggcaagugauaguagaucggggcaaucguagcggguacucuggaaucuucucaguugaaggcaagaguuguauuaaccgcugcuuuuauguggagcuaaucagagguaggaaggaagagacugaaguccucuggaccagcaauuccaucguggucuucugugggacaucuggcacuuacggaaccggcucguggcccgacggggccgaucugaaccuuaugccuauuuga

SEQ ID NO: 145774 - RNA, 1410 nt, Artificial Sequence; identical to SEQ ID NO: 138744
  derived and/or modified sequence opt3 from neuraminidase__InfluenzaA__AGR50055

SEQ ID NO: 145775 - RNA, 1410 nt, Artificial Sequence
  derived and/or modified sequence opt3 from neuraminidase__InfluenzaA__AGR50066
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucuaauggccaggcuuccuacaaaaucuuuaagaucgaaaaagguaagauugugaaaucagucgagaugaacgcccccaauuaucauuacgaagagugcaguuguuacccugacagcuccgagaucacuugcguuugccgggauaacuggcacgggucuaaucgcccaugggugagcuucaaccagaaucucgaauaucagauuggauacauauguucaggcaucuuuggcgacaacccgagacccaaugauaagaccgggaguugcggaccuguauccagcaacggugcgaacggcgugaagggguucucuuuuaaauauggaaauggcgucuggauugguaggacaaagucaaucaguagccggaacggguucgagaugaucugggacccaaauggcuggaccggaacggauaacaauuuuuccauuaaacaagacauagugggcaucaacgaauggucuggguacucggggagcuucguucagcaucccgagcugacuggucuggacuguauucgcccuugcuucuggguggaacucauccgaggcagaccaaaggagaauacaauuuggaccuccgggucaaguaucucuuuuuguggagucaacagcgauacugugggcugguccuggcccgacggugcagaguuaccguucacaauagauaaauga

SEQ ID NO: 145776 - RNA, 1410 nt, Artificial Sequence; identical to SEQ ID NO: 138744
  derived and/or modified sequence opt3 from neuraminidase__InfluenzaA__AGR50077

SEQ ID NO: 145777 - RNA, 1410 nt, Artificial Sequence; identical to SEQ ID NO: 138744
  derived and/or modified sequence opt3 from neuraminidase__InfluenzaA__AGR50088

SEQ ID NO: 145778 - RNA, 1410 nt, Artificial Sequence; identical to SEQ ID NO: 138744
  derived and/or modified sequence opt3 from neuraminidase__InfluenzaA__AGR50099

SEQ ID NO: 145779 - RNA, 1410 nt, Artificial Sequence; identical to SEQ ID NO: 138744
  derived and/or modified sequence opt3 from neuraminidase__InfluenzaA__AGR50110

SEQ ID NO: 145780 - RNA, 1410 nt, Artificial Sequence
  derived and/or modified sequence opt3 from neuraminidase__InfluenzaA__AGR50121
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucuaauggccaggcuuccuacaaaaucuuucggaucgaaaaggguaaaauugugaagucagucgagaugaacgcccccaauuaucauuacgaagagugcaguuguuacccugacagcuccgagaucacuugcguuugccgcgauaacuggcacgggucuaauagaccaugggugagcuucaaccagaaucucgaauaucagauuggauacauauguucaggcaucuuuggcgacaacccgaggcccaaugauaaaaccgggaguugcggaccuguaccauccaacggugcgaacggcgugaagggguucagcuuuaaguauggaaauggcgucuggauuggucggacaaaaucuaucucaagucgcaacggguucgagaugaucugggaccccaauggcuggaccggaacggauaacaauuuuagcauuaagcaagacauagugggcaucaacgaaugguccggguacucuggaucguucguucagcauccugagcugacuggucuggacuguauucgaccaugcuucuggguggaacucaucagaggcaggcccaaagagaauacaauuuggaccagcggguccucaaucaguuuuuguggagucaacucugauacugugggcuggagcuggccggacggugcagaguuaccuuucacaauagauaaguga

SEQ ID NO: 145781 - RNA, 1410 nt, Artificial Sequence
  derived and/or modified sequence opt3 from neuraminidase__InfluenzaA__AGR50132
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgcuaacgggucguguuucaccgucaugacagauggaccaucuaauggccaggccuccuacaaaaucuuucggaucgaaaaggguaaaauugugaagucaguggagaugaacgcgcccaauuaucauuacgaagagugcaguuguuacccugacagcuccgagaucacuugcgucugccgcgauaacuggcacgggucuaauagaccauggguuagcuucaaccagaaucucgaauaucagauuggauacauauguucaggcaucuuuggcgacaacccgaggcccaaugauaaaaccgggaguugcggaccuguguccagcaacggugcaaacggcguaaagggguucucuuuuaaguauggaaauggcguguggauuggucggacaaaaucaaucaguagccgcaacggguucgagaugaucugggacccaaauggcuggaccggaacggauaacaauuuuuccauuaagcaagacauagucggcaucaacgaauggucuggguacucggggagcuucgugcagcaucccgagcugacuggucuggacuguauucgaccuugcuucuggguugaacucaucagaggcaggccaaaagagaauacaauuuggaccuccgggucaaguaucucuuuuuguggagugaacagcgauacugucggcugguccuggcccgacggugccgaguuaccguucacaauagauaaguga

SEQ ID NO: 145782 - RNA, 1410 nt, Artificial Sequence; identical to SEQ ID NO: 138744
  derived and/or modified sequence opt3 from neuraminidase__InfluenzaA__AGR50143

SEQ ID NO: 145783 - RNA, 1410 nt, Artificial Sequence; identical to SEQ ID NO: 138744
  derived and/or modified sequence opt3 from neuraminidase__InfluenzaA__AGR50154

SEQ ID NO: 145784 - RNA, 1413 nt, Artificial Sequence; identical to SEQ ID NO: 140946
  derived and/or modified sequence opt3 from neuraminidase__InfluenzaA__AGR50165

SEQ ID NO: 145785 - RNA, 1410 nt, Artificial Sequence; identical to SEQ ID NO: 138744
  derived and/or modified sequence opt3 from neuraminidase__InfluenzaA__AGR50177

SEQ ID NO: 145786 - RNA, 1410 nt, Artificial Sequence; identical to SEQ ID NO: 138744
  derived and/or modified sequence opt3 from neuraminidase__InfluenzaA__AGR50188

SEQ ID NO: 145787 - RNA, 1410 nt, Artificial Sequence; identical to SEQ ID NO: 138744
  derived and/or modified sequence opt3 from neuraminidase__InfluenzaA__AGR50199

SEQ ID NO: 145788 - RNA, 1410 nt, Artificial Sequence; identical to SEQ ID NO: 138744
  derived and/or modified sequence opt3 from neuraminidase__InfluenzaA__AGR50210

SEQ ID NO: 145789 - RNA, 1410 nt, Artificial Sequence; identical to SEQ ID NO: 138744
  derived and/or modified sequence opt3 from neuraminidase__InfluenzaA__AGR50221

SEQ ID NO: 145790 - RNA, 1410 nt, Artificial Sequence
  derived and/or modified sequence opt3 from neuraminidase__InfluenzaA__AGR50232
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaaauaacggccaggcuucuuacaaaaucuuucggaucgaaaaggguaaaauugugaaguccgucgagaugaaugcccccaacuaucauuacgaagagugcucauguuacccugacaguagcgagaucacuugcguuugccgcgauaauuggcacggguccaacagaccaugggugucuuucaaucagaaccucgaauaucagauuggauacauauguagcggcaucuuuggcgacaauccgaggcccaacgauaaaaccgggucaugcggaccuguaaguuccaacggugcgaauggcgugaagggguucagcuuuaaguauggaaacggcgucuggauuggucggacaaaaucuaucucaagucgcaauggguucgagaugaucugggacccaaacggcuggaccggaacggauaauaacuuuagcauuaagcaagacauagugggcaucaaugaaugguccggguacucuggaucguucguucagcaucccgagcugacuggucuggacuguauucgaccuugcuucuggguggaacucaucagaggcaggccaaaagagaacacaauuuggaccagcggguccucaaucaguuuuuguggagucaauucugauacugugggcuggagcuggcccgacggugcagaguuaccguucacaauagauaaguga

SEQ ID NO: 145791 - RNA, 1410 nt, Artificial Sequence; identical to SEQ ID NO: 138744
  derived and/or modified sequence opt3 from neuraminidase__InfluenzaA__AGR50243

SEQ ID NO: 145792 - RNA, 1410 nt, Artificial Sequence; identical to SEQ ID NO: 138744
  derived and/or modified sequence opt3 from neuraminidase__InfluenzaA__AGR50254

SEQ ID NO: 145793 - RNA, 1410 nt, Artificial Sequence; identical to SEQ ID NO: 138744
  derived and/or modified sequence opt3 from neuraminidase__InfluenzaA__AGR50265

SEQ ID NO: 145794 - RNA, 1410 nt, Artificial Sequence
  derived and/or modified sequence opt3 from neuraminidase__InfluenzaA__AGR50276
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcagagcaguccguagugucugucaaacuggccggcaauucgucauugugcccugugagcgggugggcgauauacaguaaggacaacuccguuagaauuggaucuaaaggcgauguguuugucaucagggaaccauucauuagcuguuccccguuagagugccggaccuuuuuccugacacagggugcucuacucaaugacaagcauucaaacgggaccaucaaagaucgcagucccuaucgaacucugaugagcuguccuaucggagaagugccaucucccuacaacucccguuuugagucaguagccuggagcgcaagugccugccacgacggcauuaauuggcuuacaauaggcaucucugggccugauaacggagcuguugcagugcugaaguauaaugguauuaucaccgacacgauaaaguccuggagaaacaauauuuugaggacucaagagagcgaaugugccugcgucaacggcucguguuucaccgugaugacagaugggccaucuaauggacaggcuuccuacaaaaucuuucggaucgagaagggcaaaauugugaagucagucgaaaugaacgcccccaauuaucauuacgaggagugcaguuguuacccugacagcuccgaaaucacuugcguuugccgcgauaacuggcacgguucuaauagaccaugggugagcuucaaccagaaucucgaguaucagauuggguacauauguucaggaaucuuuggcgacaacccgaggcccaaugauaaaaccggcaguugcgggccuguauccagcaacggagcgaacggugugaagggcuucucuuuuaaguaugggaauggagucuggauuggccggacaaaaucaaucaguagccgcaacgguuucgaaaugaucugggacccaaauggguggaccggcacggauaacaauuuuuccauuaagcaagacauagugggaaucaacgaguggucuggcuacucggggagcuucguucagcaucccgaacugacuggacuggacuguauucgaccuugcuucuggguggagcucaucagagguaggccaaaagagaauacaauuuggaccuccggcucaaguaucucuuuuuguggggucaacagcgauacugugggaugguccuggcccgacggcgcagaauuaccguucacaauagauaaguga

SEQ ID NO: 145795 - RNA, 1410 nt, Artificial Sequence; identical to SEQ ID NO: 138744
  derived and/or modified sequence opt3 from neuraminidase__InfluenzaA__AGR50287

SEQ ID NO: 145796 - RNA, 1410 nt, Artificial Sequence
  derived and/or modified sequence opt3 from neuraminidase__InfluenzaA__AGR50298
augaaccccaaucagaagaucauuaccauaggcagcgugugcaugacaaucgggauggccaaccugauucuccaaaucggaaauacuauuuccaucuggauaucucacucaauccagccugguaaccagaaucagauugagacguguaaccaaagugucaucaccuacgaaaauaacacauggguuaaucagacuuaugugaacauuagcaauaccaacuucgcugcaggccaguccguagugucugucaaacuugccggaaauucgucacugugcccagugagcggaugggcgaucuacaguaaggacaacuccauaagaauuggcucuaaaggugauguuuuugugaucagggagccguucauuagcuguucccccuuggaaugccggacauuuuucuuaacccagggggcucugcuaaaugacaagcauucaaacggaacuaucaaagaucgcaguccuuaucgaacacucaugagcuguccaaucggcgagguccccucuccuuacaacucccguuuugaaucaguggccuggagcgcaagugccugccacgacggcauuaauuggcugaccauagggaucucuggaccagauaacggugcuguagcaguucuuaaguauaauggcauuaucacggacacuauaaaguccuggagaaacaauauucugaggacccaagagagcgagugugccugcgugaacgggucguguuucacagucaugacugauggacccucugacggccaggcuuccuacaaaaucuuucggaucgaaaaggguaaaauugugaagucaguggagaugaaugccccuaacuaucauuacgaagagugcaguuguuacccagauagcuccgagauuaccugcgucugccgcgacaauuggcacgggucuaacagaccguggguuagcuucaaucagaacuuggaauaucagaucggauacauauguucaggcaucuuuggcgauaaucccaggccuaacgacaaaacagggaguugcggaccaguguccagcaauggugcgaacggcguaaagggguucucuuuuaaguauggaaacggcguguggauuggucggaccaaaucaaucaguagccgcaauggguucgagaugaucugggaucccaacggcuggacgggaacugacaauaacuuuuccauuaagcaagacauagucggcaucaaugaauggucuggguacucggggagcuucgugcagcauccugagcucacaggucuggauuguauucgaccaugcuucuggguugaacugaucagaggcaggcccaaagagaacaccauuuggacuuccgggucaaguaucucuuuuuguggagugaauagcgacacagucggcugguccuggccggauggugcagagcucccuuucaccauagacaaguga

SEQ ID NO: 145797 - RNA, 1410 nt, Artificial Sequence; identical to SEQ ID NO: 138744
  derived and/or modified sequence opt3 from neuraminidase__InfluenzaA__AGR50309

SEQ ID NO: 145798 - RNA, 1410 nt, Artificial Sequence; identical to SEQ ID NO: 138744
  derived and/or modified sequence opt3 from neuraminidase__InfluenzaA__AGR50320

SEQ ID NO: 145799 - RNA, 1410 nt, Artificial Sequence; identical to SEQ ID NO: 138744
  derived and/or modified sequence opt3 from neuraminidase__InfluenzaA__AGR50331

SEQ ID NO: 145800 - RNA, 1410 nt, Artificial Sequence
  derived and/or modified sequence opt3 from neuraminidase__InfluenzaA__AGR50342
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguaauaucugugaaacuggccggaaauucgucauugugcccugucagcggaugggcgauuuacaguaaggacaacuccgugagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucuaauggccaggcuuccuacaaaaucuuucggauugaaaaggguaaaaucgugaagucaguggagaugaacgcccccaauuaucauuacgaagagugcaguuguuacccugacagcuccgagauuacuugcgucugccgcgauaacuggcacgggucuaauagaccauggguuagcuucaaccagaaucucgaauaucagauaggauacaucuguucaggcauuuuuggcgacaacccgaggcccaaugauaaaaccgggaguugcggaccuguguccagcaacggugcgaacggcguaaagggguucucuuuuaaguauggaaauggcguguggaucggucggacaaaaucaaucaguagccgcaacggguucgagaugauuugggacccaaauggcuggaccggaacggauaacaauuuuuccauaaagcaagacaucgucggcauuaacgaauggucuggguacucggggagcuucgugcagcaucccgagcugacuggucuggacuguauccgaccuugcuucuggguugaacucauuagaggcaggccaaaagagaauacaaucuggaccuccgggucaaguauaucuuuuuguggagugaacagcgauacugucggcugguccuggcccgacggugcagaguuaccguucacaaucgauaaguga

SEQ ID NO: 145801 - RNA, 1410 nt, Artificial Sequence; identical to SEQ ID NO: 138744
  derived and/or modified sequence opt3 from neuraminidase__InfluenzaA__AGR50353

SEQ ID NO: 145802 - RNA, 1413 nt, Artificial Sequence; identical to SEQ ID NO: 140946
  derived and/or modified sequence opt3 from neuraminidase__InfluenzaA__AGR50364

SEQ ID NO: 145803 - RNA, 1410 nt, Artificial Sequence
  derived and/or modified sequence opt3 from neuraminidase__InfluenzaA__AGR55170
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccgggaaggcagacacuaaaauucucuuuaucgaggaaggaaagauagugcauacaucaaccuuaagcgguagugcccaacacguggaggaaugcucuugcuauccucgcuacccaggcgucagauguguuugcagggauaacuggaagggguccaaccggccgauuguggacaucaauaucaaagaccacagcauuguaucgucuuacguguguuccggacuggucggcgauacgccccgcaagaacgacucaaguagcuccucucauugccuugauccuaauaacgaggaaggugggcacggagugaaaggcugggcuuucgacgauggcaaugacguuuggauggggcgaaccaucagcgagaagucaagauugggauaugagacauuuaaagugauugaagguuggaguaacccaaauuccaagcugcagauaaacaggcagaucauugucgaucggggcaaucguagcggguacucuggaaucuucucaguggagggcaaaaguuguaucaaccgcugcuuuuauguagaacuaauuagagguaggaaggaggaaacugagguucucuggaccagcaauuccauaguggucuucugugggacaucuggcacuuacggaaccggcucguggcccgacggggccgauaucaaccugaugccuauuuga

SEQ ID NO: 145804 - RNA, 1410 nt, Artificial Sequence; identical to SEQ ID NO: 136161
  derived and/or modified sequence opt3 from neuraminidase__InfluenzaA__AGR55180

SEQ ID NO: 145805 - RNA, 1410 nt, Artificial Sequence; identical to SEQ ID NO: 136161
  derived and/or modified sequence opt3 from neuraminidase__InfluenzaA__AGR55181

SEQ ID NO: 145806 - RNA, 1410 nt, Artificial Sequence; identical to SEQ ID NO: 136161
  derived and/or modified sequence opt3 from neuraminidase__InfluenzaA__AGR55183

SEQ ID NO: 145807 - RNA, 1410 nt, Artificial Sequence
  derived and/or modified sequence opt3 from neuraminidase__InfluenzaA__AGR55184
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaagaaucaggugauguugugcgaaccgacuaucauagagagaaacaucaccgaaauuguauacuuaacaaauaccacuaucgagaaagaaauuugucccaagcuggcagaguauaggaacuggucaaaaccucagugcaauaucacaggguucgccccauuuaguaaggacaacagcauacggcuauccgcgggaggugauauuugggugacccgcgagcccuacgucucuugugacccugauaagugcuaucaauucgcucucggccaggggacgacucugaauaacggacacucgaaugacaccgugcaugaucgaacaccauaccguacucuucugaugaacgaauugggcguucccuuucaccucgguaccagacagguguguaucgccuggucaagcaguuccugccaugacgggaaagcauggcugcacgucugugugacaggagaugacaagaaugccaccgcuucuuucauuuauaacggcaggcugguagauagcaucggcuccuggaguaaaaagauccuccggacgcaggagucagaaugcguuuguauuaaugggacuugcacaguggucaugaccgacggaagcgcaucugguaaagccgauacuaagauauuauuuaucgaggagggcaagauugugcacaucuccacacugucagggagcgcucaacauguggaagagugcaguuguuacccucgcuauccaggagucagaugcguuuguagggacaacuggaaaggcucuaaccggccgauaguggauauuaauguaaaggacuacuccaucgugagcucguacgucugcucuggucuugugggggacacccccaggaaaaacgauuccuucucaaguagccacuguuuggacccuaauaacgaagagggaggccauggcguuaaggggugggccuuugaugacggaaaugauguguggaugggucgaacgaucuccgaaaaacugagaucuggcuaugagaccuucaaggucauugagggguggagcaaaccaaacucaaagcuacagaucaaucgccaggugauuguagaacggggaaaccguaguggcuacuccgguauauuuagcguugaggggaagucuugcaucaaucgcuguuucuauguggaacucauuagaggcaggaaagaggaaacagaggucugguggacuucaaacaguaucguggucuuuugcggaaccagcggcacauacgggacuggauccuggcccgacggugcggauaucaaucugaugccuauuuga

SEQ ID NO: 145808 - RNA, 1410 nt, Artificial Sequence
  derived and/or modified sequence opt3 from neuraminidase__InfluenzaA__AGR55185
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaagaaucaggugauguugugcgaaccgacuaucauagagagaaacaucaccgaaauuguauacuuaacaaauaccacuaucgagaaagaaauuugucccaagcuggcagaguauaggaacuggucaaaaccucagugcaauaucacaggguucgccccauuuaguaaggacaacagcauacggcuauccgcgggaggugauauuugggugacccgcgagcccuacgucucuugugacccugauaagugcuaucaauucgcucucggccaggggacgacucugaauaacggacacucgaaugacaccgugcaugaucgaacaccauaccguacucuucugaugaacgaauugggcguucccuuucaccucgguaccagacagguguguaucgccuggucaagcaguuccugccaugacgggaaagcauggcugcacgucugugugacaggagaugacaagaaugccaccgcuucuuucauuuauaacggcaggcugguagauagcaucggcuccuggaguaaaaagauccuccggacgcaggagucagaaugcguuuguauuaaugggacuugcacaguggucaugaccgacggaagcgcaucugguaaagccgauacuaagauauuauuuaucgaggagggcaagauugugcacaucuccacacugucagggagcgcucaacauguggaagagugcaguuguuacccucgcuauccaggagucagaugcguuuguagggacaacuggaaaggcucuaaccggccgauaguggauauuaauguaaaggacuacuccaucgugagcucguacgucugcucuggucuugugggggacacccccaggaaaaacgauuccuucucaaguagccacuguuuggacccuaauaacgaagagggaggccauggcguuaaggggugggccuuugaugacggaaaugauguguggaugggucgaacgaucuccgaaaaacugagaucuggcuaugagaccuucaaggucauugagggguggagcaaaccaaacucaaagcuacagaucaaucgccaggugauuguagaacggggaaaccguaguggcuacuccgguauauuuagcguugaggggaagucuugcaucaaucgcuguuucuauguggaacucauuagaggcaggaaagaggaaacagaggucugguggacuucaaacaguaucguggucuuuugcggaaccagccggacauacggcacuggguccuggcccgacggagcggauaucaaucugaugccuauuuga

SEQ ID NO: 145809 - RNA, 1410 nt, Artificial Sequence
  derived and/or modified sequence opt3 from neuraminidase__InfluenzaA__AGR55186
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuuuauugaggagggaaagaucgugcacacaucaaccuuaagcgguagugcccaacacgucgaagagugcucuugcuauccucgguacccaggcguucgcugugugugcagagauaacuggaaaggguccaacaggccgauaguagacauuaauaucaaggacuacagcaucgugucgucuuaugucuguuccggacuggugggcgauacgccccggaaaaacgacucaaguagcuccucucauugccuugaaccuaauaacgaggaaggugggcacggaguuaagggcugggcuuucgaugacggcaaugauguguggauggggcgcaccauuagcgagaaauugcgaucaggauacgagacauuuaaggucaucgaagguuggaguaacccaaauuccaaacugcagauuaacagacaggugauaguagacaggggcaaucggagcggguauucuggaaucuucucaguugagggcaagaguuguauuaaccguugcuuuuacguggaacuaauccgcgguagaaagcaggagacugaaguccucuggaccagcaauuccaucguggucuucugugggacaucuggcacuuauggaaccggcucguggcccgauggggccgacauuaaccugaugccuauauga

SEQ ID NO: 145810 - RNA, 1410 nt, Artificial Sequence; identical to SEQ ID NO: 136161
  derived and/or modified sequence opt3 from neuraminidase__InfluenzaA__AGR55187

SEQ ID NO: 145811 - RNA, 1410 nt, Artificial Sequence; identical to SEQ ID NO: 136730
  derived and/or modified sequence opt3 from neuraminidase__InfluenzaA__AGR55192

SEQ ID NO: 145812 - RNA, 1410 nt, Artificial Sequence
  derived and/or modified sequence opt3 from neuraminidase__InfluenzaA__AGR55195
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagaucauuggaagggguccaacaggccgauaguagacauuaacaucaaagacuacagcaucgugucgucuuaugucuguuccggacuggugggcgauacgccccggaagaaugacucaaguagcuccucucacugccuugauccuaacaaugaggaaggugggcauggaguuaaaggcugggcuuucgacgauggcaacgacguguggauggggcgcaccauuagcgagaaguugcgacugggauacgagacauuuaaagucaucgaagguuggucaaauccaaacaguaagcuacagauuaauagacaggugauaguagauaggggcaaccgguccggguauagcggaaucuucucuguugagggcaaaucauguauuaaucguugcuuuuacguggaacucauccgcgguagaaaggaggaaacugagguccuguggaccaguaacagcaucguggucuucugugggacauccggcacuuauggaaccggcucuuggcccgacggggccgauauuaaucuuaugccuauauga

SEQ ID NO: 145813 - RNA, 1410 nt, Artificial Sequence
  derived and/or modified sequence opt3 from neuraminidase__InfluenzaA__AGR55204
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccggggaggcagacacuaagauucucuuuaucgaagagggaaaaauagugcauacaucaaccuuaagcgguagugcccaacacguggaagagugcucuugcuauccucgcuacccaggcgucagauguguuugcagggauaacuggaagggguccaaccggccgauuguggacaucaauaucaaggaccacagcauuguaucgucuuacguguguuccggacuggucggcgauacgccccgcaaaaacgacucaaguagcuccucucauugccuugauccuaauaacgaagagggugggcacggagugaagggcugggcuuucgacgauggcaaugacguuuggauggggcgaaccaucagcgagaaaucaagauugggauaugaaacauuuaaggugauugaggguuggaguaacccaaaauccaagcugcagauaaauaggcaggucaucguggaucggggcaaccguagcggguacucuggaauuuucucaguagaaggcaaaaguuguaucaaucgcugcuuuuauguugagcuaaucagagguaggaaggaagagacugaggugcucuggaccagcaacuccauugucguguucugugggacaucucggacuuacggcaccggaucguggcccgacggcgccgauauaaaucugaugccuaucuga

SEQ ID NO: 145814 - RNA, 1410 nt, Artificial Sequence
  derived and/or modified sequence opt3 from neuraminidase__InfluenzaA__AGR55218
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguugugcugugugaaccgacuauaaucgagagaaauauuaccgaaaucguauauuugacaaacaccacuauugagaaggaaaucugccccaaauuagcugaguacaggaauuggaguaagccucagugugacauaacaggguucgcaccauuuagcaaagauaacuccauucggcugucugccggaggugacaucugggugacccgcgagcccuaugucucgugcgauccugacaaguguuaccaauucgcgcuaggccaggggacgacucucaauaacgugcauucaaauaacaccguucgagaucguacaccauauagaacucugcuuaugaaugaacugggagugcccuuucacuugggcaccaagcaggucugcauugcuuggagcaguuccucuugucaugacgguaaagccuggcuccacgugugcaucacaggggaugacaagaacgcaaccgccagcuucaucuacaauggaaggcugguagauuccauuguuucauggaguaaagagauacugcggacgcaggaaagcgagugugugugcaucaacggcacuuguacagucgugaugaccgacggcucugcuuccgggaaggcagauacuaaaauucucuuuaucgaggaaggaaagauagugcauacaucaaccuuaagcgguagugcccaacacgucgaggaaugcucuugcuauccucgcuacccaggcguuagaugugugugcagggacaacuggaagggguccaaucggccgauuguagauaucaacaucaaagaccacagcauugugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccaucagcgagaagucaagauugggauaugagacauuuaaagucauugaagguuggaguaauccaaaguccaaacugcagauaaacaggcaagugaucguagaccggggcaaucguagcggguacucuggaauuuucucaguugagggcaagaguuguaucaaccgcugcuuuuauguggaacuaaucagagguaggaaggaggaaacugagguccucuggaccagcaauuccauuguggucuucugugggacaucuggcacuuacggaaccggcucguggcccgauggggccgacauaaaccugaugccuaucuga

SEQ ID NO: 145815 - RNA, 1410 nt, Artificial Sequence; identical to SEQ ID NO: 145405
  derived and/or modified sequence opt3 from neuraminidase__InfluenzaA__AGT18726

SEQ ID NO: 145816 - RNA, 1410 nt, Artificial Sequence
  derived and/or modified sequence opt3 from neuraminidase__InfluenzaA__AGT18727
augaaccccaaucagaagaucauuaccauaggcagcgugugcaugacaaucgggauggccaaccugauucuccaaaucggaaauauuaucuccauauggaucucucacucaauucagcuugguagucagaaccagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuguuagaauuggcagcaaaggugauguguuugucaucagggagccauucauuuccuguucaccguuagaaugccggaccuuuuuccugacacagggggcucuacucaacgacaagcauaguaauggaaccaucaaagaucgcagccccuaucgaacucugaugucuuguccuaucggcgaggugccaucccccuacaacucacguuuugaaagcguagccuggagugcaucugccugccacgacggcauuaacuggcuuacaauagggaucuccggaccugauagcggugcuguugcagugcugaaguauaauggcauuaucaccgacacgauaaagucguggagaaacaauauuuugaggacucaagagucugagugugccugcgucaacggguccuguuucaccaucaugacagauggaccaucagacggccaggcuaguuacaaaaucuuucggauugaaaaggguaaaaucgugaagucaguggagaugaaugcccccaacuaucauuacgaagagugcuccuguuacccugauucuagcgagauuacuugcgucugccgcgacaauuggcacgggucaaacagaccauggguuaguuucaaucagaaccucgaauaucagauaggauacaucuguuccggcauuuuuggcgauaauccgaggcccaacgacaaaaccgggagcugcggaccugugucuucaaauggugcgaacggcguaaagggguucaguuuuaaguauggaaauggcguguggaucggucggacaaaaagcaucuccucucgcaagggguucgagaugauuugggauccaaacggcuggucgggaaccgacaacaauuuuagcauaaaacaagacaucgucggcauuaacgaaugguccggguacucaggaaguuucgugcagcaucccgagcugacgggucuggauuguauccgaccuugcuucuggguugaacucauuagaggcaggccaaaggagaauacuaucuggacaucugggagcuccauaucauuuuguggagugaacagcgacaccgucggcuggucuuggcccgauggugcagaguuaccguucacuaucgacaaauga

SEQ ID NO: 145817 - RNA, 1410 nt, Artificial Sequence; identical to SEQ ID NO: 145405
  derived and/or modified sequence opt3 from neuraminidase__InfluenzaA__AGT18728

SEQ ID NO: 145818 - RNA, 1410 nt, Artificial Sequence
  derived and/or modified sequence opt3 from neuraminidase__InfluenzaA__AGT18729
augaaccccaaucagaagaucauuaccauaggccaagugugcaugacaaucgggauggccaaccugauucuccagaucggaaauauuaucagcauauggaucucccacucuauucagcuugguucacagaaccaaaucgagacuuguaaucagagugucauuacguacgaaaacaauaccuggguuaaccagacauaugugaauaucagcaacacuaauuucgcugcaggccaguccguagugucugucaaacuggccgggaacucgucauugugcccugugagcggaugggcgauauacaguaaggacaauuccguuagaauuggcucuaaaggugauguguuugucaucagggagccauucauuagcuguuccccguuagaaugccggaccuuuuuccugacacaaggggcucuacucaacgacaagcauucaaauggaaccaucaaagaucgcagucccuaucgaacucugaugagcuguccuaucggcgaggugccaucucccuacaacucccguuuugaaucaguagccuggagcgcaagugccugccacgacggcauuaacuggcuuacaauagggaucucuggaccugauuccggugcuguugcagugcugaaguauaauggcauuaucaccgacacgauaaagagcuggagaaacaauauuuugaggacucaggagucggagugugccugcgucaacgggucuuguuucaccaucaugacagauggaccauccgacggccaggcuucauacaaaaucuuucggauugaaaaggguaaaaucgugaagaguguggagaugaaugcccccaacuaucauuacgaagagugcagcuguuacccugauuccucugagauuacuugcgucugccgcgacaauuggcacgggagcaacagaccauggguuucauucaaucagaaccucgaauaucaaauaggauacaucuguaguggcauuuuuggcgauaauccgaggcccaacgacaaaaccggguccugcggaccugugagcucuaauggugcgaacggcguaaagggguucucauuuaaguauggaaauggcguguggaucggucggacaaaaaguaucagcucccgcaagggguucgagaugauuugggauccaaacggcuggaccggaacggacaacaauuuuucuauaaaacaggacaucgucggcauuaacgaauggucgggguacagcggauccuucgugcagcaucccgagcugacuggucuggauuguauccgaccuugcuucuggguugaacucauuagaggcaggccaaaggagaauacaaucuggaccucagggaguucuaucagcuuuuguggagugaacuccgacacugucggcuggucauggcccgauggugcagaguuaccguucacaauagacaaauga

SEQ ID NO: 145819 - RNA, 1410 nt, Artificial Sequence
  derived and/or modified sequence opt3 from neuraminidase__InfluenzaA__AGT18730
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuguuagaauuggcagcaaaggugauguguuugucaucagggagccauucauuuccuguucaccguuagaaugccggaccuuuuuccugacacagggggcucuacucaacgacaagcauaguaauggaaccaucaaagaucgcagccccuaucgaacucugaugucuuguccuaucggcgaggugccaucccccuacaacucacguuuugaaagcguagccuggagugcaucugccugccacgacggcauuaacuggcuuacaauagggaucuccggaccugauagcggugcuguugcagugcugaaguauaauggcauuaucaccgacacgauaaagucguggagaaacaauauuuugaggacucaagagucugagugugccugcgucaacggguccuguuucaccaucaugacagauggaccaucagacggccaggcuaguuacaaaaucuuucggauugaaaaggguaaaaucgugaagucaguggagauuaaugcccccaacuaucauuacgaagagugcuccuguuacccugauucuagcgagauaacuugcgucugccgcgacaauuggcacgggucaaacagaccauggguuaguuucaaucagaaccucgaauaucagaucggauacauuuguuccggcaucuuuggcgauaauccgaggcccaacgacaaaaccgggagcugcggaccugugucuucaaauggugcgaacggcguaaagggguucaguuuuaaguauggaaauggcguguggaucggucggacaaaaagcauuuccucucgcaagggguucgagaugauaugggauccaaacggcuggaccggaacggacaacaauuuuucgaucaaacaagacauugucggcaucaacgaauggagcggguacuccggaucauucgugcagcaucccgagcugacuggucuggauuguauucgaccuugcuucuggguugaacucaucagaggcaggccaaaggagaauacaauauggaccagugggucuagcaucuccuuuuguggagugaacucagacacugucggcuggagcuggcccgauggugcagaguuaccguucacaauugacaaauga

SEQ ID NO: 145820 - RNA, 1410 nt, Artificial Sequence; identical to SEQ ID NO: 145405
  derived and/or modified sequence opt3 from neuraminidase__InfluenzaA__AGT18731

SEQ ID NO: 145821 - RNA, 1410 nt, Artificial Sequence
  derived and/or modified sequence opt3 from neuraminidase__InfluenzaA__AGT18732
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuguuagaauuggcagcaaaggugauguguuugucaucagggagccauucauuuccuguucaccguuagaaugccggaccuuuuuccugacacagggggcucuacucaacgacaagcauaguaauggaaccaucaaagaucgcagccccuaucgaacucugaugucuuguccuaucggcgaggugccaucccccuacaacucacguuuugaaagcguagccuggagugcaucugccugccacgacggcauuaacuggcuuacaauagggaucuccggaccugauagcggugcuguugcagugcugaaguauaauggcauuaucaccgacacgauaaagucguggagaaacaauauuuugaggacucaagagucugagugugccugcgucaacggguccuguuucaccaucaugacagauggaccaucagacggccaggcuaguuacaaaaucuuucggauugaaaaggguaaaaucgucaagagcguggagaugaaugcccccaacuaucauuacgaagagugcuccuguuacccugauucuagcgagauuacuugcgugugccgcgacaauuggcacgggucaaacagaccauggguuaguuucaaucagaaccucgaauaucagauaggauacaucuguuccggcauuuuuggcgauaauccgaggcccaacgacaaaaccgggagcugcggaccugugucuucaaauggugcgaacggcguaaagggguucaguuuuaaguauggaaauggcguguggaucggucggacaaaaagcaucuccucucgcaagggguucgagaugauuugggauccaaacggcuggaccggaacggacaacaauuuuucgauaaaacaagacaucgucggcauuaacgaauggagcggguacuccggaucauucgugcagcaucccgagcugacuggucuggauuguauccgaccuugcuucuggguugaacucauuagaggcaggccaaaggagaauacaaucuggacccgggggaguucuauaucauuuuguggagugaacuccgacacugucggcuggucauggcccgauggugcagaguuaccguucacaaucgacaaauga

SEQ ID NO: 145822 - RNA, 1410 nt, Artificial Sequence
  derived and/or modified sequence opt3 from neuraminidase__InfluenzaA__AGT18733
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuguuagaauuggcagcaaaggugauguguuugucaucagggagccauucauuuccuguucaccguuagaaugccggaccuuuuuccugacacagggggcucuacucaacgacaagcauaguaauggaaccaucaaagaucgcagccccuaucgaacucugaugucuuguccuaucggcgaggugccaucccccuacaacucacguuuugaaagcguagccuggagugcaucugccugccacgacggcauuaacuggcuuacaauagggaucuccggaccugauagcggugcuguugcagugcugaaguauaauggcauuaucaccgacacgauaaagucguggagaaacaauauuuugaggacucaagagucugagugugccugcgucaacggguccuguuucaccaucaugacagauggaccaucagacggccaggcuaguuacaaaaucuuucggauugaaaaggguaaaaucgugaagucaguggagaugaaugcccccaacuaucauuacgaagagugcuccuguuacccugauucuagcgagucaacuugcgucugccgcgacaauuggcacgggaguaacagaccauggguuuccuucaaucagaaccucgaauaucagauuggauacauauguagcggcaucuuuggcgauaauccgaggcccaacgacaaaaccgggucuugcggaccugugucaaguaauggugcgaacggcguaaagggguucagcuuuaaguauggaaauggcguguggauuggucggacaaaauccaucucuucgcgcaagggguucgagaugaucugggauccaaacggcuggaccggaacggacaacaauuuuagcauuaaacaagacauagucggcaucaacgaaugguccggguacucaggaaguuucgugcagcaucccgagcugacuggucuggauuguauucgaccuugcuucuggguugaacucaucagaggcaggccaaaggagaauacaauuuggaccucugggagcucccggucauuuuguggagugaacagcgacacugucggcuggucuuggcccgauggugcagaguuaccguucacaaucgacaaauga

SEQ ID NO: 145823 - RNA, 1410 nt, Artificial Sequence
  derived and/or modified sequence opt3 from neuraminidase__InfluenzaA__AGT18762
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuacucugugugaaccgauaaucauugagagaaauaucaccgaaauuguguauuugacaaacaccacuaucgagaaggaaauaugccccaaaccugcugaguacaggaauuggaguaagccacagugugggauuacaggauucgcacccuuuagcaaagacaacuccauccgguuaucugccgguggcgauauuuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcaucgcuuggagcaguuccucuugucaugaugggaaggccugguugcacgucugcaucacaggagacgauaagaacgcaaccgccagcuucauuuacaauggcaggcucguggacuccguaguuucauggaguaaagagauacugcggacgcaggaaagcgagugugugugcaucaacggcacuuguacagucgugaugaccgaugggucugcuuccggaaaggcagacacuaaaauucuguuuaucgaggaagguaagauagugcauacaucaacccucagcggcagugcccaacacgucgaggaaugcucuugcuauccacgcuacccggggguuagaugugugugcagggauaacuggaagggauccaaucggcccauuguagacaucaacaucaaagaucacagcauugugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccaucaaugagacaagcagacuugguuaugagacuuuuaaggucauugaaggcuggucaaaccccaaaaguaaguugcagauaaauaggcaagugaucguagaucguggggaccgguccggauacagcggcauuuucucuguugaggguaaaucauguaucaaccgcugcuuuuauguggaacugaucagagggaggaaggaggaaaccgagguccuauggacaaguaauagcauuguggucuucuguggcacuuccggaaccuacggcacagggucuuggccugauggagccgaccucaaccugaugccaauauga

SEQ ID NO: 145824 - RNA, 1410 nt, Artificial Sequence
  derived and/or modified sequence opt3 from neuraminidase__InfluenzaA__AGT18764
augaaccccaaucagaugaucauuaccauaggcagcgugucccugacaucuucaacuaucugcuucuuuaugcagacggccaguuucauuaccacagucacucuccacaucaagcagcaugaguuucacagcccuccaaacaaucagguuaugcuuugugaaccgaccauuaucgagagaaacauaacagaaaucguguaccugaccaauacuacaauugagaaagaaaucugccccaaguuggcugaguauaggaacugguccaaaccucagugugacauuaccggguucgcaccauuuucuaaggauaauucgauccgguuaucagccggaggugacauauggguaacgcgcgagcccuacgugagcugcgauccugacaaauguuaucaauucgcgcugggccaggggacuacccuaaacaauguccauaguaacaauacagugcgagaucguacuccauacagaacccuccugaugaacgaacuuggaguucccuuucaccugggcacaaaacaggugugcauugcuugguccucuagcuccugucaugacgguaaggccugguugcacgucugcaucaccggggaugacaagaaugcaacggccucauucauuuauaacggaaagcucguggauaguguaguuagcuggucuaaagagauccugaggacucaggaauccgagugugugugcaucaauggcacauguaccgucgugaugacugacggcucagcuagcgggaaggcagauacaaaaauucuguuuauagaggaaggaaagaucgugcacaccaguacgcucucugguuccgcccaacaugucgaggaaugcagcugcuacccucgguauccaggcguucgcugugugugcagagacaacuggaaggggucgaacaggccgauuguagauaucaauaugaaagaccacucuauaguguccucauacgucuguaguggauuagugggcgacacuccccggaagaacgaucgcagcuccaauucucauugccuggacccuaacaaugaggaaggugggcacggaguuaaaggcugggcuuucgaugacggcaacgauguguggauggggcgaacaauuaaugagacuagcagacuuggauacgagaccuuuaaggucaucgaagguuggucaaacccaaaaaguaaguugcagaucaauaggcaagugauuguagaccggggcaaccguuccggguauagcggaaucuucucuguugagggcaaaucauguauuaaucgcugcuuuuacguggaacugauaagagguaggaaggaggaaacagagguccuauggaccaguaacagcaucguggucuucugugggaccuccggcacauauggaaccggcucuuggcccgauggggccgaccucaaucugaugccuauuuga

SEQ ID NO: 145825 - RNA, 1410 nt, Artificial Sequence
  derived and/or modified sequence opt3 from neuraminidase__InfluenzaA__AGT18765
augaaccccaaucagaagaucauuaccauaggcagcgugucccugacaaucucuacuauuugcuucuuuaugcaaaucgccauucucaucacgaccgucacacuucacuucaaacagcaugaguuucacucaccuccaaacaaucagguuaugcugugugaaccgacuauaaucgagagaaacauuaccgaaaucguguacuugacaaauaccacuauugagaaggaaaucugccccaaauuagcugaguauaggaacuggaguaagccucagugugacauaacaggguucgcaccauuuagcaaagauaauuccauucggcugucugccggaggugacaucuggguaacccgcgagcccuacgugucgugcgauccugacaaguguuaucaauucgcgcuaggccaggggacgacucucaacaauguccauucaaacaauaccgugcgagaucguacaccauacagaacucugcuuaugaacgaacugggaguucccuuucacuugggcaccaaacaggugugcauugcuuggagcaguuccucuugucaugacgguaaggccuggcuccacgucugcaucacaggggaugacaagaaugcaaccgccagcuucaucuauaacggaaggcugguggauuccguaguuucauggaguaaagagauucugcggacgcaggaaagcgagugugugugcauaaauggcacuuguacagucgugaugaccgacggcucugcuuccgggaaggcagauacuaaaauccucuuuauugaggaaggaaagaucgugcacacaucaaccuuaagcgguagugcccaacaugucgaggaaugcucuugcuacccucgcuauccaggcguuagaugugugugcagggacaacuggaagggguccaaccggccgauaguagauauuaauaugaaagaccacagcaucgugucgucuuacgucuguuccggacuggugggcgacacgccccgcaagaacgaucgaucaaguaauagccauugccuugacccuaacaaugaggaaggugggcacggaguuaaaggcugggcuuucgaugacggcaacgauguguggauggggagaaccaucaaugagacauccagguugggauacgagacuuuuaaggucauugaagguuggucuaacccaaaaagcaagcugcagaucaaucgucaggugauuguagaccggggcaaccgcucaggguauaguggaauauucuccguugagggcaaaagcuguaucaauagaugcuuuuacguggaacuaauuaggggucggaaggaggaaaccgagguccucuggacaucuaacucaaucguggucuucugugggaccaguggcacuuauggaacaggcagcuggcccgauggggccgaccugaaucuuaugccuaucuga

SEQ ID NO: 145826 - RNA, 1410 nt, Artificial Sequence
  derived and/or modified sequence opt3 from neuraminidase__InfluenzaA__AGT18766
augaaccccaaucagaagaucauuaccauaggcagcgugucccugacaaucucuacuauuugccucuucaugcaaaucgccauucuuaucacgaccgucacacugcacuuuaaacagcaugaguuccacucaccuccaaacaaucagguuauguugugugaaccgacuauaaucgagagaaacauuaccgaaaucguguacuuaacaaauaccacuauugagaaggaaaucugccccaaacuggcugaguauaggaacuggaguaagccucagugugacauaacaggguuugcaccauucagcaaagauaauuccauucggcuaucugccggaggugacaucuggguaacccgcgagcccuacgugucgugcgauccugacaaguguuaucaauuugcgcucggccaggggacgacucugaacaauguccauucaaacaauaccgugcgagaucguacaccauacagaacucuucugaugaacgaauugggaguucccuuccaccucggcaccaaacaggugugcauugcuuggagcaguuccucuugucaugacgguaaggccuggcugcacgucugcaucacaggggaugacaagaaugcaaccgccagcuuuaucuauaacggaaggcugguggauuccguaguuucauggaguaaagagauucuccggacgcaggaaagcgagugugugugcauaaauggcacuuguacagucgugaugaccgacggcucugcuuccgggaaggcagauacuaaaaucuuauucauugaggaaggaaagaucgugcacacaucaacccugagcgguagugcccaacaugucgaggaaugcucuugcuacccucgcuauccaggcguuagaugugugugcagggacaacuggaagggguccaaccggccgauaguagauauuaauaugaaagaccacagcaucgugucgucuuacgucuguuccggacuugugggcgacacgccccgcaagaacgaucgaucaaguaauagccauugcuuggacccuaacaaugaggaaggugggcacggaguuaaaggcugggcuuuugaugacggcaacgauguguggauggggagaaccaucaaugagacauccaggcugggauacgagacuuucaaggucauugaagguuggucuaacccaaaaagcaagcuacagaucaaucgucaggugauuguagaccggggcaaccgcucaggguauaguggaauauuuuccguugagggcaaaagcuguaucaauagaugcuucuacguggaacucauuaggggucggaaggaggaaaccgagguccuguggacaucuaacucaaucguggucuuuugugggaccaguggcacuuauggaacaggcagcuggcccgauggggccgaccuuaaucugaagccuaucuga

SEQ ID NO: 145827 - RNA, 1410 nt, Artificial Sequence
  derived and/or modified sequence opt3 from neuraminidase__InfluenzaA__AGT18767
augaaccccaaucagaagaucauuaccauaggcagcgugucccugacaaucucuacuauuugcuucuuuaugcaaacggccucacucaucaccacagucacucuucacuucaaacagcaugaguuucacaguccuccaaacaaucagguuaugcugugugaaccgaccauuaucgagagaaacauaacagaaaucguguacuugaccaauacuacaauugagaaggaaaucugccccaaauuagcugaguauaggaacuggagcaagccucagugugacauuaccggguucgcaccauuuuccaaagauaauucuauccggcugucggccggaggugacauauggguaacgcgcgagcccuacgugucaugcgauccugacaaguguuaucaauucgcgcuaggccaggggacuacccucaacaauguccauagcaacaauacagugcgagaucguacuccauacagaacccugcuuaugaacgaacugggaguucccuuucacuugggcacaaaacaggugugcauugcuuggaguuccucuagcugucaugacgguaaggccuggcuccacgucugcaucaccggggaugacaagaaugcaacggccuccuucauuuauaacggaaggcugguggauucaguaguuaguuggagcaaagagauccugcggacucaggaaucugagugugugugcaucaauggcacauguaccgucgugaugacugacggcuccgcuucagggaaggcagauacaaaaauucucuuuauagaggaaggaaagaucgugcacaccagcacguuaagugguucugcccaacaugucgaggaaugcuccugcuacccucgcuauccaggcguuagaugugugugcagggacaacuggaaggggagcaaccggccgauuguagauaucaauaugaaagaccacucgauagugucuuccuacgucuguucaggacuggugggcgacacaccccgcaagaacgaucgaaguagcaauucccauugccuugacccuaacaaugaggaaggugggcacggaguuaaaggcugggcuuucgaugacggcaacgauguguggauggggagaaccauuaaugagacuucuagguugggauacgagaccuuuaaggucaucgaagguuggagcaacccaaaaucaaagcugcagaucaaucgucaggugauuguagaccggggcaaccgcaguggguauuccggaaucuucagcguugagggcaaaucuuguauuaauagaugcuuuuacguggaacuaauaaggggucggaaggaggaaacagagguccucuggacuucaaacaguaucguggucuucugugggaccagcggcacauauggaaccggcuccuggcccgauggggccgaccugaaucuuaugccuauuuga

SEQ ID NO: 145828 - RNA, 1410 nt, Artificial Sequence
  derived and/or modified sequence opt3 from neuraminidase__InfluenzaA__AGT18768
augaaccccaaucagaagaucauuaccauaggcagcgugucccugacaaucucuacuauuugcuucuuuaugcaaacggccucauucaucaccacagucacucuccacuuuaaacaguacgaguucaacaguccuccaaauaaccagguuaugcuuugugaaccgaccauuaucgagagaaauauaacagaaaucguguaucugaccaacacuacaauugagaaggaaaucugccccaaauuggcugaguacaggaauuggagcaagccucagugugacauuaccggguuugcaccauucuccaaagauaacucuauccgguuaucggccggaggugacauauggguaacgcgcgagcccuaugugucaugcgauccugacaaguguuaccaauuugcgcugggccaggggacuacccuaaauaacguccauagcaauaacacagugcgagaucguacuccauauagaacccuccugaugaaugaacuuggaguucccuuccaccugggcacaaaacaggugugcauugcuuggaguuccucuagcugucaugacgguaaggccugguugcacgucugcaucaccggggaugacaagaacgcaacggccuccuuuauuuacaauggaaggcucguggauucaguaguuaguuggagcaaagagauccugcggacucaggaaucugagugugugugcaucaacggcacauguaccgucgugaugacugacggcuccgcuucagggaaggcagauacaaaaauucuguucauagaggaaggaaagaucgugcauaccagcacgcucagugguucugcccaacacgucgaggaaugcuccugcuauccucgcuacccaggcguuagaugugugugcagggacaacuggaaggggagcaaucggccgauuguagauaucaacaugaaagaccacucgauagugucuuccuacgucuguucaggauuagugggcgacacaccccgcaagaaugaucgaaguagcaacucccauugccuggacccuaauaacgaggaaggugggcacggaguuaaaggcugggcuuuugaugacggcaaugauguguggauggggagaaccauuaacgagacuucuaggcuuggauaugagaccuucaaggucaucgaagguuggagcaauccaaaaucaaaguugcagaucaaccgucaggugauuguagaccggggcaaucgcaguggguacuccggaaucuuuagcguugagggcaaaucuuguauuaacagaugcuucuauguggaacugauaaggggucggaaggaggaaacagagguccuauggacuucaaauaguaucguggucuucugugggaccagcggcacauacggaaccggcuccuggcccgauggggccgaccucaaccugaugccuauuuga

SEQ ID NO: 145829 - RNA, 1410 nt, Artificial Sequence; identical to SEQ ID NO: 144162
  derived and/or modified sequence opt3 from neuraminidase__InfluenzaA__AGT18769

SEQ ID NO: 145830 - RNA, 1410 nt, Artificial Sequence
  derived and/or modified sequence opt3 from neuraminidase__InfluenzaA__AGT18770
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaacaagguuaugcugugugaaccgacuauaaucgagagaaauauuaccgaaaucguguauuugacaaacaccacuauugagaaagaaaucugccccaagccugcugaguacaggaauuggaguaaaccacagugugggauaacaggauucgcacccuuuagcaaggacaacuccauucgguuaucugccgguggcgauaucuggguaacccgcgagccuuaugugucgugcgacccagauaaguguuaccaguucgcgcuggggcaaggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaaaaacgcaaccgccagcuucaucuacaauggcaggcucguggacuccguaguuucauggaguaaggagauucugcggacgcaggaaagcgagugugugugcauaaacggcacuuguacagucgugaugaccgaugggucugcuuccggaaaagcagacacuaagauccuguuuauugaggaagguaagaucgugcauacaucaacccucagcggcagugcccagcacgucgaggaaugcucuugcuauccacgcuacccggggguuagaugugugugcagggauaacuggaaaggauccaaucggcccauaguagacauuaacaucaaggaucacagcaucgugucgucuuacgucuguuccggcuuagugggugacacgccucgcaaaaaugacucaaguagcuccucucauugccuggauccaaacaaugaggaagggggacacggcguuaagggcugggcuuucgacgaugggaacgacguguggaugggacgaaccauuaaugagacaagcagacuugguuaugagacuuuuaaagucaucgaaggcuggucaaaccccaagaguaaauugcaaauuaauaggcaagugauaguagaucguggggaccgguccggauacagcggcaucuucucuguugaggguaagucauguauuaaccgcugcuuuuauguggaacugaucagagggaggaaggaggaaaccgagguccuauggacaaguaauagcaucguggucuucuguggcacuuccggaaccuacggcacagggucuuggccugauggagccgaccucaaccugaugccaauuuga

SEQ ID NO: 145831 - RNA, 1410 nt, Artificial Sequence
  derived and/or modified sequence opt3 from neuraminidase__InfluenzaA__AGT18771
augaaccccaaucagaagaucauuaccauaggcagcgugucccugacaaucucuacuauuugcuucuuuaugcagaucgccauucucaucacgaccgucacacuucacuucaaacaguacaaguuuaacucaccuccaaauaaccagguuaugcugugugagccgacuauaaucgaaagaaauauuaccgagaucguguauuugacaaacaccacuauugaaaaagagaucugccccaagccugcugaauacaggaauuggaguaaaccacagugugggauaacaggauucgcacccuuuagcaaggacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugagcuuggcguuccuuuucaccuggguaccaaacaggugugcauugcuuggagcaguuccucuugucaugaugggaaggccugguugcacgucugcaucacaggagacgauaaaaacgcaaccgccagcuucaucuacaauggcaggcucguggacuccguaguuucauggaguaaggaaauucugcggacgcaggagagcgaaugugugugcauaaacggcacuuguacagucgugaugaccgaugggucugcuuccggaaaagcagacacuaagauccuguuuauugaggaggguaagaucgugcauacaucaacccucagcggcagugcccaacacgucgaagagugcucuugcuauccacgcuacccggggguuagaugugugugcagggauaacuggaaaggauccaaucggcccauaguagacauuaacaucaaggaucacagcaucgugucgucuuacgucuguuccggcuuagugggugacacgccucgcaaaaaugacucaaguagcuccucucauugccuggauccaaacaaugaagaagggggacacggcguuaagggcugggcuuucgacgaugggaacgacguguggaugggacgaaccauuaaugagacaagcagacuugguuaugagacuuuuaaagucaucgagggcuggucaaaccccaagaguaaauugcagauuaauaggcaagugauaguagaucguggggaccgguccggauacagcggcaucuucucuguugaagguaagucauguauuaaccgcugcuuuuauguggagcugaucagagggaggaaggaagagaccgaaguccuauggacaaguaauagcaucguggucuucuguggcacuuccggaaccuacggcacagggucuuggccugauggagccgaccucaaccugaugccaauuuga

SEQ ID NO: 145832 - RNA, 1410 nt, Artificial Sequence; identical to SEQ ID NO: 144162
  derived and/or modified sequence opt3 from neuraminidase__InfluenzaA__AGT18772

SEQ ID NO: 145833 - RNA, 1410 nt, Artificial Sequence
  derived and/or modified sequence opt3 from neuraminidase__InfluenzaA__AGT37104
augaaccccaaucagaagaucauuaccauaggcagcgugucccugacaaucgccacuauuugccuccuuaugcaaaucgcuauucuggucacgaccguuacauugcacuucaaacaguacgaguguucuucaccuccaaacaaucaggugaugccgugcgaacccacuaucauagagagaaacaucaccaagauuguauauuuaacaaauaccacuaucgaaagggaggcauguccugaacuggccgaguaccggcauuggaguaaaccacagugcaagauucgcggguuugcgcccuucagcaaagacaacuccauccgacuaucugcuggaggugauauaugggugacacgugagccuuaugucucgugugacccaggcaagugcuaccaauuugcccucgggcagggaaccacgcugaauaacagacacucaaaugauacugugcaugacaggacccccuaucggacacuucugaugaacgaauugggcguuccuuuccaccucgguacuaaacagguguguauugcauggagcaguuccucuugccaugaugggaaggccuggcugcacgucuguaucaccggacacgacaagaaugcuacagccagcuuuauuuacgauggccgccugguggacuccaucggcucauggagucagaacauccucagaacccaagagagcgaaugcguauguauuaaugggacgugcacuguugugaugacagauggaucugcauccgguagggcugacaccaaaauaauguucgucgaggagggcaagaucgugcauauuucaccauuagccgggagcgcgcagcacguggaagagugcaguuguuauccgaaauaccccggaguccggugcguuugucgcgauaacuggaagggcucuaaucgaccuaucguggacauaaacaugaaggauuacuccauuguaagcucguaugugugcucuggucuggucggggacacuccaagaaggaacgacuccucaaguacaagcuacugucuuaaucccaacaaugaagagggaggccauggcgugaaagggugggcauuugaugacggagaugacguuuggaugggucggaccaucuccgaaaaguugcgucugggcuaugagacguucaaagugaucgggggauggucuaagccuaacagcaaacuacagauuaaucgccaggucgugguagauaucucaaacagaaguggcuacuccgguauuuuuagcguugaggggaagucuugcauaaauagguguuucuauguggaacucauccggggccgaaaacaagagaacgaagucugguggaccucaaauaguauuguggucuuuugcggaacaagcggcacuuacgggaccggauccuggccagacggugccgauaucaaccugaugcccaucuga

SEQ ID NO: 145834 - RNA, 1410 nt, Artificial Sequence
  derived and/or modified sequence opt3 from neuraminidase__InfluenzaA__AGU69973
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccccucugucagggagcgcucaacacguggaggaaugcaguuguuauccacgguacccgggaguccgcugcguuuguagagacaacuggaagggcucuaauaggcccaucguggauauaaacguaaaagacuacuccauugugagcucguauguccggucuggucuugugggggacaccccucgcaagaaugauuccucaaguagcucccauugcuuggacccaaacaaugaggaaggaggccacggcguuaaagggugggccuucgaugacggaaacgauguguggaugggucgaacgaucucugaaaagagcagaucaggcuacgagaccuuuaaagucaucgagggguggaguaagcccaauuccaaacugcagauuaacaggcaagugaucguagaccggggaaaucguagcggcuauucugguauuuucucaguugaggggaagaguuguauaaaccgcugcuuuuacguggaacuaaucagaggcggaaagcaggagacagaaguccucuggacuagcaauuccauuguggucuucuguggcaccucugggacauauggaacugguucguggccugauggcgcggaccugaaccuuaugccaaucuga

SEQ ID NO: 145835 - RNA, 1410 nt, Artificial Sequence
  derived and/or modified sequence opt3 from neuraminidase__InfluenzaA__AGU92648
augaaccccaaucagaagaucauuaccauaggcagcgugugcaugacaaucgggauggccaaccugauucuccaaaucggaaauauuaucuccauauggaucucucacucaauucagcuuagaaaccagagucagaucgagacuuguaaucaaagcgucauuacguacgaaaacaauaccuggguuaaccagacauaugugaauaucuccaacacuaauuucgcugcaggucagucuguagugucggucaaacuggccggcaacagcucauugugcccugugagugggugggcgauauacuccaaggacaauucuauuaggaucggaagcaaaggcgauguuuuugugauucgggagccauucaucuccuguucaccguuagaaugccgcaccuuuuuccugacacagggugcucuacucaacgacaagcauaguaaugggaccaucaaagaucgaagccccuaucguacucugaugucuuguccuauuggagaggucccaucccccuacaacucaagauuugaaagcguggccuggagugcaucugccugccacgacggcauaaacuggcuuacaaucggcauuuccgggccugauaauggagcuguagcaguucugaaguauaacgguaucauaaccgacacgauuaagagcuggaggaauaacaucuugcggacucaagagucggagugugccugcgugaauggcucuuguuucaccaucaugacagaugggccauccgacggacaggcuucauacaaaauuuuucgcaucgaaaagggcaaaauugucaagaguguggagaugaacgcccccaauuaucauuacgaagagugcagcuguuacccugauuccucugagauaaucugcgugugcagagacaacuggcacgguagcaauaggccaugggucucauucaaccagaaucucgaauaucagauuggguacaucuguaguggaaucuuuggcgauaacccgcggcccaaugacaaaacuggcuccugcgggccuguuagcucuaacggagcgaauggugugaagggcuucucauuuaaguaugggaacggaguauggauuggccgcaccaaaaguauaagcucccgaaaggguuucgagaugaucugggauccaaacggguggacaggcaccgacaauaacuuuucuauuaaacaagacaucgugggaauuaaugaauggucgggcuacagcggguccuucguccagcaucccgagcugacgggacuggauuguaucagaccuugcuucuggguggaacucauaaggggucggccaaaggagaacacuaucuggacaucaggcaguucuauuagcuuuugugggguuaauuccgacaccgugggauggucauggcccgauggcgcagaguuaccguucacuaucgacaaauga

SEQ ID NO: 145836 - RNA, 1410 nt, Artificial Sequence
  derived and/or modified sequence opt3 from neuraminidase__InfluenzaA__AGU92670
augaaccccaaucagaagaucauuaccauaggcagcgugugcaugacaaucgggauggccaaccugauucuccaaaucggaaauauuaucuccauauggaucucucacucaauucagcuuagaaaccagagucagaucgagacuuguaaucaaagcgucauuacguacgaaaacaauaccuggguuaaccagacauaugugaauaucuccaacacuaauuucgcugcaggucagucuguagugucggucaaacuggccggcaacagcucauugugcccugugagugggugggcgauauacuccaaggacaauucuauuaggaucggaagcaaaggcgauguuuuugugauucgggagccauucaucuccuguucaccguuagaaugccgcaccuuuuuccugacacagggugcucuacucaacgacaagcauaguaaugggaccaucaaagaucgaagccccuaucguacucugaugucuuguccuauuggagaggucccaucccccuacaacucaagauuugaaagcguggccuggagugcaucugccugccacgacggcauaaacuggcuuacaaucggcauuuccgggccugauaauggagcuguagcaguucugaaguauaacgguaucauaaccgacacgauuaagagcuggaggaauaacaucuugcggacucaagagucggagugugccugcgugaauggcucuuguuucaccaucaugacagaugggccauccgacggacaggcuucauacaaaauuuuucgcaucgaaaagggcaaaauugucaagaguguggagaugaacgcccccaauuaucauuacgaagagugcagcuguuacccugauuccucugagauaaucugcgugugcagagacaacuggcacgguagcaauaggccaugggucucauucaaccagaaucucgaauaucagauuggguacaucuguaguggaaucuuuggcgauaacccgcggcccgacgauaaaacuggcuccugcgggccuguuagcucuaauggagcgaacggugugaagggcuucucauuuaaguaugggaauggaguauggauuggccgcaccaaaaguauaagcucccgaaaggguuucgagaugaucugggacccaaacggguggacaggcaccgacaacaauuuuucuauuaaacaagauaucgugggaauuaacgaauggucgggcuacagcggguccuucguccagcaucccgagcugacgggacuggacuguaucagaccuugcuucuggguggaacucauaaggggucggccaaaggagaauacuaucuggacaucaggcaguucuauuagcuuuugugggguuaacuccgauaccgugggauggucauggcccgacggcgcagaguuaccguucacuaucgauaaauga

SEQ ID NO: 145837 - RNA, 1410 nt, Artificial Sequence
  derived and/or modified sequence opt3 from neuraminidase__InfluenzaA__AGU92681
augaaccccaaucagaagaucauuaccauaggcagcgugugcaugacaaucgggauggccaaccugauucuccaaaucggaaauauuaucuccauauggaucucucacucaauucagcuuagaaaccagagucagaucgagacuuguaaucaaagcgucauuacguacgaaaacaauaccuggguuaaccagacauaugugaauaucuccaacacuaauuucgcugcaggucagucuguagugucggucaaacuggccggcaacagcucauugugcccugugagugggugggcgaccuacuccaaggacaauucuauaaggauuggaagcaaaggcgauguuuuugugauccgggagccauucauuuccuguucaccguuagaaugccgcacauuuuuccugacccagggugcucuacucaacgacaagcauaguaaugggacuaucaaagaucgaagccccuaucguacacugaugucuuguccuaucggagaggucccaucccccuacaacucaagauuugaaagcguggccuggagugcaucugccugccacgacggcauuaacuggcuuaccauaggcaucuccgggccugauaauggagcuguagcaguucugaaguauaacgguauuaucacggacacuauaaagagcuggaggaauaacauuuugcggacccaagagucggagugugccugcgugaauggcucuuguuucacaaucaugacugaugggccauccgacggacaggcuucauacaaaaucuuucgcauugaaaagggcaaaaucgucaagaguguggagaugaacgcccccaauuaucauuacgaagagugcagcuguuacccugauuccucugagauuauaugcgugugcagagacaacuggcacgguagcaauaggccaugggucucauucaaccagaaucucgaauaucagaucggguacauuuguaguggaaucuuuggcgauaacccgcggcccaaugacaaaaccggcuccugcgggccuguuagcucuaacggagcgaauggugugaagggcuucucauuuaaguaugggaacggaguauggaucggccgcacaaaaaguauuagcucccgaaaggguuucgagaugauaugggauccaaacggguggaccggcacggacaauaacuuuucuaucaaacaagacauugugggaaucaaugaauggucgggcuacagcggguccuucguccagcaucccgagcugacuggacuggauuguauuagaccuugcuucuggguggaacucaucaggggucggccaaaggagaacacaauauggaccucaggcaguucuaucagcuuuugugggguuaauuccgacacugugggauggucauggcccgauggcgcagaguuaccguucacaauugacaaauga

SEQ ID NO: 145838 - RNA, 1410 nt, Artificial Sequence
  derived and/or modified sequence opt3 from neuraminidase__InfluenzaA__AGU92692
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagagugggcucuaaaggugaugucuuugugauuagggagccauucaucagcuguuccccguuagaaugccggaccuuuuuccugacacagggggcucuacucaaugacaagcauucaaacggaaccauuaaagaucgcagucccuaucgaacucugaugagcuguccuaucggcgagguaccaucucccuacaacucccguuuugaaucaguugccuggagcgcaagugccugccacgacggcaucaauuggcuuacaauugggauaucuggaccugauaacggugcuguggcaguccugaaguauaauggcaucauuaccgacacgaucaaguccuggagaaacaauauauugaggacucaagagagcgagugugccugcgugaacgggucguguuucaccgugaugacagauggaccaucuaauggccaggcuuccuacaaaauuuuucggaucgaaaaggguaaaaucgucaagucaguugagaugaacgcccccaauuaucauuacgaagagugcaguuguuacccugacagcuccgagauuacuugcgugugccgcgauaacuggcacgggucuaauagaccaugggugagcuucaaccagaaucucgaauaucagaucggauacauuuguucaggcauauuuggcgacaacccgaggcccaaugauaaaaccgggaguugcggaccuguauccagcaacggugcgaacggcgucaagggguucucuuuuaaguauggaaauggcguguggaucggucggacaaaaucaauuaguagccgcaacggguucgagaugaucugggacccaaauggcuggaccggaacggauaacaauuuuuccaucaagcaagacauuguuggcauaaacgaauggucuggguacucggggagcuucauccagcaucccgagcugacuggucuggacuguauucgaccuugcuucuggguggaacucaucagaggcaggccaaaagagaauacaauuuggaccuccgggucaaguaucucuuuuuguggagucaacagcgauacugugggcugguccuggcccgacggugcagaguuaccguucacaauagauaaguga

SEQ ID NO: 145839 - RNA, 1410 nt, Artificial Sequence; identical to SEQ ID NO: 145838
  derived and/or modified sequence opt3 from neuraminidase__InfluenzaA__AGU92703

SEQ ID NO: 145840 - RNA, 1410 nt, Artificial Sequence; identical to SEQ ID NO: 145838
  derived and/or modified sequence opt3 from neuraminidase__InfluenzaA__AGU92714

SEQ ID NO: 145841 - RNA, 1410 nt, Artificial Sequence; identical to SEQ ID NO: 145838
  derived and/or modified sequence opt3 from neuraminidase__InfluenzaA__AGU92725

SEQ ID NO: 145842 - RNA, 1410 nt, Artificial Sequence; identical to SEQ ID NO: 145838
  derived and/or modified sequence opt3 from neuraminidase__InfluenzaA__AGU92736

SEQ ID NO: 145843 - RNA, 1410 nt, Artificial Sequence; identical to SEQ ID NO: 145838
  derived and/or modified sequence opt3 from neuraminidase__InfluenzaA__AGU92747

SEQ ID NO: 145844 - RNA, 1410 nt, Artificial Sequence; identical to SEQ ID NO: 145838
  derived and/or modified sequence opt3 from neuraminidase__InfluenzaA__AGU92758

SEQ ID NO: 145845 - RNA, 1410 nt, Artificial Sequence; identical to SEQ ID NO: 145835
  derived and/or modified sequence opt3 from neuraminidase__InfluenzaA__AGU92769

SEQ ID NO: 145846 - RNA, 1410 nt, Artificial Sequence; identical to SEQ ID NO: 145835
  derived and/or modified sequence opt3 from neuraminidase__InfluenzaA__AGU92780

SEQ ID NO: 145847 - RNA, 1410 nt, Artificial Sequence
  derived and/or modified sequence opt3 from neuraminidase__InfluenzaA__AGU92791
augaaccccaaucagaagaucauuaccauaggcagcgugugcaugacaaucgggauggccaaccugauucuccaaaucggaaauauuaucuccauauggaucucucacucaauucagcuuagaaaccagagucagaucgagacuuguaaucaaagcgucauuacguacgaaaacaauaccuggguuaaccagacauaugugaauaucuccaacacuaauuucgcugcaggucagucuguagugucggucaaacuggccggcaacagcucauugugcccugugagugggugggcgauauacuccaaggacaauucuauuaggaucggaagcaaaggcgauguuuuugugauucgggagccauucaucuccuguucaccguuagaaugccgcaucuuuuuccugacccagggugcucuacucaacgacaagcauaguaaugggacaauuaaagaucgaagccccuaucguacccugaugucuuguccuauaggagaggucccaucccccuacaacucaagauuugaaagcguggccuggagugcaucugccugccacgacggcaucaacuggcuuacuauuggcaucuccgggccugauaauggagcuguagcaguucugaaguauaacgguauaauuacagacaccaucaagagcuggaggaauaacaucuugcggacgcaagagucggagugugccugcgugaauggcucuuguuucacuauuaugaccgaugggccauccgacggacaggcuucauacaaaaucuuucgcauugaaaagggcaaaauagucaagaguguggagaugaacgcccccaauuaucauuacgaagagugcagcuguuacccugauuccucugagaucauuugcgugugcagagacaacuggcacgguagcaauaggccaugggucucauucaaccagaaucucgaauaucagaucggguacaucuguaguggaauuuuuggcgauaacccgcggcccaaugacaaaacaggcuccugcgggccuguuagcucuaacggagcgaauggugugaagggcuucucauuuaaguaugggaacggaguauggauaggccgcacuaaaaguaucagcucccgaaaggguuucgagaugauuugggauccaaacggguggaccggcacagacaauaacuuuucuaucaaacaagacauugugggaaucaaugaauggucgggcuacagcggguccuucguccagcaucccgagcugaccggacuggauuguauaagaccuugcuucuggguggaacucaucaggggucggccaaaggagaacacgauuuggacuucaggcaguucuaucagcuuuugugggguuaauuccgacacagugggauggucauggcccgauggcgcagaguuaccguucaccauugacaaauga

SEQ ID NO: 145848 - RNA, 1410 nt, Artificial Sequence; identical to SEQ ID NO: 145835
  derived and/or modified sequence opt3 from neuraminidase__InfluenzaA__AGU92802

SEQ ID NO: 145849 - RNA, 1410 nt, Artificial Sequence; identical to SEQ ID NO: 145835
  derived and/or modified sequence opt3 from neuraminidase__InfluenzaA__AGU92813

SEQ ID NO: 145850 - RNA, 1410 nt, Artificial Sequence; identical to SEQ ID NO: 145835
  derived and/or modified sequence opt3 from neuraminidase__InfluenzaA__AGU92824

SEQ ID NO: 145851 - RNA, 1410 nt, Artificial Sequence
  derived and/or modified sequence opt3 from neuraminidase__InfluenzaA__AGU92846
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccguuagagugggcucuaaaggugaugucuuugugauuagggagccauucaucagcuguuccccguuagaaugccggaccuuuuuccugacacagggggcucuacucaaugacaagcauucaaacggaaccauuaaagaucgcagucccuaucgaacucugaugagcuguccuaucggcgagguaccaucucccuacaacucccguuuugaaucaguugccuggagcgcaagugccugccacgacggcaucaauuggcuuacaauugggauaucuggaccugauaacggugcuguggcaguccugaaguauaauggcaucauuaccgacacgaucaaguccuggagaaacaauauauugaggacucaagagagcgagugugccugcgugaacgggucguguuucaccgugaugacagauggaccaucuaauggccaggcuuccuacaaaauuuuucggaucgaaaaggguaaaaucgucaagucaguugagaugaacgcccccaauuaucauuacgaagagugcaguuguuacccugacagcuccgagauuacuugcgugugccgcgauaacuggcacgggucuaauagaccauggguaucguucaaccagaaucucgaauaucagaucggauacauuuguucaggcauauuuggcgacaacccgaggcccaaugauaaaaccgggaguugcggaccuguguccagcaacggugcgaacggcgucaagggguucgcauuuaaguauggaaauggcguguggaucggucggacaaaaucuauuucaagucgcaacggguucgagaugaucugggacccaaauggcuggaccggaacggauaacaauuuuagcaucaagcaagacauuguuggcauaaacgaaugguccggguacucuggaucguucauccagcaucccgagcugacuggucuggacuguauucgaccuugcuucuggguggaacucaucagaggcaggccaaaagagaauacaauuuggaccagcggguccucaaucaguuuuuguggagucaacucugauacugugggcuggagcuggcccgacggugccgaguuaccguucacaauagauaaguga

SEQ ID NO: 145852 - RNA, 1410 nt, Artificial Sequence
  derived and/or modified sequence opt3 from neuraminidase__InfluenzaA__AGU92868
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaauuugccggaaauucgucacugugcccugugagcggaugggcgauauacaguaaggacaacuccguuagagugggcucuaaaggugaugucuucgugauuagggagccauuuaucagcuguuccccguuggaaugccggaccuucuuuuuaacacagggggcucugcuaaaugacaagcauucaaacggaaccauuaaagaucgcagucccuaucgaacucucaugagcuguccuaucggcgagguaccaucucccuacaacucccguuucgaaucaguugccuggagcgcaagugccugccacgacggcaucaauuggcugacaauugggauaucuggaccugauaacggugcuguggcaguccuuaaguauaauggcaucauuaccgacacgaucaaguccuggagaaacaauauacugaggacucaagagagcgagugugccugcgugaacgggucguguuuuaccgugaugacagauggaccaucuaauggccaggcuuccuacaaaauuuuccggaucgaaaaggguaaaaucgucaagucaguugagaugaacgcccccaauuaucauuacgaagagugcaguuguuacccugacagcuccgagauuacuugcgugugccgcgauaacuggcacgggucuaauagaccaugggugagcuuuaaccagaauuuggaauaucagaucggauacauuuguucaggcauauucggcgacaacccgaggcccaaugauaaaaccgggaguugcggaccuguauccagcaacggugcgaacggcgucaagggguuuucuuucaaguauggaaauggcguguggaucggucggacaaaaucaauuaguagccgcaacggguuugagaugaucugggacccaaauggcuggaccggaacggauaacaauuucuccaucaagcaagacauuguuggcauaaacgaauggucuggguacucggggagcuucauccagcaucccgagcucacuggucuggacuguauucgaccuugcuuuuggguggaacugaucagaggcaggccaaaagagaauacaauuuggaccuccgggucaaguaucucuuucuguggagucaacagcgauacugugggcugguccuggcccgacggugcagagcucccguuuacaauagauaaguga

SEQ ID NO: 145853 - RNA, 1410 nt, Artificial Sequence
  derived and/or modified sequence opt3 from neuraminidase__InfluenzaA__AGU92890
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccguuagagugggcucuaaaggugaugucuuugugauuagggagccauucaucagcuguuccccguuagaaugccggaccuuuuuccugacacagggggcucuacucaaugacaagcauucaaacggaaccauuaaagaucgcagucccuaucgaacucugaugagcuguccuaucggcgagguaccaucucccuacaacucccguuuugaaucaguugccuggagcgcaagugccugccacgacggcaucaauuggcuuacaauugggauaucuggaccugauaacggugcuguggcaguccugaaguauaauggcaucauuaccgacacgaucaaguccuggagaaacaauauauugaggacucaagagagcgagugugccugcgugaacgggucguguuucaccgugaugacagauggaccaucuaauggccaggcuuccuacaaaauuuuucggaucgaaaaggguaaaaucgucaagucaguugagaugaacgcccccaauuaucauuacgaagagugcaguuguuacccugacagcuccgagauuacuugcgugugccgcgauaacuggcacgggucuaauagaccauggguaucguucaaccagaaucucgaauaucagaucggauacauuuguucaggcauauuuggcgacaacccgaggcccaaugauaaaaccgggaguugcggaccuguguccagcaacggugcgaacggcgucaagggguucucuuuuaaguauggaaauggcguguggaucggucggacaaaaucaauuaguagccgcaacggguucgagaugaucugggacccaaauggcuggaccgaaacggauaacaauuuuuccaucaagcaagacauuguuggaauaaacgaguggucuggcuacucggggagcuucauccagcaucccgaacugacuggacuggacuguauucgaccuugcuucuggguggagcucaucagagguaggccaaaagagaauacaauuuggaccuccggcucaaguaucucuuuuuguggggucaacagcgauacugugggaugguccuggcccgacggcgcagaauuaccguucacaauagauaaguga

SEQ ID NO: 145854 - RNA, 1410 nt, Artificial Sequence; identical to SEQ ID NO: 145835
  derived and/or modified sequence opt3 from neuraminidase__InfluenzaA__AGU92901

SEQ ID NO: 145855 - RNA, 1410 nt, Artificial Sequence; identical to SEQ ID NO: 145835
  derived and/or modified sequence opt3 from neuraminidase__InfluenzaA__AGU92912

SEQ ID NO: 145856 - RNA, 1410 nt, Artificial Sequence; identical to SEQ ID NO: 145835
  derived and/or modified sequence opt3 from neuraminidase__InfluenzaA__AGU92923

SEQ ID NO: 145857 - RNA, 1410 nt, Artificial Sequence; identical to SEQ ID NO: 145838
  derived and/or modified sequence opt3 from neuraminidase__InfluenzaA__AGU92934

SEQ ID NO: 145858 - RNA, 1410 nt, Artificial Sequence; identical to SEQ ID NO: 145838
  derived and/or modified sequence opt3 from neuraminidase__InfluenzaA__AGU92945

SEQ ID NO: 145859 - RNA, 1410 nt, Artificial Sequence; identical to SEQ ID NO: 145838
  derived and/or modified sequence opt3 from neuraminidase__InfluenzaA__AGU92956

SEQ ID NO: 145860 - RNA, 1410 nt, Artificial Sequence; identical to SEQ ID NO: 145835
  derived and/or modified sequence opt3 from neuraminidase__InfluenzaA__AGU92967

SEQ ID NO: 145861 - RNA, 1410 nt, Artificial Sequence; identical to SEQ ID NO: 145835
  derived and/or modified sequence opt3 from neuraminidase__InfluenzaA__AGU92978

SEQ ID NO: 145862 - RNA, 1410 nt, Artificial Sequence
  derived and/or modified sequence opt3 from neuraminidase__InfluenzaA__AGU92989
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagagugggcucuaaaggugaugucuuugugauuagggagccauucaucagcuguuccccguuagaaugccggaccuuuuuccugacacagggggcucuacucaaugacaagcauucaaacggaaccauuaaagaucgcagucccuaucgaacucugaugagcuguccuaucggcgagguaccaucucccuacaacucccguuuugaaucaguugccuggagcgcaagugccugccacgacggcaucaauuggcuuacaauugggauaucuggaccugauaacggugcuguggcaguccugaaguauaauggcaucauuaccgacacgaucaaguccuggagaaacaauauauugaggacucaagagagcgagugugccugcgugaacgggucguguuucaccgugaugacagauggaccaucuaauggccaggcuuccuacaaaauuuuucggaucgaaaaggguaaaaucgucaagucaguugagaugaacgcccccaauuaucauuacgaagagugcaguuguuacccugacagcuccgagauuacuugcgugugccgcgauaacuggcacgggucuaauagaccaugggugagcuucaaccagaaucucgaauaucagaucggauacauuuguucaggcauauuuggcgacaacccgaggcccaaugauaaaaccgggaguugcggaccuguauccagcaacggugcgaacggcgucaagggguucucuuuuaaguauggaaauggcguguggaucggucggacaaaaucaauuaguagccgcaacggguucgagaugaucugggacccaaauggcuggaccggaacggauaacaauuuuuccaucaagcaagacauuguuggcauaaacgaauggucuggguacucggggagcuucgugcagcaucccgagcugacuggucuggacuguauccgaccuugcuucugggucgaacucauuagaggcaggccaaaagagaauacaaucuggaccuccgggucaaguauuucuuuuuguggagugaacagcgauacuguaggcugguccuggcccgacggugcagaguuaccguucacaaucgauaaguga

SEQ ID NO: 145863 - RNA, 1410 nt, Artificial Sequence; identical to SEQ ID NO: 145852
  derived and/or modified sequence opt3 from neuraminidase__InfluenzaA__AGU93000

SEQ ID NO: 145864 - RNA, 1410 nt, Artificial Sequence; identical to SEQ ID NO: 145853
  derived and/or modified sequence opt3 from neuraminidase__InfluenzaA__AGU93011

SEQ ID NO: 145865 - RNA, 1365 nt, Artificial Sequence; identical to SEQ ID NO: 142406
  derived and/or modified sequence opt3 from neuraminidase__InfluenzaA__AGU93022

SEQ ID NO: 145866 - RNA, 1410 nt, Artificial Sequence
  derived and/or modified sequence opt3 from neuraminidase__InfluenzaA__AGU93034
augaaccccacccagaagaucauuacaauaggcagcgugugcaugacuaucgggauggccaaucugauucuccaaaucggaaacauuaucuccauauggaucucucacucaauucagcuugguaaucagaaccagaucgagacguguaaucaaagugucauuaccuacgaaaacaauacauggguuaaccagacuuaugugaauaucagcaacaccaauuucgcugcaggccaguccguagccucugugaaacuggcggggaacucgucauugugcccugucagcggaugggcuauauacaguaaggacaauuccauuagaaucggcucuaaaggugauguguuuguuauuagggagccauucaucagcuguuccccguuagaaugccggacauuuuuccugacccagggggcccuacucaacgacaagcauucaaauggaacuaucaaagaucgcagucccuaucgaacacugaugagcuguccuauuggcgaggugccaucucccuacaacucccguuuugaaucagucgcauggagcgccagugcuugccacgacggcauaaacuggcuuaccaucgggauuucuggaccugauaauggugcaguggccguacugaaguauaacggcaucauaacggacacuauuaaguccuggagaaauaacaucuugaggacccaagagagcgagugugcuugcguuaaugggucguguuucacaaucaugacugauggaccaucugacggccaggccuccuacaaaauuuuucggaucgaaaaggguaaaauugugaagucagucgagaugaacgcgcccaauuaucauuacgaagagugcaguuguuacccugauagcuccgagauaaccugcgugugccgcgacaacuggcacgggucuaauagaccaugggugagcuucaaccagaaucucgaauaucagaucggauacauuuguucaggcaucuuuggcgauaacccgaggcccaaugacaaaacagggaguugcggaccugucuccagcaacggugcaaauggcguuaagggguucucuuuuaaguauggaaacggcguguggaucggucggaccaaaucaauuaguagccgcaagggguucgagaugauaugggauccaaacggcuggacgggaacugacaauaacuuuuccaucaaacaagacauuguaggcaucaaugaauggucuggguacucggguagcuucgugcagcaucccgagcugacaggacuggauuguauucgaccuugcuucugggucgaacucaucagaggcaggccaaaggagaacaccauauggacuuccgggucaaguaucucuuuuuguggagugaauagcgacacaguuggcugguccuggcccgauggugccgaguuaccguucaccauugacaaauga

SEQ ID NO: 145867 - RNA, 1410 nt, Artificial Sequence; identical to SEQ ID NO: 145174
  derived and/or modified sequence opt3 from neuraminidase__InfluenzaA__AGU93045

SEQ ID NO: 145868 - RNA, 1410 nt, Artificial Sequence; identical to SEQ ID NO: 145835
  derived and/or modified sequence opt3 from neuraminidase__InfluenzaA__AGU93056

SEQ ID NO: 145869 - RNA, 1410 nt, Artificial Sequence; identical to SEQ ID NO: 144162
  derived and/or modified sequence opt3 from neuraminidase__InfluenzaA__AGV98980

SEQ ID NO: 145870 - RNA, 1410 nt, Artificial Sequence; identical to SEQ ID NO: 144162
  derived and/or modified sequence opt3 from neuraminidase__InfluenzaA__AGV98993

SEQ ID NO: 145871 - RNA, 1410 nt, Artificial Sequence; identical to SEQ ID NO: 144162
  derived and/or modified sequence opt3 from neuraminidase__InfluenzaA__AGV99005

SEQ ID NO: 145872 - RNA, 1410 nt, Artificial Sequence; identical to SEQ ID NO: 144162
  derived and/or modified sequence opt3 from neuraminidase__InfluenzaA__AGV99017

SEQ ID NO: 145873 - RNA, 1410 nt, Artificial Sequence; identical to SEQ ID NO: 144162
  derived and/or modified sequence opt3 from neuraminidase__InfluenzaA__AGV99040

SEQ ID NO: 145874 - RNA, 1410 nt, Artificial Sequence
  derived and/or modified sequence opt3 from neuraminidase__InfluenzaA__AGV99052
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcgugaucucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcagauuaauaggcaagugauaguagaucguggggaccgguccggauacagcggcaucuucucuguugaggguaaaucauguauuaaccgcugcuuuuauguggaacugaucagagggaggaaggaggaaaccgagguccuauggacaaguaauagcaucguggucuucuguggcacuuccggaaccuacggcacagggucuuggccugauggagccgaccucaaccugaugccaauuuga

SEQ ID NO: 145875 - RNA, 1410 nt, Artificial Sequence
  derived and/or modified sequence opt3 from neuraminidase__InfluenzaA__AGV99100
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcagauuaauaggcaagugauaguagaucguggggaccgguccggauacagcggcaucuucucuguugaggguaaaucaugugugaaccgcugcuuuuaugucgaacugauuagagggaggaaggaggaaaccgaggugcuauggacaaguaauagcaucgucguguucuguggcacuuccggaaccuacggcacagggucuuggccugauggagccgaccucaaccugaugccaaucuga

SEQ ID NO: 145876 - RNA, 1410 nt, Artificial Sequence; identical to SEQ ID NO: 144162
  derived and/or modified sequence opt3 from neuraminidase__InfluenzaA__AGV99112

SEQ ID NO: 145877 - RNA, 1410 nt, Artificial Sequence; identical to SEQ ID NO: 144162
  derived and/or modified sequence opt3 from neuraminidase__InfluenzaA__AGV99124

SEQ ID NO: 145878 - RNA, 1410 nt, Artificial Sequence; identical to SEQ ID NO: 144162
  derived and/or modified sequence opt3 from neuraminidase__InfluenzaA__AGV99136

SEQ ID NO: 145879 - RNA, 1410 nt, Artificial Sequence; identical to SEQ ID NO: 144162
  derived and/or modified sequence opt3 from neuraminidase__InfluenzaA__AGV99148

SEQ ID NO: 145880 - RNA, 1410 nt, Artificial Sequence; identical to SEQ ID NO: 144162
  derived and/or modified sequence opt3 from neuraminidase__InfluenzaA__AGV99160

SEQ ID NO: 145881 - RNA, 1410 nt, Artificial Sequence; identical to SEQ ID NO: 144162
  derived and/or modified sequence opt3 from neuraminidase__InfluenzaA__AGV99172

SEQ ID NO: 145882 - RNA, 1410 nt, Artificial Sequence; identical to SEQ ID NO: 144162
  derived and/or modified sequence opt3 from neuraminidase__InfluenzaA__AGV99196

SEQ ID NO: 145883 - RNA, 1410 nt, Artificial Sequence; identical to SEQ ID NO: 144162
  derived and/or modified sequence opt3 from neuraminidase__InfluenzaA__AGV99208

SEQ ID NO: 145884 - RNA, 1410 nt, Artificial Sequence; identical to SEQ ID NO: 144162
  derived and/or modified sequence opt3 from neuraminidase__InfluenzaA__AGV99959

SEQ ID NO: 145885 - RNA, 1410 nt, Artificial Sequence; identical to SEQ ID NO: 145373
  derived and/or modified sequence opt3 from neuraminidase__InfluenzaA__AGW00005

SEQ ID NO: 145886 - RNA, 1410 nt, Artificial Sequence; identical to SEQ ID NO: 144162
  derived and/or modified sequence opt3 from neuraminidase__InfluenzaA__AGW00068

SEQ ID NO: 145887 - RNA, 1410 nt, Artificial Sequence
  derived and/or modified sequence opt3 from neuraminidase__InfluenzaA__AGW00080
augaaccccaaucagaagaucauuaccauaggcagcgugucccugacaaucucuacuauuugcuucuuuaugcagaucgccauucucaucacgaccgucacacuucacuucaaacaguacgaguuugacucaccuccaaacaaucagguuaugcugugugaaccgacuauaaucgagagaaacauuaccgaaaucguguauuugacaaauaccacuauugagaaggaaaucugccccaaaccugcugaguacaggaacuggaguaagccacagugugggauaacaggauucgcacccuuuagcaaagauaauuccauucgguuaucugccgguggcgacaucuggguaacccgcgagccuuaugugucgugcgauccagacaaguguuaccaauucgcgcuggggcagggaacgacucuaaacaauguccauucaaacaauaccgugcgagaucguacacccuauagaacucuccugaugaacgaacuuggcguuccuuuucaccuggguaccaaacaggugugcauugcuuggagcaguuccucuugucaugacgggaaggccugguugcacgucugcaucacaggagaugacaagaaugcaaccgccagcuucaucuacaacggcaggcucguggauuccguaguuucauggaguaaagagauucugcggacgcaggaaagcgagugugugugcauaaauggcacuuguacagucgugaugaccgacgggucugcuuccggaaaggcagauacuaaaauccuguuuauugaggaagguaagaucgugcauacaucaacccucagcggcagugcccaacacgucgaggaaugcucuugcuauccacgcuacccggggguuagaugugugugcagggacaacuggaagggauccaaccggcccauaguagauauuaauaucaaagaccacagcaucgugucgucuuacgucuguuccggcuuagugggugacacgccucgcaagaacgauucaaguagcuccucucauugccuggacccaaauaacgaggaagggggacacggcguuaaaggcugggcuuucgaugacgggaaugauguguggaugggacgaaccauuaacgagacaagcagacuugguuaugagacuuuuaaggucaucgaaggcuggucaaaucccaaaaguaaguugcagauuaacaggcaagugauaguagaccguggggaucgguccggauacagcggcaucuucucuguugaggguaaaucauguauuaaucgcugcuuuuauguggaacugaucagagggaggaaggaggaaaccgagguccuauggacaaguaacagcaucguggucuucuguggcacuuccggaaccuacggcacagggucuuggccugacggagccgaucucaaucugaugccaauuuga

SEQ ID NO: 145888 - RNA, 1410 nt, Artificial Sequence
  derived and/or modified sequence opt3 from neuraminidase__InfluenzaA__AGW00104
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggagaggcagacacuaagauccuguuuauugaagaggguaaaaucgugcauacaucaacccucagcggcagugcccaacacgucgaagagugcucuugcuauccacgcuacccggggguuagaugugugugcagggauaacuggaagggauccaaucggcccauaguagacauuaacaucaaggaucacagcaucgugucgucuuacgucuguuccggcuuagugggugacacgccucgcaaaaaugacucaaguagcuccucucauugccuggauccaaacaaugaagaagggggacacggcguuaagggcugggcuuucgacgaugggaacgacguguggaugggacgaaccauuaaugagacaagcagacuugguuaugagacuuuuaaagucaucgagggcuggucaaaccccaagaguaaauugcagauuaauaggcaagugauaguagaucguggggaccgguccggauacagcggcaucuucucuguugaagguaagucauguauuaaccgcugcuuuuauguggagcugaucagagggaggaaagaagagaccgagguccuauggacaaguaauagcaucguggucuucuguggcacuuccggaaccuacggcacagggucuuggccugauggagccgaccucaaccugaugccaauuuga

SEQ ID NO: 145889 - RNA, 1410 nt, Artificial Sequence; identical to SEQ ID NO: 145887
  derived and/or modified sequence opt3 from neuraminidase__InfluenzaA__AGW00116

SEQ ID NO: 145890 - RNA, 1410 nt, Artificial Sequence; identical to SEQ ID NO: 145887
  derived and/or modified sequence opt3 from neuraminidase__InfluenzaA__AGW00128

SEQ ID NO: 145891 - RNA, 1410 nt, Artificial Sequence; identical to SEQ ID NO: 144162
  derived and/or modified sequence opt3 from neuraminidase__InfluenzaA__AGW00140

SEQ ID NO: 145892 - RNA, 1410 nt, Artificial Sequence; identical to SEQ ID NO: 144162
  derived and/or modified sequence opt3 from neuraminidase__InfluenzaA__AGW00152

SEQ ID NO: 145893 - RNA, 1410 nt, Artificial Sequence; identical to SEQ ID NO: 145887
  derived and/or modified sequence opt3 from neuraminidase__InfluenzaA__AGW00164

SEQ ID NO: 145894 - RNA, 1410 nt, Artificial Sequence; identical to SEQ ID NO: 144162
  derived and/or modified sequence opt3 from neuraminidase__InfluenzaA__AGW00176

SEQ ID NO: 145895 - RNA, 1410 nt, Artificial Sequence; identical to SEQ ID NO: 144162
  derived and/or modified sequence opt3 from neuraminidase__InfluenzaA__AGW00188

SEQ ID NO: 145896 - RNA, 1410 nt, Artificial Sequence; identical to SEQ ID NO: 144162
  derived and/or modified sequence opt3 from neuraminidase__InfluenzaA__AGW00712

SEQ ID NO: 145897 - RNA, 1410 nt, Artificial Sequence; identical to SEQ ID NO: 144162
  derived and/or modified sequence opt3 from neuraminidase__InfluenzaA__AGW00724

SEQ ID NO: 145898 - RNA, 1410 nt, Artificial Sequence
  derived and/or modified sequence opt3 from neuraminidase__InfluenzaA__AGW00736
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagaugaugcugugugaaccgacuauaaucgagagaaauauuaccgaaaucguuuauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucugggugacccgcgagccuuauguaucgugcgacccagauaaguguuaccaauucgcgcuggggcagggaacgacucuaaauaacgugcauucaaauaacaccguccgagaccguacacccuauagaacucuccugaugaaugaacuuggcgugccuuuucaccuggguaccaagcagguuugcauugcuuggagcaguuccucuugucaugaugggaaagccugguugcacgugugcaucacaggagacgauaagaacgcaaccgccagcuucaucuacaauggcaggcucgucgacuccgugguaucauggaguaaagagauucugcggacgcaggaaagcgaguguguuugcauaaacggcacuuguacaguggucaugaccgaugggucugcuuccggaaaggcagacacuaaaauccuguuuauugaggaagguaagaucgugcauacaucaacccucagcggcagugcccaacacguggaggaaugcucuugcuauccacgcuacccgggggucagauguguuugcagggauaacuggaagggauccaaucggcccauaguggacauuaacaucaaagaucacagcaucguaucgucuuacguguguuccggcuuagucggugacacgccucgcaagaaugacucaaguagcuccucucauugccuggauccaaacaaugaggaagggggacacggcgugaaaggcugggcuuucgacgaugggaacgacguuuggaugggacgaaccauuaaugagacaagcagacuugguuaugagacuuuuaaggugaucgaaggcuggucagaucccaaaaguaaguugcagauuaacaggcaggucauaguggaccguggggaucgguccggauacagcggcaucuucucuguagaggguaaaucauguauuaaucgcugcuuuuauguugaacugaucagagggaggaaggaggaaaccgaggugcuauggacaaguaacagcaucgucguguucuguggcacuuccggaaccuacggcacagggucuuggccugacggagccgaucucaaucugaugccaauuuga

SEQ ID NO: 145899 - RNA, 1410 nt, Artificial Sequence
  derived and/or modified sequence opt3 from neuraminidase__InfluenzaA__AGW00748
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacaugcauucaaauaacaccguccgagaccguacacccuauagaacucuccugaugaaugaacuuggcgugccuuuucaccuggguaccaagcagguuugcauugcuuggagcaguuccucuugucaugaugggaaagccugguugcacgugugcaucacaggagacgauaagaacgcaaccgccagcuucaucuacaauggcaggcucgucgacuccgugguaucauggaguaaagagauucugcggacgcaggaaagcgaguguguuugcauaaacggcacuuguacaguggucaugaccgaugggucugcuuccggaaaggcagacacuaaaauccuguuuauugaggaagguaagaucgugcauacaucaacccucagcggcagugcccaacacguggaggaaugcucuugcuauccacgcuacccgggggucagauguguuugcagggauaacuggaagggauccaaucggcccauaguggacauuaacaucaaagaucacagcaucguaucgucuuacguguguuccggcuuagucggugacacgccucgcaagaaugacucaaguagcuccucucauugccuggauccaaacaaugaggaagggggacacggcgugaaaggcugggcuuucgacgaugggaacgacguuuggaugggacgaaccauuaaugagacaagcagacuugguuaugagacuuuuaaggugaucgaaggcuggucaaaccccaaaaguaaguugcagauuaauaggcaggucauaguggaucguggggaccgguccggauacagcggcaucuucucuguagaggguaaaucauguauuaaccgcugcuuuuauguugaacugaucagagggaggaaggaggaaaccgaggugcuauggacaaguaauagcaucgucguguucuguggcacuuccggaaccuacggcacagggucuuggccugauggagccgaccucaaccugaugccaauuuga

SEQ ID NO: 145900 - RNA, 1410 nt, Artificial Sequence
  derived and/or modified sequence opt3 from neuraminidase__InfluenzaA__AGW00760
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcaagugaauaggcagguaauuguugaucguggggaccgguccggauacagcggcauauucucuguggaggguaaaucauguaucaaccgcugcuuuuaugucgaacugauuagagggaggaaggaggaaaccgaggugcuauggacaaguaauagcaucgucguguucuguggcacuuccggaaccuacggcacagggucuuggccugauggagccgaccucaaccugaugccaaucuga

SEQ ID NO: 145901 - RNA, 1410 nt, Artificial Sequence; identical to SEQ ID NO: 144162
  derived and/or modified sequence opt3 from neuraminidase__InfluenzaA__AGW00784

SEQ ID NO: 145902 - RNA, 1410 nt, Artificial Sequence; identical to SEQ ID NO: 144162
  derived and/or modified sequence opt3 from neuraminidase__InfluenzaA__AGW00796

SEQ ID NO: 145903 - RNA, 1410 nt, Artificial Sequence; identical to SEQ ID NO: 145887
  derived and/or modified sequence opt3 from neuraminidase__InfluenzaA__AGW00808

SEQ ID NO: 145904 - RNA, 1410 nt, Artificial Sequence; identical to SEQ ID NO: 145391
  derived and/or modified sequence opt3 from neuraminidase__InfluenzaA__AGW00820

SEQ ID NO: 145905 - RNA, 1410 nt, Artificial Sequence; identical to SEQ ID NO: 144162
  derived and/or modified sequence opt3 from neuraminidase__InfluenzaA__AGW00832

SEQ ID NO: 145906 - RNA, 1410 nt, Artificial Sequence
  derived and/or modified sequence opt3 from neuraminidase__InfluenzaA__AGW00844
augaaccccaaucagaagaucauuaccauaggcagcgugucccugacaaucucuacuauuugcuucuuuaugcagaucgccauucucaucacgaccgucacacuucacuucaaacaguacgaguuuaacuucccuccaaauaaccagguuaugcugugugaaccgacuauaaucgagagaaauauuaccgaaaucguguauuugacaaacaccacuauugagaaggaaaucugccccaaaccugcugaguacaggaauuggucaaagccacagugugggauaacaggauuugcacccuucaguaaagacaacagcauucgguuauccgccgguggcgauaucuggguaacccgcgagccuuaugugucuugcgacccagauaaguguuaccaauuugcgcuggggcagggaacgacucuaaauaacguccauucgaauaacaccgugcgagaccguacacccuauagaacucuccugaugaaugaacuuggcguuccuuuccaccuggguaccaaacaggugugcauugcuuggucaagcaguuccugucaugaugggaaggccugguugcacgucugcaucacaggagacgauaagaacgcaaccgccucuuuuaucuacaauggcaggcucguggacagcguaguuuccuggucaaaagagauucugcggacgcaggaaagugagugugugugcauaaacggcacuuguacagucgugaugaccgaugggagcgcuucuggaaaggcagacacuaaaauccuguucauugaggaagguaagaucgugcauacauccacccucucaggcagcgcccaacacgucgaggaaugcaguugcuauccacgcuacccggggguuagaugugugugcagggauaacuggaagggaucuaaucggcccauaguagacauuaacaucaaagaucacuccaucgugagcucguacgucuguucuggcuuagugggugacacgccucgcaagaaugacuccucaaguagcucccauugccuggauccaaacaaugaggaagggggacacggcguuaaaggcugggcuuuugacgaugggaacgacguguggaugggacgaaccauuaaugagacaucuagacuugguuaugagacuuucaaggucaucgaaggcuggagcaaccccaaaucaaaguugcagauuaauaggcaagugauaguagaucguggggaccggaguggauacuccggcaucuuuagcguugaggguaaaucuuguauuaaccgcugcuucuauguggaacugaucagagggaggaaggaggaaaccgagguccuauggacaucaaauaguaucguggucuucuguggcacuagcggaaccuacggcacaggguccuggccugauggagccgaccucaaccugaugccaauuuga

SEQ ID NO: 145907 - RNA, 1410 nt, Artificial Sequence; identical to SEQ ID NO: 145899
  derived and/or modified sequence opt3 from neuraminidase__InfluenzaA__AGW00868

SEQ ID NO: 145908 - RNA, 1410 nt, Artificial Sequence
  derived and/or modified sequence opt3 from neuraminidase__InfluenzaA__AGW00880
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacguaugggugacccgcgagccuuaugucucgugcgauccagacaaguguuaccaauucgcgcugggccaggggacgacucuaaauaacgugcauucaaauaacaccguucgagaucguacacccuauagaacucuccugaugaaugaacuuggagugccuuuucaccugggcaccaagcaggucugcaucgcuuggagcaguuccucuugucaugacgguaaagccugguugcacgugugcauuacaggggaugacaagaacgcaaccgccagcuucaucuacaauggaaaacucguagauuccguugugucauggaguaaggagauccugaggacgcaggaaagcgagugugucugcauuaacggcacuuguacaguggugaugaccgacggcucugcuuccgggaaagcagauacuaagauacuguuuaucgaggaaggaaagauuguccauacaucaacccucagcgguagugcccaacacguugaggaaugcucuugcuauccacgguacccggacgugcgcuguguaugcagagauaacuggaaaggcuccaauaggcccaucguggacauaaacauuaaggaccacagcaucgucucgcgguacguguguucuggguuaguuggagauacgccucgcaaaaaugacuccucaaguagcucccauugccuggauccaaacaaugaggaaggcggucacggggugaagggaugggcuuucgacgauggcaacgacgucuggaugggccgaaccaucaaugagacaucuagacuuggguaugagacuuuuaaagugauugaaggauggagcaaccccaagucaaaauugcagaucaauaggcagguaauuguugaucggggugaccguaguggcuacuccgggauauucagcguggagggaaagucuuguaucaaccgcugcuuuuaugucgaacugauuagaggcaggaaggaggaaaccgaggugcuauggacaucaaauaguaucgucguguucugugguacuagcgggaccuacggcacaggauccuggccugauggcgccgaccucaaccugaugccaaucuga

SEQ ID NO: 145909 - RNA, 1410 nt, Artificial Sequence
  derived and/or modified sequence opt3 from neuraminidase__InfluenzaA__AGW00892
augaaccccaaucagaagaucauuaccauaggcagcgugucccugacaaucucuacuauuugcuucuuuaugcagaucgccauucucaucacgaccgucacacuucacuucaaacaguacgaguuuaacccuccaccgaauaaccagguuaugcugugugaacccacuauaaucgagagaaauauuaccgaaaucguguauuugacaaacaccacuauugagaaggaaaucugcccuaaaccagcugaguacaggaauuggucaaagccccagugugggauaacaggauucgcaccuuuuaguaaagacaacagcauucgguuauccgccgguggcgauaucuggguaacccgcgagccauaugugucuugcgaccccgauaaguguuaccaauucgcgcuggggcagggaacgacucuaaauaacguccauucgaauaacaccgugcgagaccguacaccuuauagaacucuccugaugaaugaacuuggcguuccauuucaccuggguaccaaacaggugugcauugcuuggucaagcaguuccugucaugaugggaaggccugguugcacgucugcaucacaggagacgauaagaacgcaaccgccucuuucaucuacaauggcaggcucguggacagcguaguuuccuggucaaaagagauucugcggacgcaggaaagugagugugugugcauaaacggcacuuguacagucgugaugaccgaugggagcgcuucuggaaaggcagacacuaaaauccuguuuauugaggaagguaagaucgugcauacauccacccucucaggcagcgcccaacacgucgaggaaugcaguugcuauccgcgcuaccccgggguuagaugugugugcagggauaacuggaagggaucuaaucggccuauaguagacauuaacaucaaagaucacuccaucgugagcucguacgucuguucuggcuuagugggugacacgccacgcaagaaugacuccucaaguagcucccauugccuggaucccaacaaugaggaagggggacacggcguuaaaggcugggcuuucgacgaugggaacgacguguggaugggacgaaccauuaaugagacaucuagacuugguuaugagacuuuuaaggucaucgaaggcuggagcaacccuaaaucaaaguugcagaugaauaggcaagugauuguagaucguggggaccggaguggauacuccggcauauucagcguugaggguaaaucuuguaucaaccgcugcuuuuauguggaacugauuagagggaggaaggaggaaaccgagguccuauggacaucaaauaguaucguggucuucuguggcacuagcggaaccuacggcacaggguccuggccagauggagccgaccucaaccugaugcccaucuga

SEQ ID NO: 145910 - RNA, 1410 nt, Artificial Sequence
  derived and/or modified sequence opt3 from neuraminidase__InfluenzaA__AGW00904
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgggccagacaaguguuaccaauucgcgcugggacagggcacgacucuaaauaacaugcauucaaauaacaccguccgagaucguacacccuauagaacucuccugaugaaugaacuuggugugccuuuucaccuggggaccaagcagguuugcauugcuuggagcaguuccucuugucaugacggaaaagccugguugcacgugugcaucacaggcgaugacaagaacgcaaccgccagcuucaucuacaauggcaggcucgucgauuccgugguaucauggaguaaagagauucugcggacgcaggaaagcgaguguguuugcauaaacgggacuuguacaguggucaugaccgacggaucugcuuccgguaaggcagauacuaaaauccuguuuauugaggaaggcaagaucgugcauacaucaacccucagcgggagugcccaacacguggaggaaugcucuugcuauccacgcuacccgggagucagauguguuugcagggacaacuggaagggcuccaaucggcccauaguggauauuaacaucaaagaccacagcaucguaucgucuuacguguguuccgguuuagucggggauacgccucgcaagaaugacucaaguagcuccucucauugccuggacccaaacaaugaggaaggaggccacggcgugaaagggugggcuuucgaugacggaaacgauguuuggaugggucgaaccauuaaugagacaagcagacuuggcuaugagacuuuuaaggugaucgaaggguggucaaaccccaaaaguaaguugcagauuaauaggcaggucauaguggaccggggagaucguuccggcuacagcgguaucuucucuguagaggggaaaucauguauuaaccgcugcuuuuauguugaacugaucagaggcaggaaggaggaaaccgaggugcuauggacaaguaauagcaucgucguguucuguggaacuuccggcaccuacgggacaggaucuuggccugacggugccgaucucaaccugaugccaauuuga

SEQ ID NO: 145911 - RNA, 1410 nt, Artificial Sequence
  derived and/or modified sequence opt3 from neuraminidase__InfluenzaA__AGW00916
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacaugcauucaaauaacaccgucugcgaccgaacacccuaucguacucuccugaugaaugaacuuggcgugccuuuucaccuggguaccaagcagguuuguauugcuuggagcaguuccucuugccaugaugggaaagccugguugcacguguguaucacaggagacgauaagaacgcaaccgccagcuucaucuacaauggcagacucgucgacuccgugguaucauggaguaaagagauucugaggacgcaggaaagcgagugcguuuguauaaacggcacuugcacaguggucaugaccgaugggucugcuuccggaaaggcagacacuaaaauccuguuuauugaggaagguaagaucgugcauacaucaacccucagcggcagugcccaacacguggaggaaugcucuuguuauccacgguacccggggguccgcugcguuuguagagauaacuggaagggauccaauaggcccauaguggacauuaacaucaaagaucacagcaucguaucgucuuacgugugcuccggcuuagucggugacacgccucggaagaaugacucaaguagcuccucucauugucuggauccaaacaaugaggaagggggacacggcgugaaaggcugggcuuucgacgaugggaacgacguuuggaugggacgcaccauuaaugagacaagccgacuugguuaugagacuuuuaaggugaucgaaggcuggucaaaccccaaaaguaaguugcagauuaauagacaggucauaguggauaggggagaccgguccggguacagcggcaucuucucuguagaggguaaaucaugcauuaaccguuguuuuuauguugaacugauccgcgggagaaaggaggaaaccgaggugcuauggacaaguaauagcaucgucguguucugcggcacuuccggaaccuacggcacagggucuuggccugauggagccgaccucaaccugaugccaauuuga

SEQ ID NO: 145912 - RNA, 1410 nt, Artificial Sequence; identical to SEQ ID NO: 145887
  derived and/or modified sequence opt3 from neuraminidase__InfluenzaA__AGW00934

SEQ ID NO: 145913 - RNA, 1410 nt, Artificial Sequence
  derived and/or modified sequence opt3 from neuraminidase__InfluenzaA__AGW01247
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaagacucaaguagcuccucucauugccuggauccaaauaacgaggaagggggacacggcguuaagggcugggcuuucgacgaugggaaugacguguggaugggacgaaccauuaacgagacaagcagacuugguuaugagacuuuuaaagucaucgaaggcuggucaaaucccaagaguaaauugcagauuaacaggcaagugauaguagaucguggggaccgguccggauacagcggcaucuucucuguugaggguaagucauguauuaaucgcugcuuuuauguggaacugaucagagggaggaaggaggaaaccgagguccuauggacaaguaacagcaucguggucuucuguggcacuuccggaaccuacggcacagggucuuggccugauggagccgaccucaaucugaugccaauuuga

SEQ ID NO: 145914 - RNA, 1410 nt, Artificial Sequence; identical to SEQ ID NO: 144162
  derived and/or modified sequence opt3 from neuraminidase__InfluenzaA__AGW01259

SEQ ID NO: 145915 - RNA, 1410 nt, Artificial Sequence; identical to SEQ ID NO: 145899
  derived and/or modified sequence opt3 from neuraminidase__InfluenzaA__AGW01298

SEQ ID NO: 145916 - RNA, 1410 nt, Artificial Sequence; identical to SEQ ID NO: 145391
  derived and/or modified sequence opt3 from neuraminidase__InfluenzaA__AGW01322

SEQ ID NO: 145917 - RNA, 1410 nt, Artificial Sequence
  derived and/or modified sequence opt3 from neuraminidase__InfluenzaA__AGW01334
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcagauuaauaggcaagugauaguagaucguggggaccgguccggauacagcggcaucuucucuguugaggguaaaucauguauuaaccgcugcuuuuauguggaacugaucagagggaggaaggaggaagccgagguccuauggaccaguaauagcaucguggucuucuguggcacauccggaacuuacggcaccgggucuuggccugauggagcggaccucaaccugaugccaauuuga

SEQ ID NO: 145918 - RNA, 1410 nt, Artificial Sequence; identical to SEQ ID NO: 144162
  derived and/or modified sequence opt3 from neuraminidase__InfluenzaA__AGW01346

SEQ ID NO: 145919 - RNA, 1410 nt, Artificial Sequence
  derived and/or modified sequence opt3 from neuraminidase__InfluenzaA__AGW01358
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccuacagaguacaggaauuggaguaagccacagugugggauaaccggauucgcucccuuuagcaaagacaacuccauucgguuaucugcagggggcgauaucuggguaacgcgcgagccuuaugugucgugcgacccagauaaguguuaccaauucgcccuggggcagggaacuacccuaaauaacguccauucaaauaacacagugcgagaccguacucccuauagaacccuccugaugaaugaacuuggcguuccuuuucaccuggguacaaaacaggugugcauugcguggagcaguuccucuugucaugaugggaaggcuugguugcacgucugcaucaccggagacgauaagaacgccacggcaaguuucaucuacaauggcaggcucguggacuccguaguuucauggaguaaagagauucugcggacucaggaaagcgagugugugugcauaaacggcacauguaccgucgugaugacugaugggucugccuccggaaaggcugacacaaaaauccuguuuauugaggaagguaagaucgugcauaccucaacgcucagcggcagugcacaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacaccccucgcaagaaugacucaaguagcuccucucauugccuggauccaaacaaugaggaagggggacacggcguuaaaggcugggccuucgacgaugggaacgacguguggaugggacgaacaauuaaugagacuagcagacuugguuaugagaccuuuaaggucaucgaaggcuggucaaaccccaaaaguaaguugcagauuaauaggcaagugauaguagaucggggugaccguuccggauacagcggcaucuucucuguugaggguaaaucauguauuaaccgcugcuuuuauguggaacugaucagagggaggaaggaggaaacagagguccuauggacuagcaauagcaucguggucuucuguggcaccuccggaacauacggcaccgggucuuggccugauggagcugaccucaaccugaugccaauuuga

SEQ ID NO: 145920 - RNA, 1410 nt, Artificial Sequence; identical to SEQ ID NO: 144162
  derived and/or modified sequence opt3 from neuraminidase__InfluenzaA__AGW01370

SEQ ID NO: 145921 - RNA, 1410 nt, Artificial Sequence; identical to SEQ ID NO: 144162
  derived and/or modified sequence opt3 from neuraminidase__InfluenzaA__AGW01382

SEQ ID NO: 145922 - RNA, 1410 nt, Artificial Sequence
  derived and/or modified sequence opt3 from neuraminidase__InfluenzaA__AGW01394
augaaccccaaucagaagaucauuaccauaggcagcgugucccugacaaucucuacuauuugcuucuuuaugcaaaucgccauucucaucacgaccgucacacuucacuucaaacaguacgaguuugacucaccuccaaacaaucagguuaugcugugugaaccgacuauaaucgagagaaacauuaccgaaaucguguauuugacaaauaccacuauugagaaggaaaucugccccaaaccugcugaguacaggaacuggaguaagccacagugugggauaacaggauucgcacccuuuagcaaagauaauuccauucgguuaucugccgguggcgacaucuggguaacccgcgagccuuaugugucgugcgauccagacaaguguuaccaauucgcgcuggggcagggaacgacucuaaacaauguccauucaaacaauaccgugcgagaucguacacccuauagaacucuccugaugaacgaacuuggcguuccuuuucaccuggguaccaaacaggugugcauugcuuggagcaguuccucuugucaugacgggaaggccugguugcacgucugcaucacaggagaugacaagaaugcaaccgccagcuucaucuacaacggcaggcucguggauuccauuguaucauggaguaaagacauacugcggacgcaggagagcgaauguguuugcaucaauggcacuuguacaguggucaugaccgaugggucugcuuccggaaaggcagacacuaaaauucuguuuaucgaggaggguaagauagugcauacaucaacccucagcggcagugcccaacacguggaagagugcucuugcuauccacgcuacccgggggucagauguguuugcagggauaacuggaagggauccaaccggcccauuguggacaucaauaucaaagaccacagcauuguaucgucuuacguguguuccggcuuagucggugauacgccucgcaagaacgacucaaguagcuccucucauugccuggauccaaauaacgaagaagggggacacggcgugaaaggcugggcuuucgacgaugggaaugacguuuggaugggacgaaccaucaacgagacaagcagacuugguuaugagacuuuuaaggugauugagggcuggucaaaucccaaaaguaaguugcagauaaacaggcaggucaucguggaucguggggaccgguccggauacagcggcauuuucucuguagaagguaaaucauguaucaaucgcugcuuuuauguugagcugaucagagggaggaaggaagagaccgaagugcuauggacaaguaacagcauugucguguucuguggcacuuccggaaccuacggcacagggucuuggccugauggagccgaccucaaucugaugccaauauga

SEQ ID NO: 145923 - RNA, 1410 nt, Artificial Sequence
  derived and/or modified sequence opt3 from neuraminidase__InfluenzaA__AGW01406
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacaugcauucaaauaacaccguccgagaucguacacccuauagaacucuccugaugaaugaacuuggagugccuuuucaccugggcaccaagcagguuugcauugcuuggagcaguuccucuugucaugacgguaaagccugguugcacgugugcaucacaggggaugacaagaacgcaaccgccagcuucaucuacaauggaaggcucgucgauuccgugguaucauggaguaaagagauucugcggacgcaggaaagcgaguguguuugcauaaacggcacuuguacaguggucaucaccgacggcucugcuuccgggaaggcagauacuaaaauucuguuuaucgaggaaggaaagauagugcauacaucaacccucagcgguagugcccaacacguggaggaaugcucuugcuauccacgcuacccgggcgucagauguguuugcagggacaacuggaagggguccaaucggcccauuguggauaucaacaucaaagaccacagcauuguaucgucuuacguguguuccggauuagucggcgacacgccucgcaagaaugauucaaguagcuccucucauugccuggacccaaacaaugaggaaggugggcacggagugaaaggcugggcuuucgaugacggcaacgauguuuggauggggcgaaccaucaaugagacaagcagacuuggauaugagacuuuuaaggugauugaagguuggucaaaccccaaaaguaaguugcagauaaauaggcaggucaucguggaccggggcgaucguuccggguacagcggaauuuucucuguagagggcaaaucauguaucaaccgcugcuuuuauguugaacugaucagagguaggaaggaggaaaccgaggugcuauggacaaguaauagcauugucguguucugugggacuuccggcaccuacggaacaggcucuuggccugacggggccgaucucaaccugaugccaauauga

SEQ ID NO: 145924 - RNA, 1410 nt, Artificial Sequence
  derived and/or modified sequence opt3 from neuraminidase__InfluenzaA__AGW01418
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacaugcauucaaauaacaccguccgagaccguacacccuauagaacucuccugaugaaugaacuuggcgugccuuuucaccuggguaccaagcagguuugcauugcuuggagcaguuccucuugucaugaugggaaagccugguugcacgugugcaucacaggagacgauaagaacgcaaccgccagcuucaucuacaauggcaggcucgucgacuccgugguaucauggaguaaagagauucugcggacgcaggaaagcgaguguguuugcauaaacggcacuuguacaguggucaugaccgaugggucugcuuccggaaaggcagacacuaaaauccuguuuauugaggaagguaagaucgugcauacaucaacccucagcggcagugcccaacacguggaggaaugcucuugcuauccacgcuacccgggggucagauguguuugcagggauaacuggaagggauccaaucggcccauaguggacauuaacaucaaagaucacagcaucguaucgucuuacguguguuccggcuuagucggugacacgccucgcaagaaugacucaaguagcuccucucauugccuggauccaaacaaugaggaagggggacacggcgugaaaggcugggcuuucgacgaugggaacgacguuuggaugggacgaaccauuaaugagacaagcagacuugguuaugagacuuuuaaggugaucgaaggcuggucaaaccccaaaaguaaguugcagauuaauaggcaggucauaguggaucguggggaccgguccggauacagcggcaucuucucuguagaggguaaaucauguauuaaccgcugcuuuuauguugaacugaucagagggaggaaggaggaaaccggcgugcuauggacaaguaauagcaucgucguguucuguggaacuuccggcaccuacgggacaggaucuuggccugauggugccgaccucaaccugaugccaauuuga

SEQ ID NO: 145925 - RNA, 1410 nt, Artificial Sequence; identical to SEQ ID NO: 144162
  derived and/or modified sequence opt3 from neuraminidase__InfluenzaA__AGW01430

SEQ ID NO: 145926 - RNA, 1410 nt, Artificial Sequence; identical to SEQ ID NO: 144162
  derived and/or modified sequence opt3 from neuraminidase__InfluenzaA__AGW01442

SEQ ID NO: 145927 - RNA, 1410 nt, Artificial Sequence; identical to SEQ ID NO: 144162
  derived and/or modified sequence opt3 from neuraminidase__InfluenzaA__AGW01454

SEQ ID NO: 145928 - RNA, 1410 nt, Artificial Sequence; identical to SEQ ID NO: 145887
  derived and/or modified sequence opt3 from neuraminidase__InfluenzaA__AGW01466

SEQ ID NO: 145929 - RNA, 1410 nt, Artificial Sequence; identical to SEQ ID NO: 144162
  derived and/or modified sequence opt3 from neuraminidase__InfluenzaA__AGW01478

SEQ ID NO: 145930 - RNA, 1410 nt, Artificial Sequence
  derived and/or modified sequence opt3 from neuraminidase__InfluenzaA__AGW01490
augaaccccaaucagaagaucauuaccauaagcuccgugucucugacaaucucaacuauuugcuucuuuaugcagaucgccauucucaucacgaccgucacacuucacuucaaacaguacgaguuuaacaguccuccaaauaaccagguuaugcugugugaaccgacuauaaucgagagaaauauuaccgaaaucguguauuugacaaacaccacuauugagaaggaaaucugccccaaaccugcugaguacaggaauuggagcaagccacaguguggcauaacaggguucgcacccuuuuccaaagacaacucuauucgguuaucggccggaggugauaucuggguaacccgcgagccuuaugugucaugcgacccagauaaguguuaccaauucgcgcugggccaggggacgacucuaaauaacguccauagcaauaacaccgugcgagaccguacacccuauagaacucuccugaugaaugaacuuggaguuccuuuucaccugggcaccaaacaggugugcauugcuuggaguuccucuagcugucaugaugguaaggccugguugcacgucugcaucacaggggacgauaagaacgcaaccgccuccuucaucuacaauggaaggcucguggacucaguaguuaguuggagcaaagagauucugcggacgcaggaaucugagugugugugcauaaacggcacuuguacagucgugaugaccgauggcuccgcuucagggaaggcagacacuaaaauccuguuuauugaggaaggaaagaucgugcauacaagcacccucagugguucugcccaacacgucgaggaaugcuccugcuauccacgcuacccgggcguuagaugugugugcagggauaacuggaaggggagcaaucggcccauaguagacauuaacaucaaagaucacucgaucgugucuuccuacgucuguucaggauuagugggcgacacgccucgcaagaaugacaguagcuccucuagccauugccuggauccaaacaaugaggaaggugggcacggaguuaaaggcugggcuuucgacgauggcaacgacguguggauggggcgaaccauuaaugagacaucaagacuuggauaugagacuuuuaaggucaucgaagguuggaguaacuccaaaagcaaguugcagauuaauaggcaagugauaguagaucggggcgaccguucuggguacucaggaaucuucaguguugagggcaaaagcuguauuaaccgcugcuuuuauguggaacugaucagagguaggaaggaggaaaccgagguccuauggacauccaauucuaucguggucuucugugggacuucgggcaccuacggaacaggcagcuggcccgauggggccgaccucaaccugaugccuauuuga

SEQ ID NO: 145931 - RNA, 1410 nt, Artificial Sequence; identical to SEQ ID NO: 144162
  derived and/or modified sequence opt3 from neuraminidase__InfluenzaA__AGW01538

SEQ ID NO: 145932 - RNA, 1410 nt, Artificial Sequence; identical to SEQ ID NO: 145887
  derived and/or modified sequence opt3 from neuraminidase__InfluenzaA__AGW01562

SEQ ID NO: 145933 - RNA, 1410 nt, Artificial Sequence; identical to SEQ ID NO: 144162
  derived and/or modified sequence opt3 from neuraminidase__InfluenzaA__AGW01574

SEQ ID NO: 145934 - RNA, 1410 nt, Artificial Sequence; identical to SEQ ID NO: 144162
  derived and/or modified sequence opt3 from neuraminidase__InfluenzaA__AGW01586

SEQ ID NO: 145935 - RNA, 1410 nt, Artificial Sequence; identical to SEQ ID NO: 144162
  derived and/or modified sequence opt3 from neuraminidase__InfluenzaA__AGW01598

SEQ ID NO: 145936 - RNA, 1410 nt, Artificial Sequence; identical to SEQ ID NO: 145887
  derived and/or modified sequence opt3 from neuraminidase__InfluenzaA__AGW01610

SEQ ID NO: 145937 - RNA, 1410 nt, Artificial Sequence; identical to SEQ ID NO: 144162
  derived and/or modified sequence opt3 from neuraminidase__InfluenzaA__AGW01622

SEQ ID NO: 145938 - RNA, 1410 nt, Artificial Sequence; identical to SEQ ID NO: 144162
  derived and/or modified sequence opt3 from neuraminidase__InfluenzaA__AGW01634

SEQ ID NO: 145939 - RNA, 1410 nt, Artificial Sequence
  derived and/or modified sequence opt3 from neuraminidase__InfluenzaA__AGW01646
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauagauggcacuuguacagucgugaugaccgacgggucugcuuccggaaaggcagauacuaaaauccuguuuauugaggaagguaagaucgugcauacaucaacccucagcggcagugcccaacacgucgaggaaugcucuugcuauccacgcuacccggggguuagaugugugugcagggacaacuggaagggauccaaccggcccauaguagauauuaauaucaaagaccacagcaucgugucgucuuacgucuguuccggcuuagugggugacacgccucgcaagaacgauucaaguagcuccucucauugccuggacccaaauaacgaggaagggggacacggcguuaaaggcugggcuuucgaugacgggaaugauguguggaugggacgaaccauuaacgagacaagcagacuugguuaugagacuuuuaaggucaucgaaggcuggucaaaucccaaaaguaaguugcagauuaacaggcaagugauaguagaccguggggaucgguccggauacagcggcaucuucucuguugaggguaaaucauguauuaaucgcugcuuuuauguggaacugaucagagggaggaaggaggaaaccgagguccuauggacaaguaacagcaucguggucuucuguggcacuuccggaaccuacggcacagggucuuggccugacggagccgaucucaaucugaugccaauuuga

SEQ ID NO: 145940 - RNA, 1410 nt, Artificial Sequence; identical to SEQ ID NO: 144162
  derived and/or modified sequence opt3 from neuraminidase__InfluenzaA__AGW01670

SEQ ID NO: 145941 - RNA, 1410 nt, Artificial Sequence; identical to SEQ ID NO: 144162
  derived and/or modified sequence opt3 from neuraminidase__InfluenzaA__AGW01682

SEQ ID NO: 145942 - RNA, 1410 nt, Artificial Sequence; identical to SEQ ID NO: 145899
  derived and/or modified sequence opt3 from neuraminidase__InfluenzaA__AGW01704

SEQ ID NO: 145943 - RNA, 1410 nt, Artificial Sequence
  derived and/or modified sequence opt3 from neuraminidase__InfluenzaA__AGW01716
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacaugcauucaaauaacaccguccgagaccguacacccuauagaacucuccugaugaaugaacuuggcgugccuuuucaccuggguaccaagcagguuugcauugcuuggagcaguuccucuugucaugaugggaaagccugguugcacgugugcaucacaggagacgauaagaacgcaaccgccagcuucaucuacaauggcaggcucgucgacuccgugguaucauggaguaaagagauucugcggacgcaggaaagcgaguguguuugcauaaacggcacuuguacaguggucaugaccgaugggucugcuuccggaaaggcagacacuaaaauccuguuuauugaggaagguaagaucgugcauacaucaacccucagcggcagugcccaacacguggaggaaugcucuugcuauccacgcuacccgggggucagauguguuugcagggauaacuggaagggauccaaucggcccauaguggacauuaacaucaaagaucacagcaucguaucgucuuacguguguuccggcuuagucggugacacgccucgcaagaaugacucaaguagcuccucucauugccuggauccaaacaaugaggaagggggacacggcgugaaaggcugggcuuucgacgaugggaacgacguuuggaugggacgaaccauuaaugagacaagcagacuugguuaugagacuuuuaaggugaucgaaggcuggucaaaccccaaaaguaaguugcagauuaauaggcaggucauaguggaucguggggaccgguccggauacagcggcaucuucucuguagagggucgcucauguauuaacagaugcuuuuauguugaacugaucagggggcggaaagaggaaaccgaggugcuauggacaaguaauagcaucgucguguucuguggcacuuccggaaccuacggcacagggucuuggccugauggagccgaccucaaccugaugccaauuuga

SEQ ID NO: 145944 - RNA, 1410 nt, Artificial Sequence
  derived and/or modified sequence opt3 from neuraminidase__InfluenzaA__AGW01728
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacaugcauucaaauaacaccguccgagaccguacacccuauagaacucuccugaugaaugaacuuggcgugccuuuucaccuggguaccaagcagguuugcauugcuuggagcaguuccucuugucaugaugggaaagccugguugcacgugugcaucacaggagacgauaagaacgcaaccgccagcuucaucuacaauggcaggcucgucgacuccgugguaucauggaguaaagagauucugcggacgcaggaaagcgaguguguuugcauaaacggcacuuguacaguggucaugaccgaugggucugcuuccggaaaggcagacacuaaaauccuguuuauugaggaagguaagaucgugcauacaucaacccucagcggcagugcccaacacguggaggaaugcucuugcuauccacgcuacccgggggucagauguguuugcagggauaacuggaagggauccaaucggcccauaguggacauuaacaucaaagaucacagcaucguaucgucuuacguguguuccggcuuagucggugacacgccucgcaagaaugacucaaguagcuccucucauugccuggauccaaacaaugaggaagggggacacggcgugaaaggcugggcuuucgacgaugggaacgacguuuggaugggacgaaccauuaaugagacaagcagacuugguuaugagacuuuuaaggugaucgaaggcuggucaaaccccaaaaguaaguugcagauuaauaggcaggucauaguggaucguggggaccgguccggauacagcggcaucuucucuguagaggguaaaucauguauuaaccgcugcuuuuauguugaacugaucagagggaggaaggaggaaaccgaggugcuauggacaaguaauagcgucguggucuucuguggcacuuccggaaccuacggcacagggucuuggccugauggagccgaccucaaccugaugccaaucuga

SEQ ID NO: 145945 - RNA, 1410 nt, Artificial Sequence; identical to SEQ ID NO: 144162
  derived and/or modified sequence opt3 from neuraminidase__InfluenzaA__AGW01740

SEQ ID NO: 145946 - RNA, 1410 nt, Artificial Sequence
  derived and/or modified sequence opt3 from neuraminidase__InfluenzaA__AGW01752
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucggcggguggucaaaccccaaaaguaaguugcagauuaauaggcaagugauaguagaucggggagaccguuccggcuacagcgguaucuucucuguugaagggaaaucauguauuaaccgcugcuuuuauguggagcugaucagaggcaggaaggaagagaccgaaguccuauggacaaguaauagcaucguggucuucuguggaacuuccggcaccuacgggacaggaucuuggccugauggugccgaccucaaccugaugccaauuuga

SEQ ID NO: 145947 - RNA, 1410 nt, Artificial Sequence; identical to SEQ ID NO: 144162
  derived and/or modified sequence opt3 from neuraminidase__InfluenzaA__AGW01764

SEQ ID NO: 145948 - RNA, 1410 nt, Artificial Sequence; identical to SEQ ID NO: 145899
  derived and/or modified sequence opt3 from neuraminidase__InfluenzaA__AGW01776

SEQ ID NO: 145949 - RNA, 1410 nt, Artificial Sequence; identical to SEQ ID NO: 145887
  derived and/or modified sequence opt3 from neuraminidase__InfluenzaA__AGW01788

SEQ ID NO: 145950 - RNA, 1410 nt, Artificial Sequence; identical to SEQ ID NO: 145899
  derived and/or modified sequence opt3 from neuraminidase__InfluenzaA__AGW01800

SEQ ID NO: 145951 - RNA, 1410 nt, Artificial Sequence; identical to SEQ ID NO: 145887
  derived and/or modified sequence opt3 from neuraminidase__InfluenzaA__AGW01812

SEQ ID NO: 145952 - RNA, 1410 nt, Artificial Sequence; identical to SEQ ID NO: 145887
  derived and/or modified sequence opt3 from neuraminidase__InfluenzaA__AGW01824

SEQ ID NO: 145953 - RNA, 1410 nt, Artificial Sequence; identical to SEQ ID NO: 145910
  derived and/or modified sequence opt3 from neuraminidase__InfluenzaA__AGW01848

SEQ ID NO: 145954 - RNA, 1410 nt, Artificial Sequence
  derived and/or modified sequence opt3 from neuraminidase__InfluenzaA__AGW01860
augaaccccaaucagaagaucauuaccauaggcagcgugucccugacaaucucuacuauuugcuucuuuaugcagaucgccauucucaucacgaccgucacacuucacuucaaacaguacgaguuuaacucacugccuaauaaccagguuauguugugugaaccaacuauaaucgagagaaauauuaccgaaaucguguauuuaacaaacaccacuauugagaaggaaaucugcccgaaacccgcugaguacaggaauuggaguaagccucagugugggauaacaggauucgcaccauuuagcaaagacaacuccauucggcugucugccgguggcgauaucuggguaacccgcgagcccuaugugucgugcgacccugauaaguguuaccaauucgcgcuagggcagggaacgacucucaauaacguccauucaaauaacaccgugcgagaccguacaccauauagaacucugcuuaugaaugaacugggcguucccuuucacuuggguaccaaacaggugugcauugcuuggagcaguuccucuugucaugaugggaaggccuggcuccacgucugcaucacaggagacgauaagaacgcaaccgccagcuucaucuacaauggcaggcugguggacuccguaguuucauggaguaaagagauucugcggacgcaggaaagcgagugugugugcauaaacggcacuuguacagucgugaugaccgaugggucugcuuccggaaaggcagacacuaaaauccucuuuauugaggaagguaagaucgugcauacaucaaccuuaagcggcagugcccaacacgucgaggaaugcucuugcuauccucgcuacccagggguuagaugugugugcagggauaacuggaagggauccaaucggccgauaguagacauuaacaucaaagaucacagcaucgugucgucuuacgucuguuccggccuggugggugacacgccccgcaagaaugacucaaguagcuccucucauugcuucgauccuaacaaugaggaagggggacacggcguuaaaggcugggcuuuugacgaugggaacgacguguggaugggacgaaccauuaaugagacaagcagacuugguuaugagacuuucaaggucaucggcggguggucaaacccaaaaaguaaguugcagauuaauaggcaagugauaguagaucggggagaccguuccggcuacagcgguaucuuuucuguugaagggaaaucauguauuaaccgcugcuucuauguggagcugaucagaggcaggaaggaagagaccgaaguccuauggacaaguaauagcaucauuguguucuguggaacuuccggcaccuacgggacaggaucuuggcccgauggugccgaccucaaccugaugccuauauga

SEQ ID NO: 145955 - RNA, 1410 nt, Artificial Sequence
  derived and/or modified sequence opt3 from neuraminidase__InfluenzaA__AGW01884
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccaagaucguguauuugacaaacaccacuauugaaaaagagaucugccccaagccugcugaauacaggaauuggaguaaaccacagugugggauaacaggauucgcacccuuuagcaaggacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugagcuuggcguuccuuuucaccuggguaccaaacaggugugcauugcuuggagcaguuccucuugucaugaugggaaggccugguugcacgucugcaucacaggagacgauaaaaacgcaaccgccagcuucaucuacaauggcaggcucguggacuccguaguuucauggaguaaggaaauucugcggacgcaggagagcgaaugugugugcauaaacggcacuuguacagucgugaugaccgaugggucugcuuccggaaaagcagacacuaagauccuguuuauugaggaggguaagaucgugcauacaucaacccucagcggcagugcccaacacgucgaagagugcucuugcuauccacgcuacccggggguuagaugugugugcagggauaacuggaaaggauccaaucggcccauaguagacauuaacaucaaggaucacagcaucgugucgucuuacgucuguuccggcuuagugggugacacgccucgcaaaaaugacucaaguagcuccucucauugccuggauccaaacaaugaagaagggggacacggcguuaagggcugggcuuucgacgaugggaacgacguguggaugggacgaaccauuaaugagacaagcagacuugguuaugagacuuuuaaagucaucgagggcuggucaaaccccaagaguaaauugcagauuaauaggcaagugauaguagaucguggggaccgguccggauacagcggcaucuucucuguugaagguaagucauguauuaaccgcugcuuuuauguggagcugaucagagggaggaaggaagagaccgaaguccuauggacaaguaauagcaucguggucuucuguggcacuuccggaaccuacggcacagggucuuggccugauggagccgaccucaaccugaugccaauuuga

SEQ ID NO: 145956 - RNA, 1410 nt, Artificial Sequence; identical to SEQ ID NO: 144162
  derived and/or modified sequence opt3 from neuraminidase__InfluenzaA__AGW01896

SEQ ID NO: 145957 - RNA, 1410 nt, Artificial Sequence; identical to SEQ ID NO: 144162
  derived and/or modified sequence opt3 from neuraminidase__InfluenzaA__AGW01908

SEQ ID NO: 145958 - RNA, 1410 nt, Artificial Sequence; identical to SEQ ID NO: 144162
  derived and/or modified sequence opt3 from neuraminidase__InfluenzaA__AGW01920

SEQ ID NO: 145959 - RNA, 1410 nt, Artificial Sequence; identical to SEQ ID NO: 144162
  derived and/or modified sequence opt3 from neuraminidase__InfluenzaA__AGW01932

SEQ ID NO: 145960 - RNA, 1410 nt, Artificial Sequence
  derived and/or modified sequence opt3 from neuraminidase__InfluenzaA__AGW01944
augaaccccaaucagaagaucauuaccauaggcagcgugucccugacaaucucuacuauuugcuucuuuaugcagaucgccauucucaucacgaccgucacacuucacuucaaacaguacgaguuuaacuucccuccaaauaaccagguuaugcugugugaaccgacuauaaucgagagaaauauuaccgaaaucguguauuugacaaacaccacuauugagaaggaaaucugccccaaaccugcugaguacaggaauuggucaaagccacagugugggauaacaggauuugcacccuucaguaaagacaacagcauucgguuauccgccgguggcgauaucuggguaacccgcgagccuuaugugucuugcgacccagauaaguguuaccaauuugcgcuggggcagggaacgacucuaaauaacguccauucgaauaacaccgugcgagaccguacacccuauagaacucuccugaugaaugaacuuggcguuccuuuccaccuggguaccaaacaggugugcauugcuuggucaagcaguuccugucaugaugggaaggccugguugcacgucugcaucacaggagacgauaagaacgcaaccgccucuuuuaucuacaauggcaggcucguggacagcguaguuuccuggucaaaagagauucugcggacgcaggaaagugagugugugugcauaaacggcacuuguacagucgugaugaccgaugggagcgcuucuggaaaggcagacacuaaaauccuguucauugaggaagguaagaucgugcauacauccacccucucaggcagcgcccaacacgucgaggaaugcaguugcuauccacgcuacccggggguuagaugugugugcagggauaacuggaagggaucuaaucggcccauaguagacauuaacaucaaagaucacuccaucgugagcucguacgucuguucuggcuuagugggugacacgccucgcaagaaugacuccucaaguagcucccauugccuggcuccaaacaaugaggaagggggacacggcguuaaaggcugggccuuugaugacgggaacgauguguggaugggacgaaccauuaaugagacaucuagacuugguuaugagacuuucaaggucaucgaaggcuggagcaaccccaaaucaaaguugcagauuaauaggcaagugauaguagaccguggggaucggaguggauacuccggcaucuuuagcguugaggguaaaucuuguauuaaccgcugcuucuauguggaacugaucagagggaggaaggaggaaaccgagguccuauggacaucaaauaguaucguggucuucuguggcacuagcggaaccuacggcacaggguccuggccugacggagcggaucucaaccugaugccaauuuga

SEQ ID NO: 145961 - RNA, 1410 nt, Artificial Sequence; identical to SEQ ID NO: 144162
  derived and/or modified sequence opt3 from neuraminidase__InfluenzaA__AGW01956

SEQ ID NO: 145962 - RNA, 1410 nt, Artificial Sequence
  derived and/or modified sequence opt3 from neuraminidase__InfluenzaA__AGW01968
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccauucgagaucguacacccuauagaacucuccugaugaaugaacuuggagugccuuuucaccugggcaccaagcagguuugcaucgcuuggagcaguuccucuugucaugacgguaaagccugguugcacgugugcaucacaggggaugacgagaacgcaaccgccagcuucauuuacaauggaaggcucgucgauuccgugguaucauggaguaaggaaauacugcggacgcaggagagcgaguguguuugcaucaacggcacuuguacaguggucaugaccgacggcucugcuuccgggaaagcagauacuaagauucuguuuaucgaagagggaaaaauagugcauacaucaacccucagcgguagugcccaacacguggaagagugcucuugcuauccacgcuacccgggcgucagauguguuugcagggacaacuggaagggguccaaucggcccauuguggauaucaacaucaaggaccacagcauuguaucgcgcuacguguguucuggauuagucggcgacacgccucgaaagaaugauuccucaaguagcucccauugccuggacccaaacaaugaagagggugggcacggagugaaaggcugggcuuucgaugacggcaacgauguuuggauggggagaaccaucaaugagacaucuaggcuuggauaugaaacuuuuaaagugauugaggguuggagcaaccccaagucaaaauugcagauaaaucggcaggucaucguggaccguggcgaucgcaguggguacuccggaauuuucagcguagaaggcaagucuuguaucaacagaugcuuuuauguugagcugaucaggggucggaaagaagagaccgaggugcuauggacaucaaauaguauugucguguucugugggacuagcggcaccuacggaacaggcuccuggccugacggggccgaucucaaccugaugccaauauga

SEQ ID NO: 145963 - RNA, 1410 nt, Artificial Sequence; identical to SEQ ID NO: 145887
  derived and/or modified sequence opt3 from neuraminidase__InfluenzaA__AGW01980

SEQ ID NO: 145964 - RNA, 1410 nt, Artificial Sequence; identical to SEQ ID NO: 144162
  derived and/or modified sequence opt3 from neuraminidase__InfluenzaA__AGW01992

SEQ ID NO: 145965 - RNA, 1410 nt, Artificial Sequence; identical to SEQ ID NO: 144162
  derived and/or modified sequence opt3 from neuraminidase__InfluenzaA__AGW02004

SEQ ID NO: 145966 - RNA, 1410 nt, Artificial Sequence; identical to SEQ ID NO: 144162
  derived and/or modified sequence opt3 from neuraminidase__InfluenzaA__AGW02016

SEQ ID NO: 145967 - RNA, 1410 nt, Artificial Sequence; identical to SEQ ID NO: 144162
  derived and/or modified sequence opt3 from neuraminidase__InfluenzaA__AGW02040

SEQ ID NO: 145968 - RNA, 1410 nt, Artificial Sequence
  derived and/or modified sequence opt3 from neuraminidase__InfluenzaA__AGW02064
augaaccccaaucagaagaucauuaccauaggcagcgugucccugacaaucucuacuauuugcuucuuuaugcagaucgccauucucaucacgaccgucacacuucacuucaaacaguacgaguuugacucaccuccaaacaaucagguuaugcugugugaaccgacuauaaucgagagaaacauuaccgaaaucguguauuugacaaauaccacuauugagaaggaaaucugccccaaaccugcugaguacaggaacuggaguaagccacagugugggauaacaggauucgcacccuuuagcaaagauaauuccauucgguuaucugccgguggcgacaucuggguaacccgcgagccuuaugugucgugcgauccagacaaguguuaccaauucgcgcuggggcagggaacgacucuaaacaauguccauucaaacaauaccgugcgagaucguacacccuauagaacucuccugaugaacgaacuuggcguuccuuuucaccuggguaccaaacaggugugcauugcuuggagcaguuccucuugucaugacgggaaggccugguugcacgucugcaucacaggagaugacaagaaugcaaccgccagcuucaucuacaacggcaggcucguggauuccguaguuucauggaguaaagagauucugcggacgcaggaaagcgagugugugugcauaaauggcacuuguacagucgugaugaccgacgggucugcuuccggaaaggcagauacuaaaauccuguuuauugaggaagguaagaucgugcauacaucaacccucagcggcagugcccaacacgucgaggaaugcucuugcuauccacgcuacccggggguuagaugugugugcagggacaacuggaagggauccaaccggcccauaguagauauuaauaucaaagaccacagcaucgugucgucuuacgucuguuccggcuuagugggugacacgccucgcaagaacgauucaaguagcuccgggcauugccuggacccaaauaacgaggaaggaggccacggcguuaaagggugggcuuucgaugacggaaaugauguguggaugggucgaaccauuaacgagacaucuagacuuggcuaugagacuuuuaaggucaucgaaggguggagcaaucccaaaucaaaguugcagauuaacaggcaagugauaguagaccggggagaucguaguggcuacuccgguaucuucagcguugaggggaaaucuuguauuaaucgcugcuuuuauguggaacugaucagaggcaggaaggaggaaaccgagguccuauggacaucaaacaguaucguggucuucuguggaacuagcggcaccuacgggacaggauccuggccugacggugccgaucucaaucugaugccaauuuga

SEQ ID NO: 145969 - RNA, 1410 nt, Artificial Sequence; identical to SEQ ID NO: 144162
  derived and/or modified sequence opt3 from neuraminidase__InfluenzaA__AGW02076

SEQ ID NO: 145970 - RNA, 1410 nt, Artificial Sequence; identical to SEQ ID NO: 144162
  derived and/or modified sequence opt3 from neuraminidase__InfluenzaA__AGW02088

SEQ ID NO: 145971 - RNA, 1410 nt, Artificial Sequence
  derived and/or modified sequence opt3 from neuraminidase__InfluenzaA__AGW02100
augaaccccaaucagaagaucauuaccauaggcagcgugucccugacaaucucuacuauuugcuucuuuaugcagaucgccauucucaucacgaccgucacacuucacuucaaacaguacgagucaaacaguccuccaaauaaccagguuaugcugugugaaccgacuauaaucgagagaaauauuaccgaaaucguguauuugacaaacaccacuauugagaaggaaaucugccccaaaccugcugaguacaggaauuggagcaagccacagugugggauaacaggauuugcacccuucuccaaagacaacucuauucgguuaucggccgguggcgauaucuggguaacccgcgagccuuaugugucaugcgacccagauaaguguuaccaauuugcgcuggggcagggaacgacucuaaauaacguccauagcaauaacaccgugcgagaccguacacccuauagaacucuccugaugaaugaacuuggcguuccuuuccaccuggguaccaaacaggugugcauugcuuggaguuccucuagcugucaugaugggaaggccugguugcacgucugcaucacaggagacgauaagaacgcaaccgccuccuuuaucuacaauggcaggcucguggacucaguaguuaguuggagcaaagagauucugcggacgcaggaaucugagugugugugcauaaacggcacuuguacagucgugaugaccgauggguccgcuucaggaaaggcagacacuaaaauccuguucauugaggaagguaagaucgugcauacaagcacccucaguggcucugcccaacacgucgaggaaugcuccugcuauccacgcuacccggggguuagaugugugugcagggauaacuggaagggaagcaaucggcccauaguagacauuaacaucaaagaucacucgaucgugucuuccuacgucuguucaggcuuagugggugacacgccucgcaagaaugacaguagcuccucuagccauugccuggauccaaacaaugaggaagggggacacggcguuaaaggcugggcuuuugacgaugggaacgacguguggaugggacgaaccauuaaugagacaucaagacuugguuaugagacuuucaaggucaucgaaggcuggaguaaccccaaauccaaguugcagauuaauaggcaagugauaguagaucguggggaccggagcggauacucuggcaucuuuucaguugaggguaaaaguuguauuaaccgcugcuucuauguggaacugaucagagggaggaaggaggaaaccgagguccuauggacaagcaauuccaucguggucuuuuguggcacuucuggaaccuacggcacagggucguggccugauggagccgaccucaaccugaugccaauuuga

SEQ ID NO: 145972 - RNA, 1410 nt, Artificial Sequence; identical to SEQ ID NO: 145899
  derived and/or modified sequence opt3 from neuraminidase__InfluenzaA__AGW02112

SEQ ID NO: 145973 - RNA, 1410 nt, Artificial Sequence
  derived and/or modified sequence opt3 from neuraminidase__InfluenzaA__AGW02124
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugagcgaccgaacacccuaucguacucuccugaugaaugaacuuggcguuccuuuucaccuggguaccaaacaggugugcauugcuuggaguuccucuagcugucaugaugggaaggccugguugcacgucugcaucacaggagacgauaagaacgcaaccgccuccuucaucuacaauggcagacucguggacucaguaguuaguuggagcaaagagauucugaggacgcaggaaucugagugugugugcauaaacggcacuuguacagucgugaugaccgauggguccgcuucaggaaaggcagacacuaaaauccuguuuauugaggaagguaagaucgugcauacaagcacccucaguggcucugcccaacacgucgaggaaugcuccugcuauccacgguacccggggguucgcugugugugcagagauaacuggaagggaagcaauaggcccauaguagacauuaacaucaaagaucacucgaucgugucuuccuacgucuguucaggcuuagugggugacacgccucggaagaaugacaguagcuccucuagccauugccuggauccaaacaaugaggaagggggacacggcguuaaaggcugggcuuucgacgaugggaacgacguguggaugggacgcaccauuaaugagacaucacgacuugguuaugagacuuuuaaggucaucgaaggcuggaguaaccccaaauccaaguugcagauuaauagacaggugauaguagauaggggagaccggagcggguacucuggcaucuucucaguugaggguaaaaguuguauuaaccguugcuuuuauguggaacugauccgcgggagaaaggaggaaaccgagguccuauggacaagcaauuccaucguggucuucuguggcacuucuggaaccuacggcacagggucguggccugauggagccgaccucaaccugaugccaauuuga

SEQ ID NO: 145974 - RNA, 1410 nt, Artificial Sequence; identical to SEQ ID NO: 145887
  derived and/or modified sequence opt3 from neuraminidase__InfluenzaA__AGW02136

SEQ ID NO: 145975 - RNA, 1410 nt, Artificial Sequence; identical to SEQ ID NO: 145899
  derived and/or modified sequence opt3 from neuraminidase__InfluenzaA__AGW02148

SEQ ID NO: 145976 - RNA, 1410 nt, Artificial Sequence
  derived and/or modified sequence opt3 from neuraminidase__InfluenzaA__AGW02160
augaaccccaaucagaagaucauuaccauaggcagcgugucccugacaaucucuacuauuugcuucuuuaugcagaucgccauucucaucacgaccgucacacuucacuucaaacaguacgaguuugacucaccuccaaacaaucagguuaugcugugugaaccgacuauaaucgagagaaacauuaccgaaaucguguauuugacaaauaccacuauugagaaggaaaucugccccaaaccugcugaguacaggaacuggaguaagccacagugugggauaacaggauucgcacccuuuagcaaagauaauuccauucgguuaucugccgguggcgacaucuggguaacccgcgagccuuaugugucgugcgauccagacaaguguuaccaauucgcgcuggggcagggaacgacucuaaacaauguccauucaaacaauaccgugcgagaucguacacccuauagaacucuccugaugaacgaacuuggcguuccuuuucaccuggguaccaaacaggugugcauugcuuggagcaguuccucuugucaugacgggaaggccugguugcacgucugcaucacaggagaugacaagaaugcaaccgccagcuucaucuacaacggcaggcucguggauuccguaguuucauggaguaaagagauucugcggacgcaggaaagcgagugugugugcauaaauggcacuuguacagucgugaugaccgacgggucugcuuccggaaaggcagauacuaaaauccuguuuauugaggaagguaagaucgugcauacaucaacccucagcggcagugcccaacacgucgaggaaugcucuugcuauccacgcuacccggggguuagaugugugugcagggacaacuggaagggauccaaccggcccauaguagauauuaauaucaaagaccacagcaucgugucgucuuacgucuguuccggcuuagugggugacacgccucgcaagaacgauucaaguagcuccucucauugccuggacccaaauaacgaggaagggggacacggcguuaaaggcugggcuuucgaugacgggaaugauguguggaugggacgaaccauuaacgagacaagcagacuugguuaugagacuuuuaaggucaucgaaggcuggucaaaucccaaaaguaaguugcagauuaacaggcaagugauaguagaccgguccgaucguagcggguacucuggaaucuucucaguugagggcaaaaguuguauuaaucgcugcuuuuauguggaacugaucagagguaggaaggaggaaaccgagguccuauggacaagcaacuccaucguggucuucugugggacuucuggcaccuacggaacaggcucguggccugacggggccgaucucaaucugaugccaauuuga

SEQ ID NO: 145977 - RNA, 1410 nt, Artificial Sequence; identical to SEQ ID NO: 144162
  derived and/or modified sequence opt3 from neuraminidase__InfluenzaA__AGW02172

SEQ ID NO: 145978 - RNA, 1410 nt, Artificial Sequence; identical to SEQ ID NO: 144162
  derived and/or modified sequence opt3 from neuraminidase__InfluenzaA__AGW02184

SEQ ID NO: 145979 - RNA, 1410 nt, Artificial Sequence
  derived and/or modified sequence opt3 from neuraminidase__InfluenzaA__AGW02196
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugauuaacacaaccaucgagaaggaaauaugccccaaaccugcugaguacaggaauuggaguaagccacagugugggauuacuggauucgcacccuuuagcaaagacaacuccauccgguuaucugccgguggcgauauuuggguaacacgcgagccuuaugugucgugcgacccauacaaguguuaucaauucgcgcuggggcagggaaccacgcuaaauaacguccauucaaauaacacugugcgagaucguacccccuacagaacacuccugaugaaugaacuuggcguuccuuuucaccuggguacuaaacaggugugcaucgcuuggagcaguuccucuugucaugacgggaaggccugguugcacgucugcaucaccggagaugacaagaacgcaacagccagcuucauuuauaauggcaggcucguggauuccguaguuucauggaguaaagagauacugcggacccaggaaagcgagugugugugcaucaacggcacguguacugucgugaugacagacgggucugcuuccggaaaggcagauaccaaaauucuguuuaucgaggaagguaagauagugcauacuucaacacucagcggcagugcccaacacgucgaggaaugcucuugcuacccacgcuacccggggguuagaugugugugcagggacaacuggaagggauccaaucggcccauuguagauaucaacaucaaagaccacagcauugugucgucuuaugucuguuccggcuuagugggugauaccccucgcaagaaugacucaaguagcuccucucauugccuggacccaaacaaugaggaagggggacacggcguuaaaggcugggcuuucgaugacgggaacgauguguggaugggacgaacgaucaaugagaccagcagacuugguuacgagacauuuaaggucauugaaggcuggucaaaccccaaaaguaaguugcagauaaauaggcaagugaucguagaccguggggaucgguccggauauagcggcauuuucucuguugaggguaaaucauguaucaaccgcugcuuuuacguggaacugaucagagggaggaaggaggaaacugagguccuauggaccaguaauagcauuguggucuucuguggcacauccggaacuuauggcaccgggucuuggccugacggagccgaucucaaccugaugccaauauga

SEQ ID NO: 145980 - RNA, 1410 nt, Artificial Sequence; identical to SEQ ID NO: 145391
  derived and/or modified sequence opt3 from neuraminidase__InfluenzaA__AGW04174

SEQ ID NO: 145981 - RNA, 1410 nt, Artificial Sequence
  derived and/or modified sequence opt3 from neuraminidase__InfluenzaA__AGW25784
augaaccccaaucagaagaucauuaccauaggcagcguuucccugaucauugccacaaucugcuuccucaugcaaauugcuauccuugucacuacgguuacccugcacuuuaaacaguacggguauaacucuuugccuaauaaccaggugauguuaugugagccaacaauaaucgaaagaaauauuacugagaucguauaccugaccaacacaaccauugaaaaggagaucugcccgaaacuagcagaauauaggaauuggucaaagccccaguguaaaauaacuggauucgccccuuuuaguaaggacaacagcauucggcucuccgcggguggcgauaucugggugacacgcgagccauacgucucuugcgaccccuauaaguguuaccaauucgcucuggggcagggaaccacgcuuaauaacaaacauucgaaugauacugugcacgaccgaaccccuuaucguacacuguugaugaacgagcucggcguuccauuucaucuggguacuaaacaggugugcauugccuggucaagcaguuccugucacgaugggaaagcauggcugcauaucugcgucaccggacacgacgaaaaugccacagcuucuuucaucuacgauggcaagcucguggacagcauuggcuccuggucaaagaagauauuaagaacccaggagagugaauguguaugcaucaacgggacguguacuguugugaugacagauggaagcgcaucugguagggccgacaccaagauucuguuuaucgaggagggcaaaauaauucacaucucccaacuuucagggagcgcucagcaugucgaagagugcaguugcuacccccgguauccuggaauccgcugugugugcagagauaauuggaagggcucuaacaggccaauuguggacaucaacgucaaagauuacuccauuacuagcucguauguuuguucugguuuggugggggacacaccgcggaagaccgacaauuccucaaguagccacugccugaaccccaauaacgaagagggaggccauggcguaaaagggugggccuucgaugacggaaaugauguguggaugggucgcacgauauccgaaaaguuucgaucuggcuacgagaccuucaaagucaucaagggguggagcaagccuaacucaaaacuacagauuaauagacaggugaucguugacagggauaaccggaguggauauuccggcaucuuuagcguggaggguaagucuuguauuaaucguugcuucuacgucgaacucauacgcgggagaaaaagggaggcggaagugugguggacaucaaacaguaucguaguguuuuguggcacuagcggaaccuauggcacaggguccuggccagacggagcagauauuaaucugaugcccaucuga

SEQ ID NO: 145982 - RNA, 1350 nt, Artificial Sequence
  derived and/or modified sequence opt3 from neuraminidase__InfluenzaA__AGW27062
augaaccccaaucagaagaucgugaccauuggcagcauaugcauggucaucgggacaauuucccugaugcuccaaaucggaaacauuaucucuauauggguuucacacaguauccagacugguaaucagcaucagacggagccuauuagaaacaccaauuuccuuacagaaaacgccguggcuagcguaacucuggcaggcaauuccucuuuguguccaaucagggggugggccgugcacucgaaagacaacucaauucggaucggaagcaagggcgaugucuuugugauacgcgagccguucauuaguugcucccauuuagaaugucgaaccuuuuuccugacacaaggugcgcuacucaaugacaaacacucuaacgggaccguuaaggaucguagcccccauagaacucugauguccugcccuaucggagaggcuccaucacccuacaauaguagguuugaaagcguggccuggucugcauccgccugucacgacggcacaucauggcuugucauuggcaucagcgggccugauaacggagcuguggcaguacugaaauauaaugguaucauuaccgacacgauacggaguuggcgcaacaauaucuugagaacucaggagucugagugcgccuguguuaacggcuccugcuucaccgugaugacagaugggccaagcaacggacaggcuucguacaagauuuuuaagaucgaaaaaggcaaggucgugaaaucuguggagcucaaugcccccaacuaucacuacgaagaguguuccugcuauccugacgcgggugagauaacuugugucugcagggauaauuggcaugggucaaaccggccauggguuaguuucaaucagaaccuggaauaccaaauuggauauaucugcagcggcguguuuggcgacaauccgcgccccaacgaugggaccggauccugugguccuguaucuagcaauggcgcauacggggugaagggauucucauuuaaauacggcaacggugucuggaucgggcgaacaaagaguacccacuccagaagcggcuucgagaugauuugggacccaaauggauggacgggcacugauucugaauuuucaaugaagcaggacaucguggccauuacagacuggaguggguauagcggauccuucguucagcaucccgagcugaccggucucgauugcauaaggccuuguuucuggguggaauuaauccggggccguccaaaagagucuacuauuuggacaucggggagcuccaucucauuuugcggagucaacagugacaccgugucuuggagcuggcccgauggcgcugagcugccguucacgaucgacaaguga

SEQ ID NO: 145983 - RNA, 1410 nt, Artificial Sequence
  derived and/or modified sequence opt3 from neuraminidase__InfluenzaA__AGY14472
augaaccccaaucagaagaucauuaccauaggcagcgugucccugacacucgccacuaucugcuuccuuaugcagauugcuauccuggucacgaccguuacauugcacuuuaaacaguacgaguguaacucuacuccuaauaaccaggugauguuaugcgaaccaaccguaauugagagaaauaucacaaagauaguguaucugaccaacacuacagucgaaaaagagaucuguccgaagcccgcagaauacaggaauuggucaaaaccucagugcaagauuaccggguucgccccauuuaguaaggacaacagcauccggcuauccgcgggaggugauauuugggugacgcgcgagcccuauguuucuugugacccuaauaaaugcuaccaauucgcucucggccaggggacuacccugaacaaucgacauucgaacgauacagugcacgaccguacuccauauagaacccuucugaugaaugaguugggaauccccuuucaucucggcacaaagcaggucuguauagccuggucaagcaguuccugccacgaugguaaagcauggcugcauguguguguaaccgggcacgacaagaacgccacggcuucuuucauuuacgauggaaaacugguugacagcaucggcuccuggucaaagaagauucucaggacucaggaaagugagugcguguguaucaauggcacaugcaccgucgugaugacugaugggagcgcaucuggacgggccgacacaaaaaucuuauuuauugaagaggguaagauaauccacauuucccaacugucaggcagcgcucagcauguggaggaaugcaguuguuauccucgcuacccagggaucagaugcgucuguagggauaacuggaaaggaucuaaccggccgauaguugacauuaaugugaaggauuacuccaucaccagcucguauguaugcucuggccuugugggugacacgccccgcaaaaccgacaacuccucaaguagccacuguuugaauccuaacaaugaggaagggggacauggcgucaagggcugggccuucgaugacgggaacgauguguggaugggacgaacaaucuccgagaaauuuagaucugguuacgaaacuuucaagguuauuaagggcuggagcaaaccaaauucaaagcugcagaucaacaggcaagugauugucgaccgggauaaucguaguggguauuccggaauauuuagcguggagggcaaaucuugcaucaaccgcuguuucuacguagagcuaauuagagguaggaagcgggaagcggagguuugguggaccucaaauaguaucguggucuuuugcgggacaagcggcacuuauggaaccggcuccuggcccgacggggcagauaucaaccucaugccuauuuga

SEQ ID NO: 145984 - RNA, 1398 nt, Artificial Sequence
  derived and/or modified sequence opt3 from neuraminidase__InfluenzaA__AHA11501
augaaccccaaucagaagauccugugcaccagcgccacagcuauuauaaucggcgcaauugccgugcucaucgggauugcgaaccuuggacugaauaucgguuugcacuuaaaaccuggcuguaacugcucccauucucaaccagagacuacgaauaccucacagacaauaaucaacaauuacuauaacgaaacuaauauuaccaacauccagauggaggaaagaacaaguaggaauuucaacaaucugaccaaggggcuauguacuauuaacagcuggcacaucuacggaaaagacaaugcuguccggauaggcgaguccucugauguucucgugacacgcgaaccguauguaucgugcgaccccgaugagugucgauuuuacgcccugucacaggguaccacgauucgugggaagcauagcaacggaacuauccacgacagaagucaauauagggcacuuauuuccuggccucugucuagcccacccaccguguacaacucccgggucgagugcaucggcuggucaaguacaagcugucaugauggcaaaucucgcauguccaucugcauuucagggccuaauaacaaugccagcgcugugguuugguauaacagaaggccaguggcagaaauaaauacuugggcccggaacaucuugcgcacccaggagagugaaugugucugccacaauggagugugucccauuguauucacagacgguucugcuaccggcccugccgauacgcgaaucuacuacuuuaaggaggggaagauacucgagugggaaucccugacuggaacagcgaaacacauugaggaaugcagcugcuauggcgagagaaccgguaucacuuguacaugcagggacaacuggcaggggucgaaucggccaguuauccagauugauccgguggcaaugacccauacgucucaauacaucuguucccccguccugaccgacacaccucguccaaacgaucccaauauuggaaagugcaacgacccuuauccaggcaaugauaacaauggcgugaaaggguucucauaccucgacggagccaacacuugguuaggucgcaccauaaguacagcuagcagauccggcuaugaaaugcugaaggugcccaacgcccuuacugacgauaggucuaaaccgauccaggggcagaccauugucuugaaugcagacuggagcggauacucaggcaguuuuauggauuauugggcugagggugacuguuaccgggccugcuucuacguugagcugauccgagggcgcccuaaggaagauaaggugugguggacauccaacagcaucguaucuauguguucaaguaccgaguuucuaggccaguggaauuggcccgacggagcgagaauugaauauuuccucuga

SEQ ID NO: 145985 - RNA, 1410 nt, Artificial Sequence
  derived and/or modified sequence opt3 from neuraminidase__InfluenzaA__AHC57462
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugcugggacccuaacaaugaggaaggugggcacggaguuaaaggcugggcuuucgaugacggcaacgauguguggauggggcgaaccauuaaugagacaagcagacuuggauaugagacuuuuaaggucaucgaagguuggucaaacccaaaaaguaaguugcaagugaauaggcagguaauuguugaccggggcgaucguuccggguacagcggaauauucucuguggagggcaaaucauguaucaaccgcugcuuuuaugucgaacugauuagagguaggaaggaggaaaccgaggugcuauggacaaguaauagcaucgucguguucugugggacuuccggcaccuacggaacaggcucuuggcccgacggggccgaucucaaccugaugccuaucuga

SEQ ID NO: 145986 - RNA, 1410 nt, Artificial Sequence; identical to SEQ ID NO: 141534
  derived and/or modified sequence opt3 from neuraminidase__InfluenzaA__AHC57490

SEQ ID NO: 145987 - RNA, 1410 nt, Artificial Sequence
  derived and/or modified sequence opt3 from neuraminidase__InfluenzaA__AHC57514
augaaccccaaucagaagaucauuaccauaggcagcgugucccugacaaucucuacuauuugcuucuuuaugcagaucgccauucucaucacgaccgucacacuucacuucaaacaguacgaguuuuauucaccuccaaacaaucagguuaugcugugugaaccgacuauaaucgagagaaacauuaccgaaaucguguacuugacaaauaccacuauugagaaggaaaucugccccaaauuagcugaguauaggaacuggaguaagccucagugugacauaacaggguucgcaccauuuagcaaagauaauuccauucggcugucugccggaggugacaucuggguaacccgcgagcccuacgugucgugcgauccugacaaguguuaucaauucgcgcuaggccaggggacgacucucaacaauguccauucaaacaauaccgugcgagaucguacaccauacagaacucugcuuaugaacgaacugggaguucccuuucacuugggcaccaaacaggugugcauugcuuggagcaguuccucuugucaugacgguaaggccuggcuccacgucugcaucacaggggaugacaagaaugcaaccgccagcuucaucuauaacggaaggcugguggauuccguaguuucauggaguaaagagauucugcggacgcaggaaagcgagugugugugcauaaauggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuacccucgcuacccaggcguuagaugugugugcagggacaacuggaagggguccaaccggccgauaguagauauuaauaucaaagaccacagcaucgugucgucuuaugucuguuccggacuggugggcgacacgccccgcaagaacgauucaaguagcuccucucauugccuugacccuaauaacgaggaaggugggcacggaguuaaaggcugggcuuucgaugacggcaaugauguguggauggggcgaaccauuaacgagacaagcagauugggauacgagacuuuuaaggucaucgaagguuggucaaauccaaaaaguaagcugcagauuaacaggcaagugauaguagaccggggcaaucguuccggguauagcggaaucuucucuguugagggcaaaucauguauuaaccgcugcuuuuacguggaacuaaucagagguaggaaggaggaaaccgagguccucuggacaaguaauagcaucguggucuucugugggacuuccggcaccuauggaacaggcucuuggcccgauggggccgaccugaaccuuaugccuauuuga

SEQ ID NO: 145988 - RNA, 1410 nt, Artificial Sequence; identical to SEQ ID NO: 145987
  derived and/or modified sequence opt3 from neuraminidase__InfluenzaA__AHC57526

SEQ ID NO: 145989 - RNA, 1410 nt, Artificial Sequence; identical to SEQ ID NO: 145987
  derived and/or modified sequence opt3 from neuraminidase__InfluenzaA__AHC57806

SEQ ID NO: 145990 - RNA, 1410 nt, Artificial Sequence; identical to SEQ ID NO: 145987
  derived and/or modified sequence opt3 from neuraminidase__InfluenzaA__AHC57818

SEQ ID NO: 145991 - RNA, 1410 nt, Artificial Sequence
  derived and/or modified sequence opt3 from neuraminidase__InfluenzaA__AHC57830
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaaacugguggacuccguaguuucauggaguaaggagauucugaggacgcaggaaagcgagugugugugcauaaacggcacuuguacagucgugaugaccgauggcucugcuuccgggaaagcagacacuaagauccucuuuauugaggaaggaaagaucgugcauacaucaaccuuaagcgguagugcccaacacgucgaggaaugcucuugcuauccucgguacccaggcguucgcugugugugcagagauaauuggaaaggguccaacaggccgauaguagacauuaauaucaaggaucacagcaucgugucgucuuacgucuguuccggacuggugggcgacacgccccggaaaaacgacucaaguagcuccucucauugccuugauccuaauaacgaggaaggugggcacggaguuaagggcugggcuuucgacgauggcaaugacguguggauggggcgcaccauuaacgagacaagccgauugggauaugagacuuuuaaagucaucgaagguuggucaaauccaaagaguaaacugcagauuaacagacaggugauaguagauaggggcaaucgguccggguacagcggaaucuucucuguugagggcaagucauguauuaaccguugcuuuuauguggaacuaauccgcgguagaaaggaggaaaccgagguccucuggacaaguaauagcaucguggucuucugugggacuuccggcaccuacggaacaggcucuuggcccgacggggccgaucugaaccuuaugccuauuuga

SEQ ID NO: 145992 - RNA, 1410 nt, Artificial Sequence; identical to SEQ ID NO: 145991
  derived and/or modified sequence opt3 from neuraminidase__InfluenzaA__AHC57971

SEQ ID NO: 145993 - RNA, 1410 nt, Artificial Sequence; identical to SEQ ID NO: 145987
  derived and/or modified sequence opt3 from neuraminidase__InfluenzaA__AHC57984

SEQ ID NO: 145994 - RNA, 1410 nt, Artificial Sequence
  derived and/or modified sequence opt3 from neuraminidase__InfluenzaA__AHC57996
augaaccccaaucagaagaucauuaccauaggcagcgugucccugacaaucucuacuauuugcuucuuuaugcagaucgccauucucaucacgaccgucacacuucacuucaaacaguacgaguuuuauucaccuccaaacaaucagguuaugcugugugaaccgacuauaaucgagagaaacauuaccgaaaucguguacuugacaaauaccacuauugagaaggaaaucugccccaaauuagcugaguauaggaacuggaguaagccucagugugacauaacaggguucgcaccauuuagcaaagauaauuccauucggcugucugccggaggugacaucuggguaacccgcgagcccuacgugucgugcgauccugacaaguguuaucaauucgcgcuaggccaggggacgacucucaacaauguccauucaaacaauaccgugcgagaucguacaccacacagaacucugcuuaugaacgaacugggaguucccuuucauuugggcaccaaacaggugugcauugcuuggagcaguuccucuugucacgacgguaaggccuggcuccaugucugcaucacaggggaugacaagaaugcaaccgccagcuucaucuacaacggaaggcugguggauuccguaguuucauggaguaaagagauucugcggacgcaggaaagcgagugugugugcauaaauggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgcuacccaggcguuagaugugugugcagggacaacuggaagggguccaaccggccgauaguagauauuaauaucaaagaccauagcaucgugucgucuuacgucuguuccggacuggugggcgacacgccccgcaagaacgauucaaguagcuccucucacugccuugacccuaauaacgaggaaggugggcauggaguuaaaggcugggcuuucgaugacggcaaugauguguggauggggcgaaccauuaacgagacaagcagauugggauaugagacuuuuaaggucaucgaagguuggucaaauccaaaaaguaagcugcagauuaacaggcaagugauaguagaccggggcaaucguuccggguacagcggaaucuucucuguugagggcaaaucauguauuaaccgcugcuuuuauguggaacuaaucagagguaggaaggaggaaaccgagguccucuggacaaguaauagcaucguggucuucugugggacuuccggcaccuacggaacaggcucuuggcccgauggggccgaccugaaccuuaugccuauuuga

SEQ ID NO: 145995 - RNA, 1410 nt, Artificial Sequence; identical to SEQ ID NO: 144938
  derived and/or modified sequence opt3 from neuraminidase__InfluenzaA__AHC58008

SEQ ID NO: 145996 - RNA, 1410 nt, Artificial Sequence; identical to SEQ ID NO: 141534
  derived and/or modified sequence opt3 from neuraminidase__InfluenzaA__AHC58020

SEQ ID NO: 145997 - RNA, 1410 nt, Artificial Sequence
  derived and/or modified sequence opt3 from neuraminidase__InfluenzaA__AHC58032
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaaacugguggacuccguaguuucauggaguaaggagauucugaggacgcaggaaagcgagugugugugcauaaacggcacuuguacagucgugaugaccgauggcucugcuuccgggaaagcagacacuaagauccucuuuauugaggaaggaaagaucgugcauacaucaaccuuaagcgguagugcccaacacgucgaggaaugcucuugcuauccucgguacccaggcguucgcugugugugcagagauaauuggaaaggguccaacaggccgauaguagacauuaauaucaaggaucacagcaucgugucgucuuacgucuguuccggacuggugggcgacacgccccggaaaaacgacucaaguagcuccucucauugccuuaauccuaacaaugaggaaggugggcacggaguuaagggcugggcuuucgaugacggcaacgauguguggauggggcgcaccauuaaugagacaagccgauugggauaugagacuuuuaaagucaucgaagguuggucaaacccaaagaguaaacugcagauuaauagacaggugauaguagacaggggcaaccgguccggguacagcggaaucuucucuguugagggcaagucauguauuaaucguugcuuuuauguggaacuaauccgcgguagaaaggaggaaaccgagguccucuggacaaguaacagcaucguggucuucugugggacuuccggcaccuacggaacaggcucuuggcccgauggggccgaccugaaucuuaugccuauuuga

SEQ ID NO: 145998 - RNA, 1410 nt, Artificial Sequence; identical to SEQ ID NO: 144938
  derived and/or modified sequence opt3 from neuraminidase__InfluenzaA__AHC58053

SEQ ID NO: 145999 - RNA, 1410 nt, Artificial Sequence
  derived and/or modified sequence opt3 from neuraminidase__InfluenzaA__AHC58077
augaaccccaaucagaagaucauuaccauaggcagcgugucccugacaaucucuacuauuugcuucuuuaugcaaaucgccauucucaucacgaccgucacacuucacuucaaacaguacgaguuuuauucaccuccaaacaaucagguuaugcugagagaaccgacuauaaucgagaggaacauuaccgaaaucguguacuugacaaauaccacuacagagaaggaaauuugucccaaauuagcugaguaucggaacuggaguaagccucagugcgacaucaccggguucgcaccauuuagcaaagauaauuccauacgccugucugccggaggugacauuuggguaacgcgagagcccuacgugucgugugauccugacaagugcuaucaauucgcgcuaggccaggggacuacccucaacaauguccauucaaacaauacagugcgugauagaacuccauacaggacccugcuuaugaacgaacugggaguucccuuucacuugggcacaaaacagguguguaucgcuuggagcaguuccucuugccaugacgguaaggccuggcuccacgucuguauuaccggggaugacaagaaugcaacggccagcuucaucuauaacggacggcugguggauuccguaguuucauggaguaaagagauccugcgcacucaggaaagcgagugcguguguauuaauggcacaugcaccgucgugaugacugacggcucugcuuccgggaaggcagauacaaaaauacucuuuaucgaggaaggaaagauugugcauaccucaacguuaagcgguagugcccaacacgucgaggaauguucuugcuacccuagauacccaggcguuaggugcgugugucgggacaacuggaagggguccaaccgcccgaucguagauauaaauauuaaagaccacagcaucgugucgucuuaugucugcuccggacuggugggcgacacuccccgaaagaacgauucaaguagcuccucucauugucuugacccuaauaacgaggaaggugggcacggaguuaaaggcugggcuuucgaugacggcaaugauguguggauggggagaacaaucaacgagacuagcagguugggauacgagaccuuuaaggucauugaagguuggucaaauccaaaaaguaagcugcagaucaaccgucaggugauuguagaccggggcaaucgcuccggguauagcggaauauucucuguugagggcaaaucaugcaucaacagauguuuuuacguggaacuaauuaggggucggaaggaggaaacagagguccucuggaccaguaauagcaucguggucuucugcgggaccuccggcacauauggaaccggcucuuggcccgauggggccgaccugaaccuuaugccuaucuga

SEQ ID NO: 146000 - RNA, 1410 nt, Artificial Sequence; identical to SEQ ID NO: 145991
  derived and/or modified sequence opt3 from neuraminidase__InfluenzaA__AHC58089

SEQ ID NO: 146001 - RNA, 1410 nt, Artificial Sequence; identical to SEQ ID NO: 145987
  derived and/or modified sequence opt3 from neuraminidase__InfluenzaA__AHC58101

SEQ ID NO: 146002 - RNA, 1410 nt, Artificial Sequence
  derived and/or modified sequence opt3 from neuraminidase__InfluenzaA__AHC58113
augaaccccaaucagaagaucauuaccauaggcagcgugucccugacaaucucuacuauuugcuucuuuaugcagaucgccauucucaucacgaccgucacacuucacuucaaacaguacgaguuuuauucaccuccaaacaaucagguuaugcugugugaaccgacuauaaucgagagaaacauuaccgaaaucguguacuugacaaauaccacuauugagaaggaaaucugccccaaauuagcugaguauaggaacuggaguaagccucagugugacauaacaggguucgcaccauuuagcaaagauaauuccauucggcugucugccggaggugacaucuggguaacccgcgagcccuacgugucgugcgauccugacaaguguuaucaauucgcgcuaggccaggggacgacucucaacaauguccauucaaacaauaccgugcgagaucguacaccauacagaacucugcuuaugaacgaacugggaguucccuuucacuugggcaccaaacaggugugcauugcuuggagcaguuccucuugucaugacgguaaggccuggcuccacgucugcaucacaggggaugacaagaaugcaaccgccagcuucaucuauaacggaaggcugguggauuccguaguuucauggaguaaaaagauucugcggacgcaggagagcgaaugugugugcauaaauggcacuuguacagucgugaugaccgacggcucugcuuccgggaaagcagauacuaagauccucuuuauugaggagggaaagaucgugcauacaucaaccuuaagcgguagugcccaacacgucgaagagugcucuugcuacccucgcuacccaggcguuagaugugugugcagggacaacuggaaaggguccaaccggccgauaguagauauuaauaucaaggaccacagcaucgugucgucuuaugucuguuccggacuggugggcgacacgccccgcaaaaacgauucaaguagcuccucucauugccuugacccuaauaacgaagagggugggcacggaguuaagggcugggcuuucgaugacggcaaugauguguggauggggcgaaccauuaacgaaacaagcagauugggauacgagacuuuuaaagucaucgaggguuggucaaauccaaagaguaaacugcagauuaacaggcaagugauaguagaccggggcaaucguuccggguauagcggaaucuucucuguugaaggcaagucauguauuaaccgcugcuuuuacguggagcuaaucagagguaggaaggaagagaccgaaguccucuggacaaguaauagcaucguggucuucugugggacuuccggcaccuauggaacaggcucuuggcccgauggggccgaccugaaccuuaugccuauuuga

SEQ ID NO: 146003 - RNA, 1410 nt, Artificial Sequence; identical to SEQ ID NO: 145987
  derived and/or modified sequence opt3 from neuraminidase__InfluenzaA__AHC58129

SEQ ID NO: 146004 - RNA, 1410 nt, Artificial Sequence; identical to SEQ ID NO: 145987
  derived and/or modified sequence opt3 from neuraminidase__InfluenzaA__AHC58153

SEQ ID NO: 146005 - RNA, 1410 nt, Artificial Sequence; identical to SEQ ID NO: 145987
  derived and/or modified sequence opt3 from neuraminidase__InfluenzaA__AHC58165

SEQ ID NO: 146006 - RNA, 1410 nt, Artificial Sequence; identical to SEQ ID NO: 145991
  derived and/or modified sequence opt3 from neuraminidase__InfluenzaA__AHC58177

SEQ ID NO: 146007 - RNA, 1410 nt, Artificial Sequence
  derived and/or modified sequence opt3 from neuraminidase__InfluenzaA__AHC58189
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccauuaaugagaugagcagacuuggauaugagacauuuaaggucaucgaagguuggucaaaccccaaaaguaaguugcagauuaauaggcaagugauaguagaccggggcgaucguuccggguacagcggaaucuucucuguugagggcaaaucauguauuaaccgcugcuuuuauguggaacugaucagagguaggaaggaggaaacugagguccuauggaccaguaauagcaucguggucuucugugggacauccggcacuuacggaaccggcucuuggccugacggggccgaucucaaccugaugccaauuuga

SEQ ID NO: 146008 - RNA, 1410 nt, Artificial Sequence; identical to SEQ ID NO: 145987
  derived and/or modified sequence opt3 from neuraminidase__InfluenzaA__AHC58201

SEQ ID NO: 146009 - RNA, 1410 nt, Artificial Sequence
  derived and/or modified sequence opt3 from neuraminidase__InfluenzaA__AHC58225
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccauuaaugagacaagcagacuuggauaugagacuuuuaaggucaucgaagguuggucaaaccccaaaaguaaguugcagauuaauaggcaagugauaguaaaccggggcgaccguuccggguacagcggaaucuucucuguugagggcaaaucauguauuaaucgcugcuuuuauguggaacugaucagagguaggaaggaggaaaccgagguccuauggacaaguaacagcaucguggucuucugugggacuuccggcaccuacggaacaggcucuuggccugauggggccgaccucaaucugaugccaauuuga

SEQ ID NO: 146010 - RNA, 1410 nt, Artificial Sequence; identical to SEQ ID NO: 145991
  derived and/or modified sequence opt3 from neuraminidase__InfluenzaA__AHC58237

SEQ ID NO: 146011 - RNA, 1410 nt, Artificial Sequence; identical to SEQ ID NO: 145987
  derived and/or modified sequence opt3 from neuraminidase__InfluenzaA__AHC58249

SEQ ID NO: 146012 - RNA, 1410 nt, Artificial Sequence; identical to SEQ ID NO: 141534
  derived and/or modified sequence opt3 from neuraminidase__InfluenzaA__AHC58273

SEQ ID NO: 146013 - RNA, 1410 nt, Artificial Sequence; identical to SEQ ID NO: 145991
  derived and/or modified sequence opt3 from neuraminidase__InfluenzaA__AHC58363

SEQ ID NO: 146014 - RNA, 1410 nt, Artificial Sequence; identical to SEQ ID NO: 144938
  derived and/or modified sequence opt3 from neuraminidase__InfluenzaA__AHC58375

SEQ ID NO: 146015 - RNA, 1410 nt, Artificial Sequence; identical to SEQ ID NO: 145991
  derived and/or modified sequence opt3 from neuraminidase__InfluenzaA__AHC58387

SEQ ID NO: 146016 - RNA, 1410 nt, Artificial Sequence; identical to SEQ ID NO: 145991
  derived and/or modified sequence opt3 from neuraminidase__InfluenzaA__AHC58399

SEQ ID NO: 146017 - RNA, 1410 nt, Artificial Sequence; identical to SEQ ID NO: 145987
  derived and/or modified sequence opt3 from neuraminidase__InfluenzaA__AHC58411

SEQ ID NO: 146018 - RNA, 1410 nt, Artificial Sequence; identical to SEQ ID NO: 144938
  derived and/or modified sequence opt3 from neuraminidase__InfluenzaA__AHC58423

SEQ ID NO: 146019 - RNA, 1410 nt, Artificial Sequence; identical to SEQ ID NO: 145991
  derived and/or modified sequence opt3 from neuraminidase__InfluenzaA__AHC58459

SEQ ID NO: 146020 - RNA, 1410 nt, Artificial Sequence
  derived and/or modified sequence opt3 from neuraminidase__InfluenzaA__AHC58471
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccagccuguaguguccgucaaacuggccggaaauucuucguugugcccagugucagggugggcgauauacagcaaggacaacaguauuagaaucggcuccaaaggugauguuuuugugauuagggagccguucaucucuuguagccccuuagaaugccggaccuuuuuccugacacagggggcucuacucaaugacaagcauuccaacggaaccaucaaagaucgcucaccuuaucgaacucugaugaguuguccaauuggcgagguccccagcccuuacaacucucguuuugaauccguggccuggucagcaagcgccugccacgacggcauaaauuggcuuacaaucgggauuaguggaccagauaacggugcuguagcaguucugaaguauaauggcaucauaaccgacacgauuaagucuuggagaaacaauaucuugaggacucaagaguccgagugugccugcgugaacgggagcuguuucaccgucaugacagauggacccucggacggccaggcuucuuacaaaaucuuucggauugaaaaggguaaaaucgugaaguccguggagaugaaugccccuaacuaucauuacgaagagugcucauguuacccagauaguagcgagauuacuugcgucugccgcgacaauuggcacggggcgaacagaccguggguuuccuucaaucagaaccucgaauaucagauaggauacaucuguucuggcguguuuggcgauaaucccaggccuaacgacaaaaccgggagcugcggaccaguaucaaguaauggugcaaacggcgugaagggguucuccuuuaaguauggaaacggcgucuggauuggucggacaaaaagcaucucuucacgcaauggguucgagaugaucugggaucccaacggcuggaccggaacggacaauaacuuuaguauuaagcaagacauagugggcaucaaugaauggagcggguacuccggaucuuucguucagcauccugagcugacuggucuggauuguauucgaccaugcuucuggguggaacucaucagaggcaggcccaaagagaacacaauuuggaccucggggagcuccaucucauuuuguggagucaauagugacacugugggcuggucuuggccggauggugccgaguuaccuuucacaauagacaaguga

SEQ ID NO: 146021 - RNA, 1410 nt, Artificial Sequence; identical to SEQ ID NO: 145987
  derived and/or modified sequence opt3 from neuraminidase__InfluenzaA__AHC58482

SEQ ID NO: 146022 - RNA, 1410 nt, Artificial Sequence; identical to SEQ ID NO: 145991
  derived and/or modified sequence opt3 from neuraminidase__InfluenzaA__AHC58494

SEQ ID NO: 146023 - RNA, 1410 nt, Artificial Sequence
  derived and/or modified sequence opt3 from neuraminidase__InfluenzaA__AHC58518
augaaccccaaucagaagaucauuaccauaggcagcgugucccugacaaucucuacuauuugcuucuuuaugcaagucgccauccucauuacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaauuagcugaguacaggaauuggaguaagccucagugugacaucacaggguucgcaccauuuagcaaagauaacuccauacggcugucugccggaggugacauuugggugacccgcgagcccuaugucucgugcgauccugacaaguguuaccaauucgcgcuaggccaggggacgacucucaauaacgugcauucaaauaacaccguucgagaucguacaccauauagaacucugcuuaugaaugaacugggagugcccuuucacuugggcaccaagcaggucugcaucgcuuggagcaguuccucuugucaugacgguaaagccuggcuccacgugugcauuacaggggaugacaagaacgcaaccgccagcuucaucuacaauggaaaacugguagauuccguugugucauggaguaaggagauccugaggacgcaggaaagcgagugugucugcauuaacggcacuuguacaguggugaugaccgacggcucugcuuccgggaaagcagauacuaagauacucuuuaucgaggaaggaaagauuguccauacaucaaccuuaagcgguagugcccaacacguugaggaaugcucuugcuauccucgguacccaggcgugcgcuguguaugcagagacaacuggaaaggguccaauaggccgaucguggauauaaacauuaaggaccacagcaucgucucgucuuacguguguuccggacugguuggcgacacgccccggaaaaaugauucaaguagcuccucucauugccuugacccuaacaaugaggaaggugggcacggagugaagggcugggcuuucgaugacggcaacgaugucuggauggggcgcaccaucaaugagacaagccgauugggauaugagacuuuuaaagugauugaagguuggucaaacccaaagaguaaacugcagaucaauagacagguaauuguugacaggggcaaccgguccggguacagcggaauauucucuguggagggcaagucauguaucaaucguugcuuuuaugucgaacuaauucgcgguagaaaggaggaaaccgaggugcucuggacaaguaacagcaucgucguguucugugggacuuccggcaccuacggaacaggcucuuggcccgauggggccgaccugaaucuuaugccuaucuga

SEQ ID NO: 146024 - RNA, 1410 nt, Artificial Sequence; identical to SEQ ID NO: 145987
  derived and/or modified sequence opt3 from neuraminidase__InfluenzaA__AHC58530

SEQ ID NO: 146025 - RNA, 1410 nt, Artificial Sequence; identical to SEQ ID NO: 145987
  derived and/or modified sequence opt3 from neuraminidase__InfluenzaA__AHC58554

SEQ ID NO: 146026 - RNA, 1410 nt, Artificial Sequence; identical to SEQ ID NO: 145987
  derived and/or modified sequence opt3 from neuraminidase__InfluenzaA__AHC58566

SEQ ID NO: 146027 - RNA, 1410 nt, Artificial Sequence
  derived and/or modified sequence opt3 from neuraminidase__InfluenzaA__AHC58578
augaaccccaaucagaagaucauuaccauaggcagcgugucccugacagucucuacuaucugcuucuuuaugcaaauugccauccucauuacgaccguuacacuucacuucaaacaguacgaguuuuauucaccuccaaacaaucaggugaugcugugugaaccgacuaucauagagagaaacaucaccgaaauuguauacuugacaaauaccacuaucgagaaggaaauuugccccaaauuagcugaguauaggaacuggaguaagccucagugugacaucacaggguucgcaccauuuagcaaagauaauuccauacggcugucugccggaggugacauuugggugacccgcgagcccuacgucucgugcgauccugacaaguguuaucaauucgcgcuaggccaggggacgacucucaacaaugugcauucaaacaauaccguucgagaucguacaccauacagaacucugcuuaugaacgaacugggagugcccuuucacuugggcaccaagcaggucugcaucgcuuggagcaguuccucuugucaugacgguaaagccuggcuccacgugugcauuacaggggaugacaagaaugcaaccgccagcuucaucuauaacggaaggcugguagauuccguugugucauggaguaaagagauccugcggacgcaggaaagcgagugugucugcauuaauggcacuuguacaguggugaugaccgacggcucugcuuccgggaaggcagauacuaaaauacucuuuaucgaggaaggaaagauuguccauacaucaaccuuaagcgguagugcccaacacguugaggaaugcucuugcuacccucgcuacccaggcgugagauguguaugcagggacaacuggaagggguccaaccggccgaucguggauauaaauauuaaagaccacagcaucgucucgucuuauguguguuccggacugguuggcgacacgccccgcaagaacgauucaaguagcuccucucauugccuugacccuaauaacgaggaaggugggcacggagugaaaggcugggcuuucgaugacggcaaugaugucuggauggggcgaaccaucaacgagacaagcagauugggauacgagacuuuuaaggugauugaagguuggucaaauccaaaaaguaagcugcagaucaacaggcagguaauuguugaccggggcaaucguuccggguauagcggaauauucucuguggagggcaaaucauguaucaaccgcugcuuuuacgucgaacuaauuagagguaggaaggaggaaaccgaggugcucuggacaaguaauagcaucgucguguucugugggacuuccggcaccuauggaacaggcucuuggcccgauggggccgaccugaaccuuaugccuaucuga

SEQ ID NO: 146028 - RNA, 1410 nt, Artificial Sequence; identical to SEQ ID NO: 141534
  derived and/or modified sequence opt3 from neuraminidase__InfluenzaA__AHC58590

SEQ ID NO: 146029 - RNA, 1410 nt, Artificial Sequence; identical to SEQ ID NO: 146023
  derived and/or modified sequence opt3 from neuraminidase__InfluenzaA__AHC58602

SEQ ID NO: 146030 - RNA, 1410 nt, Artificial Sequence; identical to SEQ ID NO: 145987
  derived and/or modified sequence opt3 from neuraminidase__InfluenzaA__AHC58614

SEQ ID NO: 146031 - RNA, 1410 nt, Artificial Sequence; identical to SEQ ID NO: 145987
  derived and/or modified sequence opt3 from neuraminidase__InfluenzaA__AHC58626

SEQ ID NO: 146032 - RNA, 1410 nt, Artificial Sequence; identical to SEQ ID NO: 145987
  derived and/or modified sequence opt3 from neuraminidase__InfluenzaA__AHC58638

SEQ ID NO: 146033 - RNA, 1410 nt, Artificial Sequence; identical to SEQ ID NO: 145987
  derived and/or modified sequence opt3 from neuraminidase__InfluenzaA__AHC58650

SEQ ID NO: 146034 - RNA, 1410 nt, Artificial Sequence
  derived and/or modified sequence opt3 from neuraminidase__InfluenzaA__AHC58662
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaauaacacagugcgagaucguacuccauauagaacccugcuuaugaaugaacugggaguucccuuucacuugggcacaaaacaggugugcaucgcuuggagcaguuccucuugucaugacgguaaggccuggcuccacgucugcauuaccggggaugacaagaacgcaacggccagcuucaucuacaauggaaaacugguggauuccguaguuucauggaguaaggagauccugaggacucaggaaagcgagugugugugcauuaacggcacauguaccgucgugaugacugacggcucugcuuccgggaaagcagauacaaagauacucuuuaucgaggaaggaaagauugugcauaccucaacguuaagcgguagugcccaacacgucgaggaaugcucuugcuauccucgguacccaggcguucgcugugugugcagagacaacuggaaaggguccaauaggccgaucguagauauaaacauuaaggaccacagcaucgugucgucuuacgucuguuccggacuggugggcgacacuccccggaaaaaugauucaaguagcuccucucauugccuugacccuaacaaugaggaaggugggcacggaguuaagggcugggcuuucgaugacggcaacgauguguggauggggcgcacaaucaaugagacuagccgauugggauaugagaccuuuaaagucauugaagguuggucaaacccaaagaguaaacugcagaucaauagacaggugauuguagacaggggcaaccgguccggguacagcggaauauucucuguugagggcaagucauguaucaaucguugcuuuuauguggaacuaauucgcgguagaaaggaggaaacagagguccucuggaccaguaacagcaucguggucuucugugggaccuccggcacauacggaaccggcucuuggcccgauggggccgaccugaaucuuaugccuaucuga

SEQ ID NO: 146035 - RNA, 1410 nt, Artificial Sequence
  derived and/or modified sequence opt3 from neuraminidase__InfluenzaA__AHC58686
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguugugcugugugaaccgacuauaaucgagagaaauauuaccgaaaucguauauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucugggugacccgcgagccuuaugucucgugcgauccagacaaguguuaccaauucgcgcugggccaggggacgacucuaaauaacgugcauucaaauaacaccguucgagaucguacacccuauagaacucuccugaugaaugaacuuggagugccuuuucaccugggcaccaagcaggucugcauugcuuggagcaguuccucuugucaugacgguaaagccugguugcacgugugcaucacaggggaugacaagaacgcaaccgccagcuucaucuacaauggaaggcucguagauuccguugugucauggaguaaagagauucugcggacgcaggaaagcgagugugucugcauaaacggcacuuguacaguggugaugaccgacggcucugcuuccgggaaggcagauacuaaaauccuguuuauugaggaaggaaagaucguccauacaucaacccucagcgguagugcccaacacguugaggaaugcucuugcuauccacgcuacccgggcgugagauguguaugcagggacaacuggaagggguccaaucggcccauaguggauauuaacaucaaagaccacagcaucgucucgucuuacguguguuccggauuaguuggcgacacgccucgcaagaaugauucaaguagcuccucucauugccuggacccaaacaaugaggaaggugggcacggagugaaaggcugggcuuucgaugacggcaacgaugucuggauggggcgaaccauuaaugagacaagcagacuuggauaugagacuuuuaaggugaucgaagguuggucaaaccccaaaaguaaguugcagauuaauaggcagguaauaguugaccggggcgaucguuccggguacagcggaaucuucucuguggagggcaaaucauguauuaaccgcugcuuuuaugucgaacugaucagagguaggaaggaggaaaccgaggugcuauggacaaguaauagcaucgucguguucugugggacuuccggcaccuacggaacaggcucuuggccugacggggccgaucucaaccugaugccaauuuga

SEQ ID NO: 146036 - RNA, 1410 nt, Artificial Sequence
  derived and/or modified sequence opt3 from neuraminidase__InfluenzaA__AHC58698
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuugugcugucgugaugacagacggcucugcauccgggaaggccgauaccaaaauccucuuuauugaggaaggaaagaucgugcauacuucaacauuaagcgguagugcucaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacccccaggaagaaugauucaaguagcuccucucauugccuugacccuaacaaugaggaaggugggcacggaguuaaaggcugggccuucgaugacggcaacgauguguggauggggcgaacgauuaaugagaccagcagauugggauaugagacauuuaaggucaucgaagguuggucaaacccaaaaaguaagcugcagauuaaucgccaggugauaguagaccggggcaaccguuccggguacagcggaaucuucucuguugagggcaaaucauguauuaaucgcugcuuuuauguggaacuaaucagagguaggaaggaggaaacugagguccucuggaccaguaacagcaucguggucuucugugggacauccggcacuuacggaaccggcucuuggcccgauggggcggaccugaaucuuaugccuauuuga

SEQ ID NO: 146037 - RNA, 1410 nt, Artificial Sequence; identical to SEQ ID NO: 144938
  derived and/or modified sequence opt3 from neuraminidase__InfluenzaA__AHC58710

SEQ ID NO: 146038 - RNA, 1410 nt, Artificial Sequence; identical to SEQ ID NO: 144938
  derived and/or modified sequence opt3 from neuraminidase__InfluenzaA__AHC58722

SEQ ID NO: 146039 - RNA, 1410 nt, Artificial Sequence
  derived and/or modified sequence opt3 from neuraminidase__InfluenzaA__AHC58734
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaaacugguggacuccguaguuucauggaguaaggagauucugaggacgcaggaaagcgagugugugugcauaaacggcacuuguacagucgugaugaccgauggcucugcuuccgggaaagcagacacuaagauccucuuuauugaggaaggaaagaucgugcauacaucaaccuuaagcgguagugcccaacacgucgaggaaugcucuugcuauccucgguacccaggcauacgcuguguuugcagagauaauuggaaaggguccaacaggccgauuguggacaucaauaucaaggaucacagcauuguaucgucuuacguguguuccggacuggucggcgacacgccccggaaaaacgacucaaguagcuccucucauugccuugauccuaauaacgaggaaggugggcacggagugaagggcugggcuuucgacgauggcaaugacguuuggauggggcgcaccaucaacgagacaagccgauugggauaugagacuuuuaaagugauugaagguuggucaaauccaaagaguaaacugcagauaaacagacaggucaucguggauaggggcaaucgguccggguacagcggaauuuucucuguagagggcaagucauguaucaaccguugcuuuuauguugaacuaauccgcgguagaaaggaggaaaccgaggugcucuggacaaguaauagcauugucguguucugugggacuuccggcaccuacggaacaggcucuuggcccgacggggccgaucugaaccuuaugccuauauga

SEQ ID NO: 146040 - RNA, 1410 nt, Artificial Sequence; identical to SEQ ID NO: 145987
  derived and/or modified sequence opt3 from neuraminidase__InfluenzaA__AHC58746

SEQ ID NO: 146041 - RNA, 1410 nt, Artificial Sequence; identical to SEQ ID NO: 145991
  derived and/or modified sequence opt3 from neuraminidase__InfluenzaA__AHC58758

SEQ ID NO: 146042 - RNA, 1410 nt, Artificial Sequence; identical to SEQ ID NO: 145987
  derived and/or modified sequence opt3 from neuraminidase__InfluenzaA__AHC58770

SEQ ID NO: 146043 - RNA, 1410 nt, Artificial Sequence; identical to SEQ ID NO: 141534
  derived and/or modified sequence opt3 from neuraminidase__InfluenzaA__AHC58782

SEQ ID NO: 146044 - RNA, 1410 nt, Artificial Sequence; identical to SEQ ID NO: 145987
  derived and/or modified sequence opt3 from neuraminidase__InfluenzaA__AHC58806

SEQ ID NO: 146045 - RNA, 1410 nt, Artificial Sequence
  derived and/or modified sequence opt3 from neuraminidase__InfluenzaA__AHC58818
augaaccccaaucagaagaucauuaccauaggcagcgugucccugacaaucucuacuauuugcuucuuuauccagauugccauccucauaacgaccgucacacuucacuucaaacaguacgaguuuaacucaccuccaaauaaccagguuaugcugugugaaccgacuaucauugagagaaauaucaccgaaauuguguauuugacaaacaccacuaucgagaaggaaauaugccccaaauuagcugaguacaggaauuggaguaagccucagugugacauuacaggguucgcaccauuuagcaaagauaacuccauccggcugucugccggaggugacauuuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcaucgcuuggagcaguuccucuugucaugacgguaaggccuggcuccacgucugcaucacaggggaugacaagaacgcaaccgccagcuucauuuacaauggaaggcugguggauuccguaguuucauggaguaaagagauacugcggacgcaggaaagcgagugugugugcaucaacggcacuuguacagucgugaugaccgacggcucugcuuccgggaaggcagauacuaaaauucucuuuaucgaggaaggaaagauagugcauacaucaaccuuaagcgguagugcccaacacgucgaggaaugcucuugcuauccucgcuacccaggcguuagaugugugugcagggacaacuggaagggguccaaucggccgauuguagauaucaacaucaaagaccacagcauugugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccaucaaugagacaagcagauugggauaugagacuuuuaaggucauugaagguuggucaaacccaaaaaguaagcugcagauaaauaggcaagugaucguagaccggggcaaccguuccggguacagcggaauuuucucuguugagggcaaaucauguaucaaucgcugcuuuuauguggaacuaaucagagguaggaaggaggaaaccgagguccucuggacaaguaacagcauuguggucuucugugggacuuccggcaccuacggaacaggcucuuggcccgauggggccgaccugaaucuuaugccuauauga

SEQ ID NO: 146046 - RNA, 1410 nt, Artificial Sequence; identical to SEQ ID NO: 146036
  derived and/or modified sequence opt3 from neuraminidase__InfluenzaA__AHC58830

SEQ ID NO: 146047 - RNA, 1410 nt, Artificial Sequence; identical to SEQ ID NO: 145987
  derived and/or modified sequence opt3 from neuraminidase__InfluenzaA__AHC58842

SEQ ID NO: 146048 - RNA, 1410 nt, Artificial Sequence
  derived and/or modified sequence opt3 from neuraminidase__InfluenzaA__AHC58866
augaaccccaaucagaagaucauuaccauaggcagcgugucccugacaaucucuacuauuugcuucuuuaugcagaucgccauucucaucacgaccgucacacuucacuucaaacagugugaguuuaacucaccuccaaauaacagaguuaugcugugcgaaccgacuauaaucgagaggaauauuaccgaaaucguguacuugacaaacaccacuauugagaaggaaaucugucccaaauuagcugaguaucggaauuggaguaagccucagugcgacauaacaggguucgcaccauuuagcaaagauaacuccauucgccugucugccggaggugacaucuggguaacccgagagcccuacgugucgugugauccuaauaagugcuaucaguucgcgcuaggccaagggacgacucucaacaauguccauucaaacaauaccgugcgugacagaacaccauacaggacucugcuuaugaacgaacugggaguucccuuucacuugggcaccaaacagguguguauugcuuggagcaguuccucuugccaugaugguaaggccuggcuccacgucuguaucacaggggacgauaagaaugcaaccgccagcuucaucuauaacggaaaacugguggacuccguaguuucauggaguaaggagauucugcggacgcaggaaagcgagugcguguguauaaacggcacuugcacagucgugaugaccgauggcucugcuuccgggaaagcagacacuaagauccucuuuauugaggaaggaaagaucgugcauacaucaaccuuaagcgguagugcccagcacgucgaggaaugcucuuguuacccucgcuauccaggcguuagaugcguguguagggauaauuggaaaggguccaaccggccgauaguagacauuaauaucaaggaucacagcaucgugucgucuuacgucugcuccggacuggugggcgacacgccccgcaaaaacgacucaaguagcuccucucauugucuugauccuaauaacgaggaaggugggcacggaguuaagggcugggcuuucgacgauggcaaugacguguggauggggcgaaccauuaacgagacaagcagauugggauacgagacuuuuaaagucaucgaagguuggucaaauccaaagaguaaacugcaaauuaacaggcaagugauaguagaucggggcaaucguuccggguauagcggaaucuucucuguugagggcaagucaugcauuaaccgcuguuuuuacguggaacuaaucagagguaggaaggaggaaaccgggguccucuggacaaguaauagcaucguggucuucugcggcacuuccggaaccuauggcacagggucuuggcccgacggagccgaucugaaccuuaugccuauuuga

SEQ ID NO: 146049 - RNA, 1410 nt, Artificial Sequence; identical to SEQ ID NO: 146036
  derived and/or modified sequence opt3 from neuraminidase__InfluenzaA__AHC58878

SEQ ID NO: 146050 - RNA, 1410 nt, Artificial Sequence; identical to SEQ ID NO: 145987
  derived and/or modified sequence opt3 from neuraminidase__InfluenzaA__AHC58890

SEQ ID NO: 146051 - RNA, 1410 nt, Artificial Sequence; identical to SEQ ID NO: 145991
  derived and/or modified sequence opt3 from neuraminidase__InfluenzaA__AHC58902

SEQ ID NO: 146052 - RNA, 1410 nt, Artificial Sequence; identical to SEQ ID NO: 145987
  derived and/or modified sequence opt3 from neuraminidase__InfluenzaA__AHC58996

SEQ ID NO: 146053 - RNA, 1410 nt, Artificial Sequence; identical to SEQ ID NO: 145987
  derived and/or modified sequence opt3 from neuraminidase__InfluenzaA__AHC59008

SEQ ID NO: 146054 - RNA, 1410 nt, Artificial Sequence; identical to SEQ ID NO: 145991
  derived and/or modified sequence opt3 from neuraminidase__InfluenzaA__AHC59020

SEQ ID NO: 146055 - RNA, 1410 nt, Artificial Sequence
  derived and/or modified sequence opt3 from neuraminidase__InfluenzaA__AHC59032
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaaacugguggacuccguaguuucauggaguaaggagauucugaggacgcaggaaagcgagugugugugcauaaacggcacuuguacagucgugaugaccgauggcucugcuuccgggaaagcagacacuaagauccucuuuauugaggaaggaaagaucgugcauacaucaaccuuaagcgguagugcccaacacgucgaggaaugcucuugcuauccucgguacccauccguucgcugugugugcagagauaauuggaaaggcagcaacaggccgauaguagacauuaauaucaaggaucacucgaucgugucuuccuacgucuguucagggcuggugggagacacgccccggaaaaacgacaguagcuccucuagccauugccuugauccuaauaacgaggaaggcggucacgggguuaagggaugggcuuucgacgauggcaaugacguguggaugggccgcaccauuaacgagacaucacgauugggguaugagacuuuuaaagucaucgaaggauggaguaauccaaaguccaaacugcagauuaacagacaggugauaguagauagggguaaucggagcggcuacucugggaucuucucaguugagggaaagaguuguauuaaccguugcuuuuauguggaacuaauccgcggcagaaaggaggaaaccgagguccucuggacaagcaauuccaucguggucuucugugguacuucugggaccuacggcacaggaucguggcccgacggcgccgaucugaaccuuaugccuauuuga

SEQ ID NO: 146056 - RNA, 1410 nt, Artificial Sequence; identical to SEQ ID NO: 146023
  derived and/or modified sequence opt3 from neuraminidase__InfluenzaA__AHC59044

SEQ ID NO: 146057 - RNA, 1410 nt, Artificial Sequence; identical to SEQ ID NO: 141534
  derived and/or modified sequence opt3 from neuraminidase__InfluenzaA__AHC59056

SEQ ID NO: 146058 - RNA, 1410 nt, Artificial Sequence; identical to SEQ ID NO: 145987
  derived and/or modified sequence opt3 from neuraminidase__InfluenzaA__AHC59068

SEQ ID NO: 146059 - RNA, 1410 nt, Artificial Sequence; identical to SEQ ID NO: 145987
  derived and/or modified sequence opt3 from neuraminidase__InfluenzaA__AHC59080

SEQ ID NO: 146060 - RNA, 1410 nt, Artificial Sequence
  derived and/or modified sequence opt3 from neuraminidase__InfluenzaA__AHC59092
augaaccccaaucagaagaucauuaccauaggcagcgugucccugacaaucucuacuauuugcuucuuuaugcaaaucgccauucucgucacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaaccugcugaguacaggaauuggaguaagccacagugugacaucacaggguucgcacccuuuagcaaagauaacuccauacgguuaucugccggaggugacauuugggugacccgcgagccuuaugucucgugcgauccagacaaguguuaccaauucgcgcugggccaggggacgacucuaaauaacgugcauucaaauaacaccguucgagaucguacacccuauagaacucuccugaugaaugaacuuggagugccuuuucaccugggcaccaagcaggucugcaucgcuuggagcaguuccucuugucaugacgguaaagccugguugcacgugugcauuacaggggaugacaagaacgcaaccgccagcuucaucuacaauggaaggcucguagauuccguugugucauggaguaaagagauccugcggacgcaggaaagcgagugugucugcauuaacggcacuuguacaguggugaugaccgacggcucugcuuccgggaaggcagauacuaaaauacuguuuaucgaggaaggaaagauuguccauacaucaacccucagcgguagugcccaacacguugaggaaugcucuugcuauccacgcuacccgggcgugagauguguaugcagggacaacuggaagggguccaaucggcccaucguggauauaaacauuaaagaccacagcaucgucucgucuuacguguguuccggauuaguuggcgacacgccucgcaagaaugauucaaguagcuccggucauugccuggacccaaacaaugaggaagggggacacggcgugaaaggcugggcuuucgaugacgggaacgaugucuggaugggacgaaccaucaaugagacaucuagacuugguuaugagacuuuuaaggugauugaaggcuggagcaaccccaaaucaaaguugcagaucaauaggcagguaauuguugaccguggggaucggaguggauacuccggcauauucagcguggaggguaaaucuuguaucaaccgcugcuuuuaugucgaacugauuagagggaggaaggaggaaaccgaggugcuauggacaucaaauaguaucgucguguucuguggcacuagcggaaccuacggcacaggguccuggccugacggagccgaucucaaccugaugccaaucuga

SEQ ID NO: 146061 - RNA, 1410 nt, Artificial Sequence
  derived and/or modified sequence opt3 from neuraminidase__InfluenzaA__AHC59104
augaaccccaaucagaagaucauuaccauaggcagcgugucccugacaaucucuacuauuugcuucuuuaugcagaucgccauucucaucacgaccgucacacuucacuucaaacaguacgaguuuuauucaccuccaaacaaucagguuaugcugugugaaccgacuauaaucaagagaaacauuaccgagaucguguacuugacaaauaccacuauugaaaaagagaucugccccaaguuagcugaauauaggaacuggaguaaaccucagugugacauaacaggguucgcaccauuuagcaaggauaauuccauucggcugucugccggaggugacaucuggguaacccgcgagcccuacgugucgugcgauccugacaaguguuaucaauucgcgcuaggccaggggacgacucucaacaauguccauucaaacaauaccgugcgagaucguacaccauacagaacucugcuuaugaacgagcugggaguucccuuucacuugggcaccaaacaggugugcauugcuuggagcaguuccucuugucaugacgguaaggccuggcuccacgucugcaucacaggggaugacaaaaaugcaaccgccagcuucaucuauaacggaaggcugguggauuccguaguuucauggaguaaggaaauucugcggacgcaggagagcgaaugugugugcauaaauggcacuuguacagucgugaugaccgacggcucugcuuccgggaaagcagauacuaagauccucuuuauugaggagggaaagaucgugcauacaucaaccuuaagcgguagugcccaacacgucgaagagugcucuugcuacccucgcuacccaggcguuagaugugugugcagggacaacuggaaaggguccaaccggccgauaguagauauuaauaucaaggaccacagcaucgugucgucuuaugucuguuccggacuggugggcgacacgccccgcaaaaacgauucaaguagcuccucucauugccuugacccuaauaacgaagagggugggcacggaguuaagggcugggcuuucgaugacggcaaugauguguggauggggcgaaccauuaacgaaacaagcagauugggauacgagacuuuuaaagucaucgaggguuggucaaauccaaagaguaaacugcagauuaacaggcaagugauaguagaccggggcaaucguuccggguauagcggaaucuucucuguugaaggcaagucauguauuaaccgcugcuuuuacguggagcuaaucagagguaggaaggaagagaccgaaguccucuggacaaguaauagcaucguggucuucugugggacuuccggcaccuauggaacaggcucuuggcccgauggggccgaccugaaccuuaugccuauuuga

SEQ ID NO: 146062 - RNA, 1410 nt, Artificial Sequence
  derived and/or modified sequence opt3 from neuraminidase__InfluenzaA__AHC59116
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaaacugguggacuccguaguuucauggaguaaggagauucugaggacgcaggaaagcgagugugugugcauaaacggcacuuguacagucgugaugaccgauggcucugcuuccgggaaagcagacacuaagauccucuuuauugaggaaggaaagaucgugcauacaucaaccuuaagcgguagugcccaacacgucgaggaaugcucuugcuauccucgguacccaggcguucgcugugugugcagagauaauuggaaaggguccaacaggccgauaguagacauuaauaucaaggaucacagcaucgugucgucuuacgucuguuccggacuggugggcgacacgccccggaaaaacgacucaaguagcuccucucauugccuugauccuaauaacgaggaaggugggcacggaguuaagggcugggcuuucgacgauggcaaugacguguggauggggcgcaccauuaacgagacaagccgauugggauaugagacuuuuaaagucaucgaagguuggucaaauccaaagaguaaacugcagauuaacagacaggugauaguagauaggggcaaucgguccggguacagcggaaucuucucuguugagggcaagucauguauuaaccguugcuuuuauguggaacuaauccgcgguagagaggaagagaccgagguccucuggacaaguaauagcaucguggucuucugugggacuuccggcaccuacggaacaggcucuuggcccgacggggccgaucugaaccuuaugccuauuuga

SEQ ID NO: 146063 - RNA, 1410 nt, Artificial Sequence
  derived and/or modified sequence opt3 from neuraminidase__InfluenzaA__AHC59128
augaaccccaaucagaagaucauuaccauaggcagcgugucccugacaaucucuacuauuugcuucuuuaugcaaaucgccauucucaucacgaccgucacacuucacuucaaacaguacgaguuuuauucaccuccaaacaaucagguuaugcugugugaaccgacuauaauggagagaaacaucaccgaaauuguguacuugacaaauaccacuaucgagaaggaaauuugccccaaauuagcugaguauaggaacuggaguaagccucagugugacaucacaggguucgcaccauuuagcaaagauaauuccauacggcugucugccggaggugacauuuggguaacccgcgagcccuacgugucgugcgauccugacaaguguuaucaauucgcgcuaggccaggggacgacucucaacaauguccauucaaacaauaccgugcgagaucguacaccauacagaacucugcuuaugaacgaacugggaguucccuuucacuugggcaccaaacaggugugcaucgcuuggagcaguuccucuugucaugacgguaaggccuggcuccacgucugcgugacaggggaugacaagaaugcaaccgccagcuucauuuauaacggaaggcugguagauuccguugugucauggaguaaagagauccugcggacgcaggaaagcgagugugucugcaucaauggcacuuguacaguggugaugaccgacggcucugcuuccgggaaggcagauacuaaaauucucuuuauagaggaaggaaagaucguccauacaucaaccuuaagcgguagugcccaacacguugaggaaugcucuugcuacccucgcuacccaggcgugagauguguaugcagggacaacuggaagggguccaaccggccgauuguggauaucaauauaaaagaccacagcauugucucgucuuauguguguuccggacugguuggcgacacgccccgcaagaacgauucaaguagcuccucucauugccuugacccuaauaacgaggaaggugggcacggagugaaaggcugggcuuucgaugacggcaaugaugucuggauggggcgaaccaucaacgagacaagcagauugggauacgagacuuuuaaggugaucgaagguuggucaaauccaaaaaguaagcugcagauuaacaggcagguaaucguugaccggggcaaucguuccggguauagcggaauuuucucuguggagggcaaaucauguauaaaccgcugcuuuuacgucgaacuaaucagagguaggaaggaggaaaccgaggugcucuggacaaguaauagcauugucguguucugugggacuuccggcaccuauggaacaggcucuuggcccgauggggccgaccugaaccuuaugccuaucuga

SEQ ID NO: 146064 - RNA, 1410 nt, Artificial Sequence
  derived and/or modified sequence opt3 from neuraminidase__InfluenzaA__AHC59152
augaaccccaaucagaagaucauuaccauaggcagcgugucccugacaaucucuacuauuugcuucuuuaugcaagucgccauccucauuacgaccguuacacuucacuucaaacaguacgaguuuaacucaccuccaaauaaccaggugaugcugugugaaccgacuaucauagagagaaauaucaccgaaauuuuguauuuaacaaacaccacuaucgagaaggaaauuugccccaaacuggcugaguacaggaauuggaguaagccucagugugacaucacaggguucgcaccauuuagcaaagauaacuccauacggcuaucugccggaggugacauuuggguaacccgcgagcccuaugugucgugcgauccugacaaguguuaccaauucgcgcucggccaggggacgacucugaauaacguccauucaaauaacaccgugcgagaucguacaccauauagaacucuucugaugaaugaauugggaguucccuuucaccucggcaccaaacaggugugcaucgcuuggagcaguuccucuugucaugacgguaaggccuggcugcacgucugcauuacaggggaugacaagaacgcaaccgccagcuucaucuacaauggaaaacugguggauuccguaguuucauggaguaaggagauccucaggacgcaggaaagcgagugugugugcauuaacggcacuuguacagucgugaugaccgacggcucugcuuccgggaaagcagauacuaagauauuauuuaucgaggaaggaaagauugugcauacaucaacccugagcgguagugcccaacacgucgaggaaugcucuugcuauccucgguacccaggcguucgcugugugugcagagacaacuggaaaggguccaauaggccgaucguagauauaaacauuaaggaccacagcaucgugucgucuuacgucuguuccggacuugugggcgacacgccccggaaaaaugauucaaguagcuccucucauugcuuggacccuaacaaugaggaaggugggcacggaguuaagggcugggcuuucgaugacggcaacgauguguggauggggcgcaccaucaaugagacaagccgacugggauaugagacuuuuaaagucauugaagguuggucaaacccaaagaguaaacuacagaucaauagacaggugauuguagacaggggcaaccgguccggguacagcggaauauucucuguugagggcaagucauguaucaaucguugcuuuuauguggaacucauucgcgguagaaaggaggaaaccgagguccuguggacaaguaacagcaucguggucuucugugggacuuccggcaccuacggaacaggcucuuggcccgauggggccgaccuuaaucugaugccuaucuga

SEQ ID NO: 146065 - RNA, 1410 nt, Artificial Sequence
  derived and/or modified sequence opt3 from neuraminidase__InfluenzaA__AHC59188
augaaccccaaucagaagaucauuaccauaggcagcgugucccugacaaucucuacuauuugcuucuuuaugcaaaucgccauucucaucacgaccgucacacuucacuucaaacaguacgaguuuaacccuccaccgaauaaccagguugugcugugugaacccacuauaaucgagagaaauauuaccgaaaucguauauuugacaaacaccacuauugagaaggaaaucugcccuaaauuagcugaguacaggaauuggucaaagccacagugugacauaacaggguucgcacccuuuaguaaagauaacagcauucggcuguccgccggaggugacaucugggugacccgcgagccuuaugucucuugcgauccagacaaguguuaccaauucgcgcuaggccaggggacgacucucaauaacgugcauucgaauaacaccguucgagaucguacacccuauagaacucugcuuaugaaugaacugggagugccuuuucacuugggcaccaagcaggucugcauugcuuggucaagcaguuccugucaugacgguaaagccuggcuccacgugugcaucacaggggaugacaagaacgcaaccgccucuuucaucuacaauggaaggcugguagauagcguuguguccuggucaaaagagauucugcggacgcaggaaagugagugugucugcauaaacggcacuuguacaguggugaugaccgacggcagcgcuucugggaaggcagauacuaaaauccucuuuauugaggaaggaaagaucguccauacauccaccuuaucagguagcgcccaacacguugaggaaugcaguugcuauccacgcuacccgggcgugagauguguaugcagggacaacuggaaggggucuaaucggcccauaguggauauuaacaucaaagaccacuccaucgucagcucguacguguguucuggacugguuggcgacacgccucgcaagaaugauuccucaaguagcucccauugccuugacccaaacaaugaggaaggugggcacggagugaaaggcugggcuuucgaugacggcaacgaugucuggauggggcgaaccauuaaugagacaucuagauugggauaugagacuuuuaaggugaucgaagguuggagcaaccccaaaucaaagcugcagauuaauaggcagguaauaguugaccggggcgaucguaguggguacuccggaaucuucagcguggagggcaaaucuuguauuaaccgcugcuuuuaugucgaacuaaucagagguaggaaggaggaaaccgaggugcucuggacaucaaauaguaucgucguguucugugggacuagcggcaccuacggaacaggcuccuggccugacggggccgaucugaaccuuaugccaauuuga

SEQ ID NO: 146066 - RNA, 1410 nt, Artificial Sequence; identical to SEQ ID NO: 141534
  derived and/or modified sequence opt3 from neuraminidase__InfluenzaA__AHC59200

SEQ ID NO: 146067 - RNA, 1410 nt, Artificial Sequence
  derived and/or modified sequence opt3 from neuraminidase__InfluenzaA__AHC59212
augaaccccaaucagaagaucauuaccauaggcagcgugucccugacaaucucuacuauuugcuucuuuaugcaaaucgccacgcucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaauaacacagugcgagaucguacuccauauagaacccugcuuaugaaugaacugggaguucccuuucacuugggcacaaaacaggugugcaucgcuuggagcaguuccucuugucaugacgguaaggccuggcuccacgucugcauuaccggggaugacaagaacgcaacggccagcuucaucuacaauggaaggcugguggauuccguaguuucauggaguaaagagauccugcggacucaggaaagcgagugugugugcauuaacggcacauguaccgucgugaugacugacggcucugcuuccgggaaggcagauacaaaaauacucuuuaucgaggaaggaaagauugugcauaccucaacguuaagcgguagugcccaacacgucgaggaaugcucuugcuauccucgcuacccaggcguuagaugugugugcagggacaacuggaagggguccaaucggccgaucguagauauaaacauuaaagaccacagcaucgugucgucuuacgucuguuccggacuggugggcgacacccccaggaagaaugauucaaguagcuccucucauugccuugacccuaacaaugaggaaggugggcacggaguuaaaggcugggcuuucgaugacggcaacgauguguggauggggcgaacaaucaaugagacuagcagauugggauaugagaccuuuaaggucauugaagguuggucaaacccaaaaaguaagcugcagaucaaucgccaggugauuguagaccggggcgaucguuccggguacagcggaauauucucuguugagggcaaaucauguaucaaccgcugcuuuuauguggaacuaauuagagguaggaaggaggaaacagagguccucuggaccaguaauagcaucguggucuucugugggacuuccggcacauacggaaccggcucuuggcccgacggggccgaucugaaccuuaugccuaucuga

SEQ ID NO: 146068 - RNA, 1410 nt, Artificial Sequence; identical to SEQ ID NO: 145991
  derived and/or modified sequence opt3 from neuraminidase__InfluenzaA__AHC59224

SEQ ID NO: 146069 - RNA, 1410 nt, Artificial Sequence
  derived and/or modified sequence opt3 from neuraminidase__InfluenzaA__AHC59236
augaaccccaaucagaagaucauuaccauaggcagcgugucccugacaaucucuacuauuugcuucuuuaugcaaaucgccauucucaucacgaccgucacacuucacuucaaacaguacgaguuuuauucaccuccaaacaaucagguuaugcugugugaaccgacuauaaucgagagaaacauuaccgaaaucguguacuugacaaauaccacuauugagaaggaaaucugccccaaauuagcugaguauaggaacuggaguaagccucagugugacauaacaggguucgcaccauuuagcaaagauaauuccauucggcugucugccggaggugacaucuggguaacccgcgagcccuacgugucgugcgauccugacaaguguuaucaauucgcgcuaggccaggggacgacucucaacaauguccauucaaacaauaccgugcacgaucgaacaccauaccguacucugcuuaugaacgaacugggaguucccuuucauuugggcaccaaacaggugugcauugcuuggagcaguuccucuugucacgacgguaaggccuggcuccaugucugcaucacaggggaugacaagaaugcaaccgccagcuucaucuauaacggaagacugguggauuccguaguuucauggaguaaagagauucugaggacgcaggaaagcgagugugugugcauaaauggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuacccucgguacccaggcguucgcugugugugcagagacaacuggaagggguccaacaggccgauaguagauauuaauaucaaagaccauagcaucgugucgucuuaugucuguuccggacuggugggcgacacgccccggaagaacgauucaaguagcuccucucacugccuugacccuaauaacgaggaaggugggcauggaguuaaaggcugggcuuucgaugacggcaaugauguguggauggggcgcaccauuaacgagacaagccgauugggauacgagacuuuuaaggucaucgaagguuggucaaauccaaaaaguaagcugcagauuaacagacaggugauaguagacaggggcaaucgguccggguauagcggaaucuucucuguugagggcaaaucauguauuaaccguugcuuuuacguggaacuaauccgcgguagaaaggaggaaaccgagguccucuggacaaguaauagcaucguggucuucugugggacuuccggcaccuauggaacaggcucuuggcccgauggggccgaccugaaccuuaugccuauuuga

SEQ ID NO: 146070 - RNA, 1410 nt, Artificial Sequence; identical to SEQ ID NO: 145991
  derived and/or modified sequence opt3 from neuraminidase__InfluenzaA__AHC59260

SEQ ID NO: 146071 - RNA, 1410 nt, Artificial Sequence; identical to SEQ ID NO: 145987
  derived and/or modified sequence opt3 from neuraminidase__InfluenzaA__AHC59272

SEQ ID NO: 146072 - RNA, 1410 nt, Artificial Sequence; identical to SEQ ID NO: 145991
  derived and/or modified sequence opt3 from neuraminidase__InfluenzaA__AHC59284

SEQ ID NO: 146073 - RNA, 1410 nt, Artificial Sequence
  derived and/or modified sequence opt3 from neuraminidase__InfluenzaA__AHC59296
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaaacugguggacuccguaguuucauggaguaaggagauucugaggacgcaggaaagcgagugugugugcauaaacggcacuuguacagucgugaugaccgauggcucugcuuccgggaaagcagacacuaagauccucuuuauugaggaaggaaagaucgugcauacaucaaccuuaagcgguagugcccaacacgucgaggaaugcucuugcuauccucgguacccaggcguucgcugugugugcagagauaauuggaaaggguccaacaggccgauaguagacauuaagaucaaagaucacagcaucgugucgucuuacgucuguuccggacuggugggcgacacgccccggaagaaugacucaaguagcuccucucauugccuugauccuaacaaugaggaaggugggcacggaguuaaaggcugggcuuucgacgauggcaacgacguguggauggggcgcaccauuaaugagacaagccgauugggauaugagacuuuuaaggucaucgaagguuggucaaacccaaaaaguaagcugcagauuaauagacaggugauaguagauaggggcaaccgguccggguacagcggaaucuucucuguugagggcaagucauguauuaaucguugcuuuuauguggaacuaauccgcgguagaaaagaggaaaccgagguccucuggacaaguaacagcaucguggucuucugugggacuuccggcaccuacggaacaggcucuuggcccgacggggccgaucugaaucuuaugccuauuuga

SEQ ID NO: 146074 - RNA, 1410 nt, Artificial Sequence
  derived and/or modified sequence opt3 from neuraminidase__InfluenzaA__AHC59308
augaaccccaaucagaagaucauuaccauaggcagcgugucccugacaaucucuacuauuugcuucuuuaugcaaaucgccauucucaucacgaccgucacacuucacuucaaacaguacgaguuuaacccuccaccgaauaaccagguuaugcugugugaacccacuauaaucgagagaaauauuaccgaaaucguguauuugacaaacaccacuauugagaaggaaaucugcccuaaauuagcugaguacaggaauuggucaaagccacagugugacauaacaggguucgcacccuuuaguaaagauaacagcauucggcuguccgccggaggugacaucuggguaacccgcgagccuuaugugucuugcgauccaaauaaguguuaccaauucgcgcuaggccaggggacgacucucaacaauguccauucgaacaauaccgugcgagaccguacacccuauagaacucugcuuaugaacgaacugggaguuccuuuucacuugggcaccaaacaggugugcauugcuuggucaagcaguuccugucaugaugguaaggccuggcuccacgucugcaucacaggggacgauaagaaugcaaccgccucuuucaucuacaacggaaaacugguggacagcguaguuuccuggucaaaggagauucugaggacgcaggaaagugagugugugugcauaaacggcacuuguacagucgugaugaccgauggcagcgcuucugggaaagcagacacuaagauccucuuuauugaggaaggaaagaucgugcauacauccaccuuaucagguagcgcccaacacgucgaggaaugcaguugcuauccacgguacccgggcguucgcugugugugcagagauaauuggaaagggucuaacaggcccauaguagacauuaauaucaaggaucacuccaucgugagcucguacgucuguucuggacuggugggcgacacgccucggaaaaacgacuccucaaguagcucccauugccuugauccaaauaacgaggaaggugggcacggaguuaagggcugggcuuucgacgauggcaaugacguguggauggggcgcaccauuaacgagacaucucgauugggauaugagacuuuuaaagucaucgaagguuggagcaaucccaagucaaaacugcagauuaacagacaggugaugguagauaggggcaaucggaguggguacuccggaauauucagcguugagggcaagucuuguaucaaccguugcuuuuauguggaacuaauucgcgguagaaaggaggaaaccgagguccucuggacaucaaauaguaucguggucuucugugggacuagcggcaccuacggaacaggcuccuggccugacggggccgaucugaaccuuaugccaaucuga

SEQ ID NO: 146075 - RNA, 1410 nt, Artificial Sequence; identical to SEQ ID NO: 145899
  derived and/or modified sequence opt3 from neuraminidase__InfluenzaA__AHC59320

SEQ ID NO: 146076 - RNA, 1410 nt, Artificial Sequence; identical to SEQ ID NO: 144162
  derived and/or modified sequence opt3 from neuraminidase__InfluenzaA__AHC59332

SEQ ID NO: 146077 - RNA, 1410 nt, Artificial Sequence; identical to SEQ ID NO: 146035
  derived and/or modified sequence opt3 from neuraminidase__InfluenzaA__AHC59344

SEQ ID NO: 146078 - RNA, 1410 nt, Artificial Sequence
  derived and/or modified sequence opt3 from neuraminidase__InfluenzaA__AHC59368
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaaacugguggacuccguaguuucauggaguaaggagauucugaggacgcaggaaagcgagugugugugcauaaacggcacuuguacagucgugaugaccgauggcucugcuuccgggaaagcagacacuaagauccucuuuauugaggaaggaaagaucgugcauacaucaaccuuaagcgguagugcccaacacgucgaggaaugcucuugcuauccucgguacccaggcguucgcugugugugcagagauaauuggaaaggguccaacaggccgauaguagacauuaauaucaaggaucacagcaucgugucgucuuacgucuguuccggacuggugggcgacacgccccggaaaaacgacucaaguagcuccucucauugccuugauccuaauaacgaggaaggugggcacggaguuaagggcugggcuuucgacgauggcaaugacguguggauggggcgcaccauugaugagacaagccgauugggauaugagacuuuuaaagucaucgaagguuggucaaacccaaagaguaaacugcagauuaauagacaggugauaguagacaggggcaaccgguccggguacagcggaaucuucucuguugagggcaagucauguauuaaucguugcuuuuauguggaacuaauccgcgguagaaaggaggaaaccgagguccucuggacaaguaacagcaucguggucuucugugggacuuccggcaccuacggaacaggcucuuggcccgauggggccgaccugaaucuuaugccuauuuga

SEQ ID NO: 146079 - RNA, 1410 nt, Artificial Sequence; identical to SEQ ID NO: 145987
  derived and/or modified sequence opt3 from neuraminidase__InfluenzaA__AHC59380

SEQ ID NO: 146080 - RNA, 1410 nt, Artificial Sequence; identical to SEQ ID NO: 144938
  derived and/or modified sequence opt3 from neuraminidase__InfluenzaA__AHC59392

SEQ ID NO: 146081 - RNA, 1410 nt, Artificial Sequence; identical to SEQ ID NO: 146023
  derived and/or modified sequence opt3 from neuraminidase__InfluenzaA__AHC59404

SEQ ID NO: 146082 - RNA, 1410 nt, Artificial Sequence; identical to SEQ ID NO: 145991
  derived and/or modified sequence opt3 from neuraminidase__InfluenzaA__AHC59416

SEQ ID NO: 146083 - RNA, 1410 nt, Artificial Sequence
  derived and/or modified sequence opt3 from neuraminidase__InfluenzaA__AHC59428
augaaccccaaucagaagaucauuaccauaggcagcgugucccugacaaucucuacuauuugcuucuuuaugcaaaucgccauucucaucacgaccgucacacuucacuucaaacaguacgaguuuuauucaccuccaaacaaucagguuaugcugugugaaccgacuauaaucgagagaaacauuaccgaaaucguguacuugacaaauaccacuauugagaaggaaaucugccccaaauuagcugaguauaggaacuggaguaagccucagugugacauaacaggguucgcaccauuuagcaaagauaauuccauucggcugucugccggaggugacaucuggguaacccgcgagcccuacgugucgugcgauccugaccgauguuaucaauucgcgcuaggccaggggacgacucucaacaauguccauucaaacaauaccgugcgugauagaacaccauacaggacucugcuuaugaacgaacugggaguucccuuucacuugggcaccaaacaggugugcauugcuuggagcaguuccucuugucaugacgguaaggccuggcuccacgucugcaucacaggggaugacaagaaugcaaccgccagcuucaucuauaacggacggcugguggauuccguaguuucauggaguaaggagauucugcgcacgcaggaaagcgagugugugugcauaaauggcacuuguacagucgugaugaccgacggcucugcuuccgggaaagcagauacuaagauccucuuuauugaggaaggaaaaaucgugcauacaucaaccuuaagcgguagugcccaacacgucgaggaaugcucuugcuacccuagauacccaggcguuaggugugugugccgggacaacuggaagggguccaaccgcccgauaguagauauuaauaucaaggaccacagcaucgugucgucuuaugucuguuccggacuggugggcgacacgccccggaaaaacgauucaaguagcuccucucauugccuugacccuaauaacgaggaaggugggcacggaguuaagggcugggcuuucgaugacggcaaugauguguggauggggagaaccauuaacgagacaagcagguugggauacgagacuuuuaaagucaucgaagguuggucaaauccaaagaguaaacugcagauuaaccgacaggugauaguagaccguggcaaucgcuccggguauagcggaaucuucucuguugagggcaagucauguauuaacagaugcuuuuacguggaacuaaucaggggucggaaagaggaaaccgagguccucuggacaaguaauagcaucguggucuucugugggacuuccggcaccuauggaacaggcucuuggcccgauggggccgaccugaaccuuaugccuauuuga

SEQ ID NO: 146084 - RNA, 1410 nt, Artificial Sequence
  derived and/or modified sequence opt3 from neuraminidase__InfluenzaA__AHC59440
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcaaacaucaacccucagcgguagugcccagcaugucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucacugccuggacccaaacaaugaggaaggugggcauggaguuaaaggcugggcuuucgaugacggcaacgauguguggauggggcgaaccauuaaugagacaagcagacuuggauaugagacuuuuaaggucaucgaagguuggucaaaccccaaaaguaaguugcagauuaauaggcaagugauaguagaccggggcgaucguuccggguacagcggaaucuucucuguugagggcaaaucauguauuaaccgcugcuuuuauguggaacugaucagagguaggaaggaggaaaccgagguccuauggacaaguaauagcaucguggucuucugugggacuuccggcaccuacggaacaggcucuuggccugacggggccgaucucaaccugaugccaauuuga

SEQ ID NO: 146085 - RNA, 1410 nt, Artificial Sequence; identical to SEQ ID NO: 145991
  derived and/or modified sequence opt3 from neuraminidase__InfluenzaA__AHC59452

SEQ ID NO: 146086 - RNA, 1410 nt, Artificial Sequence; identical to SEQ ID NO: 141534
  derived and/or modified sequence opt3 from neuraminidase__InfluenzaA__AHC59464

SEQ ID NO: 146087 - RNA, 1410 nt, Artificial Sequence; identical to SEQ ID NO: 145899
  derived and/or modified sequence opt3 from neuraminidase__InfluenzaA__AHC59476

SEQ ID NO: 146088 - RNA, 1410 nt, Artificial Sequence; identical to SEQ ID NO: 145991
  derived and/or modified sequence opt3 from neuraminidase__InfluenzaA__AHC59488

SEQ ID NO: 146089 - RNA, 1410 nt, Artificial Sequence; identical to SEQ ID NO: 145991
  derived and/or modified sequence opt3 from neuraminidase__InfluenzaA__AHC59500

SEQ ID NO: 146090 - RNA, 1410 nt, Artificial Sequence; identical to SEQ ID NO: 146036
  derived and/or modified sequence opt3 from neuraminidase__InfluenzaA__AHC59512

SEQ ID NO: 146091 - RNA, 1410 nt, Artificial Sequence; identical to SEQ ID NO: 146036
  derived and/or modified sequence opt3 from neuraminidase__InfluenzaA__AHC59524

SEQ ID NO: 146092 - RNA, 1410 nt, Artificial Sequence; identical to SEQ ID NO: 146023
  derived and/or modified sequence opt3 from neuraminidase__InfluenzaA__AHC59536

SEQ ID NO: 146093 - RNA, 1410 nt, Artificial Sequence; identical to SEQ ID NO: 145991
  derived and/or modified sequence opt3 from neuraminidase__InfluenzaA__AHC59548

SEQ ID NO: 146094 - RNA, 1410 nt, Artificial Sequence; identical to SEQ ID NO: 145991
  derived and/or modified sequence opt3 from neuraminidase__InfluenzaA__AHC59560

SEQ ID NO: 146095 - RNA, 1410 nt, Artificial Sequence; identical to SEQ ID NO: 146069
  derived and/or modified sequence opt3 from neuraminidase__InfluenzaA__AHC59572

SEQ ID NO: 146096 - RNA, 1410 nt, Artificial Sequence; identical to SEQ ID NO: 146064
  derived and/or modified sequence opt3 from neuraminidase__InfluenzaA__AHC59584

SEQ ID NO: 146097 - RNA, 1410 nt, Artificial Sequence; identical to SEQ ID NO: 146036
  derived and/or modified sequence opt3 from neuraminidase__InfluenzaA__AHC59596

SEQ ID NO: 146098 - RNA, 1410 nt, Artificial Sequence; identical to SEQ ID NO: 144938
  derived and/or modified sequence opt3 from neuraminidase__InfluenzaA__AHC59608

SEQ ID NO: 146099 - RNA, 1410 nt, Artificial Sequence; identical to SEQ ID NO: 146023
  derived and/or modified sequence opt3 from neuraminidase__InfluenzaA__AHC59620

SEQ ID NO: 146100 - RNA, 1410 nt, Artificial Sequence; identical to SEQ ID NO: 145991
  derived and/or modified sequence opt3 from neuraminidase__InfluenzaA__AHC59632

SEQ ID NO: 146101 - RNA, 1410 nt, Artificial Sequence; identical to SEQ ID NO: 145991
  derived and/or modified sequence opt3 from neuraminidase__InfluenzaA__AHC59644

SEQ ID NO: 146102 - RNA, 1410 nt, Artificial Sequence
  derived and/or modified sequence opt3 from neuraminidase__InfluenzaA__AHC59656
augaaccccaaucagaagaucauuaccauaggcagcgugucccugacaaucucuacuauuugcuucuuuaugcaaaucgccauucucaucacgaccgucacaaugcacuucaaacaguacgaguuuaacucaccuccaaauaaccagguuaugcuuugugaaccgacuauaaucgagagaaauauuaccgaaaucguguaucugacaaacaccacuauugagaaggaaaucugccccaaauuggcugaguacaggaauuggaguaagccucagugugacauaacaggguucgcaccauuuagcaaagauaacuccauucgguuaucugccggaggugacaucuggguaacccgcgagcccuaugugucgugcgauccugucaaguguuaccaauucgcgcugggccaggggacgacucuaaauaacgugcauucaaauaacaccguucgagaccguacaccauauagaacucuccugaugaaugaacuuggagugcccuuucaccugggcaccaagcaggucugcauugcuuggagcaguuccucuugucaugaugguaaagccugguugcacgugugcaucacaggggacgauaagaacgcaaccgccagcuucaucuacaauggaaaacucguagacuccguugugucauggaguaaggagauucugaggacgcaggaaagcgagugugucugcauaaacggcacuuguacaguggugaugaccgauggcucugcuuccgggaaagcagacacuaagauccuguuuauugaggaaggaaagaucguccauacaucaacccucagcgguagugcccaacacguugaggaaugcucuugcuauccucgguacccaggcgugcgcuguguaugcagagauaacuggaaaggguccaauaggccgauaguggacauuaacaucaaggaucacagcaucgucucgucuuacguguguuccggauuaguuggcgacacgccccggaaaaaugacucaaguagcuccucucauugccuggauccuaacaaugaggaaggugggcacggagugaagggcugggcuuucgacgauggcaacgacgucuggauggggcgcaccauuaaugagacaagccgacuuggauaugagacuuuuaaagugaucgaagguuggucaaacccaaagaguaaauugcagauuaauagacagguaauaguugauaggggcaaccgguccggguacagcggaaucuucucuguggagggcaagucauguauuaaucguugcuuuuaugucgaacugauccgcgguagaaaggaggaaaccgaggugcuauggacaaguaacagcaucgucguguucugugggacuuccggcaccuacggaacaggcucuuggcccgacggggccgaucucaaucugaugccuauuuga

SEQ ID NO: 146103 - RNA, 1410 nt, Artificial Sequence; identical to SEQ ID NO: 146036
  derived and/or modified sequence opt3 from neuraminidase__InfluenzaA__AHC59668

SEQ ID NO: 146104 - RNA, 1410 nt, Artificial Sequence; identical to SEQ ID NO: 146064
  derived and/or modified sequence opt3 from neuraminidase__InfluenzaA__AHC59680

SEQ ID NO: 146105 - RNA, 1410 nt, Artificial Sequence; identical to SEQ ID NO: 145991
  derived and/or modified sequence opt3 from neuraminidase__InfluenzaA__AHC59704

SEQ ID NO: 146106 - RNA, 1410 nt, Artificial Sequence; identical to SEQ ID NO: 141534
  derived and/or modified sequence opt3 from neuraminidase__InfluenzaA__AHC59716

SEQ ID NO: 146107 - RNA, 1410 nt, Artificial Sequence; identical to SEQ ID NO: 141534
  derived and/or modified sequence opt3 from neuraminidase__InfluenzaA__AHC59728

SEQ ID NO: 146108 - RNA, 1410 nt, Artificial Sequence; identical to SEQ ID NO: 146036
  derived and/or modified sequence opt3 from neuraminidase__InfluenzaA__AHC59752

SEQ ID NO: 146109 - RNA, 1410 nt, Artificial Sequence; identical to SEQ ID NO: 146023
  derived and/or modified sequence opt3 from neuraminidase__InfluenzaA__AHC59764

SEQ ID NO: 146110 - RNA, 1410 nt, Artificial Sequence
  derived and/or modified sequence opt3 from neuraminidase__InfluenzaA__AHC59776
augaaccccaaucagaagaucauuaccauaggcagcgugucccugacaaucucuacuauuugcuucuuuaugcaaaucgccauucucaucacgaccgucacacuucacuucaaacaguacgaguuuuauucaccuccaaacaaucagguuaugcugugugaaccgacuauaaucgagagaaacauuaccgaaaucguguacuugacaaauaccacuauugagaaggaaaucugccccaaauuagcugaguauaggaacuggaguaagccucagugugacauaacaggguucgcaccauuuagcaaagauaauuccauucggcugucugccggaggugacaucuggguaacccgcgagcccuacgugucgugcgauccugacaaguguuaucaauucgcgcuaggccaggggacgacucucaacaauguccauucaaacaauaccgugcgagaucguacaccauacagaacucugcuuaugaacgaacugggaguucccuuucacuugggcaccaaacaggugugcauugcuuggagcaguuccucuugucaugacgguaaggccuggcuccacgucugcaucacaggggaugacaagaaugcaaccgccagcuucaucuauaacggaaaacugguggauuccguaguuucauggaguaaggagauucugaggacgcaggaaagcgagugugugugcauaaauggcacuuguacagucgugaugaccgacggcucugcuuccgggaaagcagauacuaagauccucuuuauugaggaaggaaagaucgugcauacaucaaccuuaagcgguagugcccaacacgucgaggaaugcucuugcuacccucgguacccaggcguucgcugugugugcagagacaacuggaaaggguccaacaggccgauaguagauauuaauaucaaggaccacagcaucgugucgucuuaugucuguuccggacuggugggcgacacgccccggaaaaacgauucaaguagcuccucucauugccuugacccuaauaacgaggaaggugggcacggaguuaagggcugggcuuucgaugacggcaaugauguguggauggggcgcaccauuaacgagacaagccgauugggauacgagacuuuuaaagucaucgaagguuggucaaauccaaagaguaaacugcagauuaacagacaggugauaguagacaggggcaaucgguccggguauagcggaaucuucucuguugagggcaagucauguauuaaccguugcuuuuacguggaacuaauccgcgguagaaaggaggaaaccgagguccucuggacaaguaauagcaucguggucuucugugggacuuccggcaccuauggaacaggcucuuggcccgauggggccgaccugaaccuuaugccuauuuga

SEQ ID NO: 146111 - RNA, 1410 nt, Artificial Sequence; identical to SEQ ID NO: 145987
  derived and/or modified sequence opt3 from neuraminidase__InfluenzaA__AHC59788

SEQ ID NO: 146112 - RNA, 1410 nt, Artificial Sequence; identical to SEQ ID NO: 146064
  derived and/or modified sequence opt3 from neuraminidase__InfluenzaA__AHC59800

SEQ ID NO: 146113 - RNA, 1410 nt, Artificial Sequence
  derived and/or modified sequence opt3 from neuraminidase__InfluenzaA__AHC59812
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguugugcugugugaaccgacuauaaucgagagaaauauuaccgaaaucguauauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucugggugacccgcgagccuuaugucucgugcgauccagacaaguguuaccaauucgcgcugggccaggggacgacucuaaauaacgugcauucaaauaacaccguucgagaucguacacccuauagaacucuccugaugaaugaacuuggagugccuuuucaccugggcaccaagcaggucugcauugcuuggagcaguuccucuugucaugacgguaaagccugguugcacgugugcaucacaggggaugacaagaacgcaaccgccagcuucaucuacaauggaaggcucguagauuccguugugucauggaguaaagagauucugcggacgcaggaaagcgagugugucugcauaaacggcacuuguacaguggugaugaccgacggcucugcuuccgggaaggcagauacuaaaauccuguuuauugaggaaggaaagaucgucuauacaucaacccucagcgguagugcccaacauguugaggaaugcucuugcuacccacgcuacccgggcgugagauguguaugcagggacaacuggaagggguccaaucggcccauaguggauauuaacaucaaagaccacagcaucgucucgucuuauguguguuccggauuaguuggcgacacgccucgcaagaaugauucaaguagcuccucucacugccuggacccaaacaaugaggaaggugggcauggagugaaaggcugggcuuucgaugacggcaacgaugucuggauggggcgaaccauuaaugagacaagcagacuuggauacgagacuuuuaaggugaucgaagguuggucaaaccccaaaaguaaguugcagauuaauaggcagguaauaguugaccggggcgaucguuccggguauagcggaaucuucucuguggagggcaaaucauguauuaaccgcugcuuuuacgucgaacugaucagagguaggaaggaggaaaccgaggugcuauggacaaguaauagcaucgucguguucugugggacuuccggcaccuauggaacaggcucuuggccugacggggccgaucucaaccugaugccaauuuga

SEQ ID NO: 146114 - RNA, 1410 nt, Artificial Sequence
  derived and/or modified sequence opt3 from neuraminidase__InfluenzaA__AHC59824
augaaccccaaucagaagaucauuaccauaggcagcgugucccugacaaucucuacuauuugcuucuuuaugcagaucgccauucucaucacgaccgucacacuucacuucaaacaguacgaguuuuauucaccuccaaacaaucagguuaugcugugugaaccgacuauaaucgagagaaacauuaccgaaaucguguacuugacaaauaccacuauugagaaggaaaucugccccaaauuagcugaguauaggaaguggaguaaaccucagugugacauaacaggguucgcaccauuuagcaaggauaacuccauucggcugucugccggaggugacaucuggguaacccgcgagcccuacgugucgugcgauccugacaaguguuaucaauucgcgcuaggccaggggacgacucucaauaacguccauucaaauaacaccgugcgagaucguacaccauacagaacucugcuuaugaaugaacugggaguucccuuucacuugggcaccaaacaggugugcauugcuuggagcaguuccucuugucaugacgguaaggccuggcuccacgucugcaucacaggggaugacaaaaacgcaaccgccagcuucaucuauaauggaaggcugguggauuccguaguuucauggaguaaggagauucugcggacgcaggaaagcgagugugugugcauaaacggcacuuguacagucgugaugaccgacggcucugcuuccgggaaagcagauacuaagauccucuuuauugaggaaggaaagaucgugcauacaucaaccuuaagcgguagugcccaacacgucgaggaaugcucuugcuacccucgcuacccaggcguuagaugugugugcagggacaauuggaaaggguccaaccggccgauaguagauauuaacaucaaggaccacagcaucgugucgucuuaugucuguuccggacuggugggcgacacgccccgcaaaaaugauucaaguagcuccucucauugccuugacccuaacaaugaggaaggugggcacggaguuaagggcugggcuuucgaugacggcaacgauguguggauggggcgaaccauuaaugagacaagcagauugggauacgagacuuuuaaagucaucgaagguuggucaaacccaaagaguaaacugcagauuaauaggcaagugauaguagaccggggcaaccguuccggguauagcggaaucuucucuguugagggcaagucauguauuaaucgcugcuuuuacguggaacuaaucagagguaggaaggaggaaaccgagguccucuggacaaguaacagcaucguggucuucugugggacuuccggcaccuauggaacaggcucuuggcccgauggggccgaccugaaucuuaugccuauuuga

SEQ ID NO: 146115 - RNA, 1410 nt, Artificial Sequence; identical to SEQ ID NO: 145991
  derived and/or modified sequence opt3 from neuraminidase__InfluenzaA__AHC59836

SEQ ID NO: 146116 - RNA, 1410 nt, Artificial Sequence; identical to SEQ ID NO: 144938
  derived and/or modified sequence opt3 from neuraminidase__InfluenzaA__AHC59848

SEQ ID NO: 146117 - RNA, 1410 nt, Artificial Sequence; identical to SEQ ID NO: 145987
  derived and/or modified sequence opt3 from neuraminidase__InfluenzaA__AHC59860

SEQ ID NO: 146118 - RNA, 1410 nt, Artificial Sequence; identical to SEQ ID NO: 146034
  derived and/or modified sequence opt3 from neuraminidase__InfluenzaA__AHC59872

SEQ ID NO: 146119 - RNA, 1410 nt, Artificial Sequence; identical to SEQ ID NO: 146023
  derived and/or modified sequence opt3 from neuraminidase__InfluenzaA__AHC59884

SEQ ID NO: 146120 - RNA, 1410 nt, Artificial Sequence
  derived and/or modified sequence opt3 from neuraminidase__InfluenzaA__AHC59895
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauuaaggagggaaagaucgugcauacaucaaccuuaagcgguagugcccaacacgucgaagagugcucuugcuauccucgcuacccaggcguuagaugugugugcagggacaacuggaaaggguccaaucggccgauaguagauauuaacaucaaggaccacagcaucgugucgucuuacgucuguuccggacuggugggcgacacgccccgcaaaaaugauucaaguagcuccucucauugccuugacccuaacaaugaagagggugggcacggaguuaagggcugggcuuucgaugacggcaacgauguguggauggggcgaaccauuaaugaaacaagcagauugggauaugagacuuuuaaagucaucgaggguuggucaaacccaaagaguaaacugcagauuaauaggcaagugauaguagaccggggcaaccguuccggguacagcggaaucuucucuguugaaggcaagucauguauuaaucgcugcuuuuauguggagcuaaucagagguaggaaggaagagaccgaaguccucuggacaaguaacagcaucguggucuucugugggacuuccggcaccuacggaacaggcucuuggcccgauggggccgaccugaaucuuaugccuauuuga

SEQ ID NO: 146121 - RNA, 1410 nt, Artificial Sequence; identical to SEQ ID NO: 145991
  derived and/or modified sequence opt3 from neuraminidase__InfluenzaA__AHC59907

SEQ ID NO: 146122 - RNA, 1410 nt, Artificial Sequence
  derived and/or modified sequence opt3 from neuraminidase__InfluenzaA__AHC59918
augaaccccaaucagaagaucauuaccauaggcagcgugucccugacaaucucuacuauuugcuucuuuauccagauugccauccucauaacgaccgucacacuucacuucaaacaguacgaguuuaacucaccuccaaauaaccagguuaugcugugugaaccgacuaucauugagagaaauaucaccgaaauuguguauuugacaaacaccacuaucgagaaggaaauaugccccaaauuagcugaguacaggaauuggaguaagccucagugugacauuacaggguucgcaccauuuagcaaagauaacuccauccggcugucugccggaggugacauuuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcaucgcuuggagcaguuccucuugucaugacgguaaggccuggcuccacgucugcaucacaggggaugacaagaacgcaaccgccagcuucauuuacaauggaaggcugguggauuccguaguuucauggaguaaagagauacugcggacgcaggaaagcgagugugugugcaucaacggcacuuguacagucgugaugaccgacggcucugcuuccgggaaggcagauacuaaaauucucuuuaucgaggaaggaaagauagugcauacaucaaccuuaagcgguagugcccaacacgucgaggaaugcucuugcuauccucgcuacccaggcguuagaugugugugcagggacaacuggaagggguccaaucggccgauuguagauaucaacaucaaagaccacagcauugugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccaucaaugagacaagcagauugggauaugagacuuuuaaggucauugaagguuggucaaacccaaaaaguaagcugcagaugaauaggcaagugauaguagaccggggcaaccguuccggguacagcggaaucuucucuguugagggcaaaucauguauuaaucgcugcuuuuauguggaacuaaucagagguaggaaggaggaaaccgagguccucuggacaaguaacagcaucguggucuucugugggacuuccggcaccuacggaacaggcucuuggcccgauggggccgaccugaaucuuaugccuauuuga

SEQ ID NO: 146123 - RNA, 1410 nt, Artificial Sequence; identical to SEQ ID NO: 146122
  derived and/or modified sequence opt3 from neuraminidase__InfluenzaA__AHC59930

SEQ ID NO: 146124 - RNA, 1410 nt, Artificial Sequence; identical to SEQ ID NO: 145991
  derived and/or modified sequence opt3 from neuraminidase__InfluenzaA__AHC59942

SEQ ID NO: 146125 - RNA, 1410 nt, Artificial Sequence; identical to SEQ ID NO: 146036
  derived and/or modified sequence opt3 from neuraminidase__InfluenzaA__AHC59954

SEQ ID NO: 146126 - RNA, 1410 nt, Artificial Sequence
  derived and/or modified sequence opt3 from neuraminidase__InfluenzaA__AHC59966
augaaccccaaucagaagaucauuaccauaggcagcgugucccugacaaucucuacuauuugcuucuuuaugcagaucgccauucucaucacgaccgucacacuucacuucaaacaguacgaguuuaacucaaguccuaauaaccagguuaugcugugugaaccaacuauaaucgagagaaauauuaccgaaaucguguauuugacaaacaccacuauugagaaggaaaucugcccgaaacccgcugaguacaggaauuggagcaagccucagugugacauaacaggguucgcaccauuuuccaaagauaacucuauucgguuaucggccggaggugacaucuggguaacccgcgagcccuaugugucaugcgauccugacaaguguuaccaauucgcgcugggccaggggacgacucuaaauaacguccauagcaauaacaccgugcgagaucguacaccauauagaacucuccugaugaaugaacuuggaguucccuuucaccugggcaccaaacaggugugcauugcuuggaguuccucuagcugucaugacgguaaggccugguugcacgucugcaucacaggggaugacaagaacgcaaccgccuccuucaucuacaauggaaggcucguggauucaguaguuaguuggagcaaagagauucugcggacgcaggaaucugagugugugugcauaaacggcacuuguacagucgugaugaccgacggcuccgcuucagggaaggcagauacuaaaauccuguuuauugaggaaggaaagaucgugcauacaagcacccucagugguucugcccaacacgucgaggaaugcuccugcuauccucgcuacccaggcguuagaugugugugcagggacaacuggaaggggagcaaucggccgauaguagauauuaacaucaaagaccacucgaucgugucuuccuacgucuguucaggauuagugggcgacacgccccgcaagaaugauaguagcuccucuagccauugccuggacccuaacaaugaggaaggugggcacggaguuaaaggcugggcuuucgaugacggcaacgauguguggauggggcgaaccauuaaugagacaucaagacuuggauaugagacuuuuaaggucaucgaagguuggaguaacccaaaauccaaguugcagauuaauaggcaagugauaguagaccggggcgaugggagcggauacucuggcaucuucucaguugaggguaaaaguuguauuaaccguugcuuuuauguggaacugauccgcgggagaaaggaggaaaccgagguccuauggacaagcaauuccaucguggucuucuguggcacuucuggaaccuacggcacagggucguggcccgacggagccgaucucaaccugaugccuauuuga

SEQ ID NO: 146127 - RNA, 1410 nt, Artificial Sequence; identical to SEQ ID NO: 144938
  derived and/or modified sequence opt3 from neuraminidase__InfluenzaA__AHC59978

SEQ ID NO: 146128 - RNA, 1410 nt, Artificial Sequence; identical to SEQ ID NO: 142900
  derived and/or modified sequence opt3 from neuraminidase__InfluenzaA__AHC59990

SEQ ID NO: 146129 - RNA, 1410 nt, Artificial Sequence; identical to SEQ ID NO: 146036
  derived and/or modified sequence opt3 from neuraminidase__InfluenzaA__AHC60002

SEQ ID NO: 146130 - RNA, 1410 nt, Artificial Sequence; identical to SEQ ID NO: 145991
  derived and/or modified sequence opt3 from neuraminidase__InfluenzaA__AHC60014

SEQ ID NO: 146131 - RNA, 1410 nt, Artificial Sequence; identical to SEQ ID NO: 141534
  derived and/or modified sequence opt3 from neuraminidase__InfluenzaA__AHC60026

SEQ ID NO: 146132 - RNA, 1410 nt, Artificial Sequence; identical to SEQ ID NO: 145987
  derived and/or modified sequence opt3 from neuraminidase__InfluenzaA__AHC60038

SEQ ID NO: 146133 - RNA, 1410 nt, Artificial Sequence; identical to SEQ ID NO: 145987
  derived and/or modified sequence opt3 from neuraminidase__InfluenzaA__AHC60050

SEQ ID NO: 146134 - RNA, 1410 nt, Artificial Sequence
  derived and/or modified sequence opt3 from neuraminidase__InfluenzaA__AHC60062
augaaccccaaucagaagaucauuaccauaggcagcgugucccugacaaucucuacuauuugcuucuuuaugcaaaucgccauucucaucacgaccgucacaaugcacuucaaacaguacgaguuuaacucaccuccaaauaaccagguuaugcuuugugaaccgacuauaaucgagagaaauauuaccgaaaucguguaucugacaaacaccacuauugagaaggaaaucugccccaaauuggcugaguacaggaauuggaguaagccucagugugacauaacaggguucgcaccauuuagcaaagauaacuccauucgguuaucugccggaggugacaucuggguaacccgcgagcccuaugugucgugcgauccugacaaguguuaccaauucgcgcugggccaggggacgacucuaaauaacguccauucaaauaacaccgugcgagaucguacaccauauagaacucuccugaugaaugaacuuggaguucccuuucaccugggcaccaaacaggugugcauugcuuggagcaguuccucuugucaugacgguaaggccugguugcacgucugcaucacaggggaugacaagaacgcaaccgccagcuucaucuacaauggaaaacucguggauuccguaguuucauggaguaaggagauucugaggacgcaggaaagcgagugugugugcauaaacggcacuuguacagucgugaugaccgacggcucugcuuccgggaaagcagauacuaagauccuguuuauugaggaaggaaagaucgugcauacaucaacccucagcgguagugcccaacacgucgaggaaugcucuugcuauccucgguacccaggcguucgcugugugugcagagacaacuggaaaggguccaauaggccgauaguagauauuaacaucaaggaccacagcaucgugucgucuuacgucuguuccggauuagugggcgacacgccccggaaaaaugauucaaguagcuccucucauugccuggacccuaacaaugaggaaggugggcacggaguuaagggcugggcuuucgaugacggcaacgauguguggauggggcgcaccauuaaugagacaagccgacuuggauaugagacuuuuaaagucaucgaagguuggucaaacccaaagaguaaauugcagauuaauagacaggugauaguagacaggggcaaccgguccggguacagcggaaucuucucuguugagggcaagucauguauuaaucguugcuuuuauguggaacugauccgcgguagaaaggaggaaaccgagguccuauggacaaguaacagcaucguggucuucugugggacuuccggcaccuacggaacaggcucuuggcccgauggggccgaccucaaucugaugccuauuuga

SEQ ID NO: 146135 - RNA, 1410 nt, Artificial Sequence; identical to SEQ ID NO: 144938
  derived and/or modified sequence opt3 from neuraminidase__InfluenzaA__AHC60074

SEQ ID NO: 146136 - RNA, 1410 nt, Artificial Sequence; identical to SEQ ID NO: 145991
  derived and/or modified sequence opt3 from neuraminidase__InfluenzaA__AHC60086

SEQ ID NO: 146137 - RNA, 1410 nt, Artificial Sequence
  derived and/or modified sequence opt3 from neuraminidase__InfluenzaA__AHC60098
augaaccccaaucagaagaucauuaccauaggcagcgugucccugacaaucucuacuauuugcuucuuuaugcagaucgccauucucaucacgaccgucacacuucacuucaaacaguacgaguuuuauucaccuccaaacaaucagguuaugcugugugaaccgacuauaaucgagagaaacauuaccgaaaucguguacuugacaaauaccacuauugagaaggaaaucugccccaaauuagcugaguauaggaacuggaguaagccucagugugacauaacaggguucgcaccauuuagcaaagauaauuccauucggcugucugccggaggugacaucuggguaacccgcgagcccuacgugucgugcgauccugacaaguguuaucaauucgcgcuaggccaggggacgacucucaacaauguccauucaaacaauaccgugcgagaucguacaccauacagaacucugcuuaugaacgaacugggaguucccuuucacuugggcaccaaacaggugugcauugcuuggagcaguuccucuugucaugacgguaaggccuggcuccacgucugcaucacaggggaugacaagaaugcaaccgccagcuucaucuauaacggaaggcugguggauuccguaguuucauggaguaaagagauucugcggacgcaggaaagcgagugugugugcauaaauggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuacccucgcuacccaggcguuagaugugugugcagggacaacuggaagggguccaaccggccgauaguagauauuaauaucaaagaccacagcaucgugucgucuuaugucuguuccggacuggugggcgacacgccccgcaagaacgauucaaguagcuccucucauugccuugacccuaauaacgaggaaggugggcacggaguuaaaggcugggcuuucgaugacggcaaugauguguggauggggcgaaccauugacgagacaagcagauugggauacgagacuuuuaaggucaucgaagguuggucaaacccaaaaaguaagcugcagauuaauaggcaagugauaguagaucggggcaaccguuccggguauagcggaaucuucucuguugagggcaaaucauguauuaaucgcugcuuuuacguggaacuaaucagagguaggaaggaggaaaccgagguccucuggacaaguaacagcaucguggucuucugugggacuuccggcaccuauggaacaggcucuuggcccgacggggccgaucugaaucuuaugccuauuuga

SEQ ID NO: 146138 - RNA, 1410 nt, Artificial Sequence; identical to SEQ ID NO: 145987
  derived and/or modified sequence opt3 from neuraminidase__InfluenzaA__AHC60110

SEQ ID NO: 146139 - RNA, 1410 nt, Artificial Sequence; identical to SEQ ID NO: 146064
  derived and/or modified sequence opt3 from neuraminidase__InfluenzaA__AHC60122

SEQ ID NO: 146140 - RNA, 1410 nt, Artificial Sequence; identical to SEQ ID NO: 145991
  derived and/or modified sequence opt3 from neuraminidase__InfluenzaA__AHC60134

SEQ ID NO: 146141 - RNA, 1410 nt, Artificial Sequence; identical to SEQ ID NO: 146045
  derived and/or modified sequence opt3 from neuraminidase__InfluenzaA__AHC60146

SEQ ID NO: 146142 - RNA, 1410 nt, Artificial Sequence; identical to SEQ ID NO: 146122
  derived and/or modified sequence opt3 from neuraminidase__InfluenzaA__AHC60158

SEQ ID NO: 146143 - RNA, 1410 nt, Artificial Sequence; identical to SEQ ID NO: 145987
  derived and/or modified sequence opt3 from neuraminidase__InfluenzaA__AHC60182

SEQ ID NO: 146144 - RNA, 1410 nt, Artificial Sequence
  derived and/or modified sequence opt3 from neuraminidase__InfluenzaA__AHC60206
augaaccccaaucagaagaucauuaccauaggcagcgugucccugacaaucucuauuaucugcuucuuuaugcaagucgccauucucaucacuacgguuacccuucacuucaaacaguacgaguuuaacucaccuccaaauaaccaggugaugcugugugaaccgacaauaaucgagagaaauauuacugaaaucguauauuugaccaacacaaccauugagaaggaaaucugccccaaauuagcugaguacaggaauuggaguaagccucagugugacauaacuggguucgcaccauuuagcaaagauaacuccauucggcugucugccggaggugacaucugggugacacgcgagcccuaugucucgugcgauccugacaaguguuaccaauucgcgcuaggccaggggaccacgcucaauaacgugcauucaaauaacacuguucgagaucguaccccauauagaacacugcuuaugaaugaacugggagugcccuuucacuugggcacuaagcaggucugcauugcuuggagcaguuccucuugucaugacgguaaagccuggcuccacgugugcaucaccggggaugacaagaacgcaacagccagcuucaucuacaauggaaaacugguagauuccguugugucauggaguaaggagauucugaggacccaggaaagcgagugugucugcauaaacggcacguguacuguggugaugacagacggcucugcuuccgggaaagcagauaccaagauccucuuuauugaggaaggaaagaucguccauacuucaacauuaagcgguagugcccaacacguugaggaaugcucuugcuauccucgguacccaggcgugcgcuguguaugcagagacaacuggaaaggguccaauaggccgauaguggauauuaacaucaaggaccacagcaucgucucgucuuacguguguuccggacugguuggcgacacgccccggaaaaaugauucaaguagcuccucucauugccuugacccuaacaaugaggaaggugggcacggagugaagggcugggcuuucgaugacggcaacgaugucuggauggggcgcaccauuaaugagaccagccgauugggauaugagacauuuaaagugaucgaagguuggucaaacccaaagaguaaacugcagauuaauagacagguaauaguugacaggggcaaccgguccggguacagcggaaucuucucuguggagggcaagucauguauuaaucguugcuuuuaugucgaacuaauccgcgguagaaaggaggaaacugaggugcucuggaccaguaacagcaucgucguguucugugggacauccggcacuuacggaaccggcucuuggcccgauggggccgaccugaaucuuaugccuauuuga

SEQ ID NO: 146145 - RNA, 1410 nt, Artificial Sequence; identical to SEQ ID NO: 144938
  derived and/or modified sequence opt3 from neuraminidase__InfluenzaA__AHC60218

SEQ ID NO: 146146 - RNA, 1410 nt, Artificial Sequence; identical to SEQ ID NO: 141534
  derived and/or modified sequence opt3 from neuraminidase__InfluenzaA__AHC60230

SEQ ID NO: 146147 - RNA, 1410 nt, Artificial Sequence; identical to SEQ ID NO: 145987
  derived and/or modified sequence opt3 from neuraminidase__InfluenzaA__AHC60242

SEQ ID NO: 146148 - RNA, 1410 nt, Artificial Sequence; identical to SEQ ID NO: 145987
  derived and/or modified sequence opt3 from neuraminidase__InfluenzaA__AHC60254

SEQ ID NO: 146149 - RNA, 1410 nt, Artificial Sequence; identical to SEQ ID NO: 145987
  derived and/or modified sequence opt3 from neuraminidase__InfluenzaA__AHC60266

SEQ ID NO: 146150 - RNA, 1410 nt, Artificial Sequence; identical to SEQ ID NO: 146036
  derived and/or modified sequence opt3 from neuraminidase__InfluenzaA__AHC60278

SEQ ID NO: 146151 - RNA, 1410 nt, Artificial Sequence; identical to SEQ ID NO: 145987
  derived and/or modified sequence opt3 from neuraminidase__InfluenzaA__AHC60290

SEQ ID NO: 146152 - RNA, 1410 nt, Artificial Sequence
  derived and/or modified sequence opt3 from neuraminidase__InfluenzaA__AHC60302
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaaacugguggacuccguaguuucauggaguaaggagauucugaggacgcaggaaagcgagugugugugcauaaacggcacuuguacagucgugaugaccgauggcucugcuuccgggaaagcagacacuaagauccucuuuauugaggaaggaaagaucauacauacaucaaccuuaagcgguagugcccaacacguggaggaaugcucuugcuauccucgguacccaggcguccgcuguguuugcagagauaauuggaaaggguccaacaggccgauuguggacaucaauaucaaggaucacagcauuguaucgucuuacguguguuccggacuggucggcgacacgccccggaaaaacgacucaaguagcuccucucauugccuugauccuaauaacgaggaaggugggcacggagugaagggcugggcuuucgacgauggcaaugacguuuggauggggcgcaccaucaacgagacaagccgauugggauaugagacuuuuaaagugauugaagguuggucaaauccaaagaguaaacugcagauaaacagacaggucaucguggauaggggcaaucgguccggguacagcggaauuuucucuguagagggcaagucauguaucaaccguugcuuuuauguugaacuaauccgcgguagaaaggaggaaaccgaggugcucuggacaaguaauagcauugucguguucugugggacuuccggcaccuacggaacaggcucuuggcccgacggggccgaucugaaccuuaugccuauauga

SEQ ID NO: 146153 - RNA, 1410 nt, Artificial Sequence; identical to SEQ ID NO: 145987
  derived and/or modified sequence opt3 from neuraminidase__InfluenzaA__AHC60314

SEQ ID NO: 146154 - RNA, 1410 nt, Artificial Sequence; identical to SEQ ID NO: 145987
  derived and/or modified sequence opt3 from neuraminidase__InfluenzaA__AHC60326

SEQ ID NO: 146155 - RNA, 1410 nt, Artificial Sequence
  derived and/or modified sequence opt3 from neuraminidase__InfluenzaA__AHC60338
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcgaugacguguggauggggcgaaccauuaacgagacaagcagacuuggauaugagacuuuuaaggucaucgaagguuggucaaaucccaaaaguaaguugcagauuaacaggcaagugauaguagaucggggcgaccguuccggguacagcggaaucuucucuguugagggcaaaucauguauuaaucgcugcuuuuauguggaacugaucagagguaggaaggaggaaaccgagguccuauggacaaguaacagcaucguggucuucugugggacuuccggcaccuacggaacaggcucuuggccugauggggccgaccucaaucugaugccaauuuga

SEQ ID NO: 146156 - RNA, 1410 nt, Artificial Sequence; identical to SEQ ID NO: 142900
  derived and/or modified sequence opt3 from neuraminidase__InfluenzaA__AHC60350

SEQ ID NO: 146157 - RNA, 1410 nt, Artificial Sequence
  derived and/or modified sequence opt3 from neuraminidase__InfluenzaA__AHC60362
augaaccccaaucagaagaucauuaccauaggcagcgugucccugacaaucucuacuauuugcuucuuuaugcaagucgccauccucauuacgaccguuacacuucacuucaaacaguacgaguuuaacucaccuccaaauaaccaggugaugcuguguaagccgacuaucauagaaagaaauaucaccgagauuguauauuugacaaacaccacuaucgaaaaagagauuugccccaaguuagcugaauacaggaauuggaguaaaccucagugugacaucacaggguucgcaccauuuagcaaggauaacuccauacggcugucugccggaggugacauuugggugacccgcgagcccuaugucucgugcgauccugacaaguguuaccaauucgcgcuaggccaggggacgacucucaauaacgugcauucaaauaacaccguucgagaucguacaccauauagaacucugcuuaugaaugagcugggagugcccuuucacuugggcaccaaacaggucugcaucgcuuggagcaguuccucuugucaugacgguaaggccuggcuccacgugugcauuacaggggaugacaaaaacgcaaccgccagcuucaucuacaauggaaagcugguagauuccguugugucauggaguaaagaaauccugaggacgcaggagagcgaaugugucugcauuaacggcacuuguacaguggugaugaccgacggcucugcuuccgggaaggcagauacuaagauacucuuuaucgaggagggaaaaauuguccauacaucaaccuuaagcgguagugcccaacacguugaagagugcucuugcuauccucgguacccaggcgugcgcuguguaugcagagacaacuggaagggguccaauaggccgaucguggauauaaacauuaaagaccacagcaucgucucgucuuacguguguuccggacugguuggcgacacgccccggaagaaugauucaaguagcuccucucauugccuugacccuaacaaugaagagggugggcacggagugaaaggcugggcuuucgaugacggcaacgaugucuggauggggcgcaccaucaaugaaacaagccgauugggauaugagacuuuuaaggugauugaggguuggucaaacccaaaaaguaagcugcagaucaauagacagguaauuguugacaggggcaaccgguccggguacagcggaauauucucuguggaaggcaagucauguaucaaucguugcuuuuaugucgagcuaauucgcgguagaaaagaagagaccgaagugcucuggacaaguaacagcaucgucguguucugugggacuuccggcaccuacggaacaggcucuuggcccgauggggccgaccugaaucuuaugccuaucuga

SEQ ID NO: 146158 - RNA, 1410 nt, Artificial Sequence; identical to SEQ ID NO: 145899
  derived and/or modified sequence opt3 from neuraminidase__InfluenzaA__AHC60374

SEQ ID NO: 146159 - RNA, 1410 nt, Artificial Sequence; identical to SEQ ID NO: 141534
  derived and/or modified sequence opt3 from neuraminidase__InfluenzaA__AHC60386

SEQ ID NO: 146160 - RNA, 1410 nt, Artificial Sequence; identical to SEQ ID NO: 145991
  derived and/or modified sequence opt3 from neuraminidase__InfluenzaA__AHC60398

SEQ ID NO: 146161 - RNA, 1410 nt, Artificial Sequence; identical to SEQ ID NO: 146023
  derived and/or modified sequence opt3 from neuraminidase__InfluenzaA__AHC60410

SEQ ID NO: 146162 - RNA, 1410 nt, Artificial Sequence; identical to SEQ ID NO: 141534
  derived and/or modified sequence opt3 from neuraminidase__InfluenzaA__AHC60422

SEQ ID NO: 146163 - RNA, 1410 nt, Artificial Sequence; identical to SEQ ID NO: 146023
  derived and/or modified sequence opt3 from neuraminidase__InfluenzaA__AHC60434

SEQ ID NO: 146164 - RNA, 1410 nt, Artificial Sequence; identical to SEQ ID NO: 145991
  derived and/or modified sequence opt3 from neuraminidase__InfluenzaA__AHC60446

SEQ ID NO: 146165 - RNA, 1410 nt, Artificial Sequence
  derived and/or modified sequence opt3 from neuraminidase__InfluenzaA__AHC60458
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuugugcugucgugaugacagacggcucugcauccgggaaggccgauaccaaaauccucuuuauugaggaaggaaagaucgugcauacuucaacauuaagcgguagugcucaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacccccaggaagaaugaugguucaaguagcucccauugccuugacccuaacaaugaggaagggggacacggcguuaaaggcugggccuucgaugacgggaacgauguguggaugggacgaacgauuaaugagaccucuagauuggguuaugagacauuuaaggucaucgaaggcuggagcaacccaaaaucaaagcugcagauuaaucgccaggugauaguagaccgggggaaccguaguggauacuccggcaucuucagcguugaggguaaaucuuguauuaaucgcugcuuuuauguggaacuaaucagagggaggaaggaggaaacugagguccucuggaccucaaacaguaucguggucuucuguggcacaagcggaacuuacggcaccggguccuggcccgauggagcggaccugaaucuuaugccuauuuga

SEQ ID NO: 146166 - RNA, 1410 nt, Artificial Sequence; identical to SEQ ID NO: 146036
  derived and/or modified sequence opt3 from neuraminidase__InfluenzaA__AHC60470

SEQ ID NO: 146167 - RNA, 1410 nt, Artificial Sequence
  derived and/or modified sequence opt3 from neuraminidase__InfluenzaA__AHC60482
augaaccccaaucagaagaucauuaccauaggcagcgugucccugacaaucucuacuauuugcuucuuuaugcagaucgccauucucacgaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaaccugcugaguacaggaauuggaguaagccacagugugacaucaccggguucgcacccuuuagcaaagauaacuccauacgguuaucugccggaggugacauuuggguaacgcgcgagccuuaugugucgugcgauccagacaaguguuaccaauucgcgcugggccaggggacuacccuaaauaacguccauucaaauaacacagugcgagaucguacucccuauagaacccuccugaugaaugaacuuggaguuccuuuucaccugggcacaaaacaggugugcaucgcuuggagcaguuccucuugucaugacgguaaggccugguugcacgucugcauuaccggggaugacaagaacgcaacggccagcuucaucuacaauggaaggcucguggauuccguaguuucauggaguaaagagauccugcggacucaggaaagcgagugugugugcauuaacggcacauguaccgucgugaugacugacggcucugcuuccgggaaggcagauacaaaaauacuguuuaucgaggaaggaaagauugugcauaccucaacgcucagcgguagugcccaacacgucgaggaaugcucuugcuauccacgcuacccgggcguuagaugugugugcagggacaacuggaagggguccaaucggcccaucguagauauaaacauuaaagaccacagcaucgugucgucuuacgucuguuccggauuagugggcgacaccccucgcaagaaugauucaaguagcuccucucauugccuggacccaaacaaugaggaaggugggcacggaguuaaaggcugggcuuucgaugacggcaacgauguguggauggggcgaacaaucaaugagacuagcagacuuggauaugagaccuuuaaggucauugaagguuggucaaaccccaaaaguaaguugcagaucaauaggcaagugauuguagaccggggcgaucguuccggguacagcggaauauucucuguugagggcaaaucauguaucaaccgcugcuuuuauguggaacugauuagagguaggaaggaggaaacagagguccuauggaccaguaauagcaucguggucuucugugggacuuccggcacauacggaaccggcucuuggccugacggggccgaucucaaccugaugccaaucuga

SEQ ID NO: 146168 - RNA, 1410 nt, Artificial Sequence; identical to SEQ ID NO: 145987
  derived and/or modified sequence opt3 from neuraminidase__InfluenzaA__AHC60494

SEQ ID NO: 146169 - RNA, 1410 nt, Artificial Sequence; identical to SEQ ID NO: 145987
  derived and/or modified sequence opt3 from neuraminidase__InfluenzaA__AHC60506

SEQ ID NO: 146170 - RNA, 1410 nt, Artificial Sequence; identical to SEQ ID NO: 145991
  derived and/or modified sequence opt3 from neuraminidase__InfluenzaA__AHC60518

SEQ ID NO: 146171 - RNA, 1410 nt, Artificial Sequence; identical to SEQ ID NO: 145991
  derived and/or modified sequence opt3 from neuraminidase__InfluenzaA__AHC60542

SEQ ID NO: 146172 - RNA, 1410 nt, Artificial Sequence
  derived and/or modified sequence opt3 from neuraminidase__InfluenzaA__AHC60554
augaaccccaaucagaagaucauuaccauaggcagcgugucccugacaaucucuacuauuugcuucuuuaugcagaucgccauucucaucacgaccgucacacuucacuucaaacaguacgaguuuuauucaccuccaaacaaucagguuaugcugugugaaccgacuaugauagagagaaacaucaccgaaauuguguacuugacaaauaccacuaucgagaaggaaauuugccccaaauuagcugaguauaggaacuggaguaagccucagugugacaucacaggguucgcaccauuuagcaaagauaauuccauacggcugucugccggaggugacauuuggguaacccgcgagcccuacgugucgugcgauccugacaaguguuaucaauucgcgcuaggccaggggacgacucucaacaauguccauucaaacaauaccgugcgagaucguacaccauacagaacucugcuuaugaacgaacugggaguucccuuucacuugggcaccaaacaggugugcaucgcuuggagcaguuccucuugucaugacgguaaggccuggcuccacgucugcauuacaggggaugacaagaaugcaaccgccagcuucaucuauaacggaaggcugguggauuccguaguuucauggaguaaagagauccugcggacgcaggaaagcgagugugugugcauuaauggcacuuguacagucgugaugaccgacggcucugcuuccgggaaggcagauacuaaaauacucuuuaucgaggaaggaaagauugugcauacaucaaccuuaagcgguagugcccaacacgucgaggaaugcucuugcuacccucgcuacccaggcguuagaugugugugcagggacaacuggaagggguccaaccggccgaucguagauauaaauauuaaagaccacagcaucgugucgucuuaugucuguuccggacuggugggcgacacgccccgcaagaacgauucaaguagcuccucucauugccuugacccuaauaacgaggaaggugggcacggaguuaaaggcugggcuuucgaugacggcaaugauguguggauggggcgaaccaucaacgagacaagcagauugggauacgagacuuuuaaggucauugaagguuggucaaauccaaaaaguaagcugcagaucaacaggcaagugauuguagaccggggcaaucguuccggguauagcggaauauucucuguugagggcaaaucauguaucaaccgcugcuuuuacguggaacuaauuagagguaggaaggaggaaaccgagguccucuggacaaguaauagcaucguggucuucugugggacuuccggcaccuauggaacaggcaccuggcccgauggggccgaccugaaccuuaugccuaucuga

SEQ ID NO: 146173 - RNA, 1410 nt, Artificial Sequence
  derived and/or modified sequence opt3 from neuraminidase__InfluenzaA__AHC60566
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccauuaaugagacaagcagacuuggauaugagacuuuuaaggucaucgaagguuggucaaaccccaaaaguaaguugcaagugaauaggcagguaauuguugaccggggcgaucguuccggguacagcggaauauucucuguggagggcaaaucauguaucaaccgcugcuuuuaugucgaacugauuagagguaggaaggaggaaaccgaggugcuauggacaaguaauagcaucgucguguucugugggacuuccggcaccuacggaacaggcucuuggccugacggggccgaucucaaccugaugccaaucuga

SEQ ID NO: 146174 - RNA, 1410 nt, Artificial Sequence; identical to SEQ ID NO: 144938
  derived and/or modified sequence opt3 from neuraminidase__InfluenzaA__AHC60578

SEQ ID NO: 146175 - RNA, 1410 nt, Artificial Sequence; identical to SEQ ID NO: 145987
  derived and/or modified sequence opt3 from neuraminidase__InfluenzaA__AHC60590

SEQ ID NO: 146176 - RNA, 1410 nt, Artificial Sequence
  derived and/or modified sequence opt3 from neuraminidase__InfluenzaA__AHC60602
augaaccccaaucagaagaucauuaccauaggcagcgugucccugacaaucucuacuauuugcuucuuuaugcaaaucgccauucucaucacgaccgucacacuucacuucaaacaguacgaguuuaacccuccaccgaauaaccagguugugcugugugaacccacuauaaucgagagaaauauuaccgaaaucguauauuugacaaacaccacuauugagaaggaaaucugcccuaaaccagcugaguacaggaauuggucaaagccccagugugacauaacaggguucgcaccuuuuaguaaagauaacagcauucgguuauccgccggaggugacaucugggugacccgcgagccauaugucucuugcgaucccgacaaguguuaccaauucgcgcugggccaggggacgacucuaaauaacgugcauucgaauaacaccguucgagaucguacaccuuauagaacucuccugaugaaugaacuuggagugccauuucaccugggcaccaagcaggucugcauugcuuggucaagcaguuccugucaugacgguaaagccugguugcacgugugcaucacaggggaugacaagaacgcaaccgccucuuucaucuacaauggaaggcucguagauagcguuguguccuggucaaaagagauucugcggacgcaggaaagugagugugucugcauaaacggcacuuguacaguggugaugaccgacggcagcgcuucugggaaggcagauacuaaaauccuguuuauugaggaaggaaagaucguccauacauccacccucucagguagcgcccaacacguugaggaaugcaguugcuauccgcgcuaccccggcgugagauguguaugcagggacaacuggaaggggucuaaucggccuauaguggauauuaacaucaaagaccacuccaucgucagcucguacguguguucuggauuaguuggcgacacgccacgcaagaaugauuccucaaguagcucccauugccuggaccccaacaaugaggaaggugggcacggagugaaaggcugggcuuucgaugacggcaacgaugucuggauggggcgaaccauuaaugagacaucuagacuuggauaugagacuuuuaaggugaucgaagguuggagcaacccuaaaucaaaguugcagauuaauaggcagguaauaguugaccggggcgaucguaguggguacuccggaaucuucagcguggagggcaaaucuuguauuaaccgcugcuuuuaugucgaacugaucagagguaggaaggaggaaaccgaggugcuauggacaucaaauaguaucgucguguucugugggacuagcggcaccuacggaacaggcuccuggccagacggggccgaucucaaccugaugcccauuuga

SEQ ID NO: 146177 - RNA, 1410 nt, Artificial Sequence; identical to SEQ ID NO: 141534
  derived and/or modified sequence opt3 from neuraminidase__InfluenzaA__AHC60614

SEQ ID NO: 146178 - RNA, 1410 nt, Artificial Sequence; identical to SEQ ID NO: 144938
  derived and/or modified sequence opt3 from neuraminidase__InfluenzaA__AHC60626

SEQ ID NO: 146179 - RNA, 1410 nt, Artificial Sequence
  derived and/or modified sequence opt3 from neuraminidase__InfluenzaA__AHC60650
augaaccccaaucagaagaucauuaccauaggcagcgugucccugacaaucucuacuauuugcuucuuuaugcagaucgccauucucaucacgaccgucacacuucacuucaaacaguacgaguuuuauucaccuccaaacaaucagguuaugcugugugaaccgacuauaaucgagagaaacauuaccgaaaucguguacuugacaaauaccacuauugagaaggaaaucugccccaaauuagcugaguauaggaacuggaguaagccucagugugacauaacaggguucgcaccauuuagcaaagauaauuccauucggcugucugccggaggugacaucuggguaacccgcgagcccuacgugucgugcgauccugacaaguguuaucaauucgcgcuaggccaggggacgacucucaacaauguccauucaaacaauaccgugcgagaucguacaccauacagaacucugcuuaugaacgaacugggaguucccuuucacuugggcaccaaacaggugugcauugcuuggagcaguuccucuugucaugacgguaaggccuggcuccacgucugcaucacaggggaugacgagaaugcaaccgccagcuucaucuauaacggaaggcugguggauuccguaguuucauggaguaaggaaauucugcggacgcaggagagcgagugugugugcauaaauggcacuuguacagucgugaugaccgacggcucugcuuccgggaaagcagauacuaagauccucuuuauugaagagggaaaaaucgugcauacaucaaccuuaagcgguagugcccaacacgucgaagagugcucuugcuacccucgcuacccaggcguuagaugugugugcagggacaacuggaagggguccaaccggccgauaguagauauuaauaucaaggaccacagcaucgugucgucuuaugucuguuccggacuggugggcgacacgccccgcaaaaacgauucaaguagcuccucucauugccuugacccuaauaacgaagagggugggcacggaguuaagggcugggcuuucgaugacggcaaugauguguggauggggcgaaccauuaacgagacaagcagauugggauacgaaacuuuuaaagucaucgaggguuggucaaauccaaagaguaaacugcagauuaacaggcaagugauaguagaccggggcaaucguuccggguauagcggaaucuucucuguugaaggcaagucauguauuaaccgcugcuuuuacguggagcuaaucagagguaggaaagaagagaccgagguccucuggacaaguaauagcaucguggucuucugugggacuuccggcaccuauggaacaggcucuuggcccgauggggccgaccugaaccuuaugccuauuuga

SEQ ID NO: 146180 - RNA, 1410 nt, Artificial Sequence; identical to SEQ ID NO: 146036
  derived and/or modified sequence opt3 from neuraminidase__InfluenzaA__AHC60662

SEQ ID NO: 146181 - RNA, 1410 nt, Artificial Sequence; identical to SEQ ID NO: 145991
  derived and/or modified sequence opt3 from neuraminidase__InfluenzaA__AHC60674

SEQ ID NO: 146182 - RNA, 1410 nt, Artificial Sequence; identical to SEQ ID NO: 141534
  derived and/or modified sequence opt3 from neuraminidase__InfluenzaA__AHC60686

SEQ ID NO: 146183 - RNA, 1410 nt, Artificial Sequence; identical to SEQ ID NO: 145991
  derived and/or modified sequence opt3 from neuraminidase__InfluenzaA__AHC60698

SEQ ID NO: 146184 - RNA, 1410 nt, Artificial Sequence; identical to SEQ ID NO: 145987
  derived and/or modified sequence opt3 from neuraminidase__InfluenzaA__AHC60710

SEQ ID NO: 146185 - RNA, 1410 nt, Artificial Sequence; identical to SEQ ID NO: 146036
  derived and/or modified sequence opt3 from neuraminidase__InfluenzaA__AHC60722

SEQ ID NO: 146186 - RNA, 1410 nt, Artificial Sequence
  derived and/or modified sequence opt3 from neuraminidase__InfluenzaA__AHC60734
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugauuaacacaaccaucgagaaggaaauaugccccaaauuagcugaguacaggaauuggaguaagccucagugugacauuacuggguucgcaccauuuagcaaagauaacuccauccggcugucugccggaggugacauuuggguaacacgcgagcccuaugugucgugcgauccuaauaaguguuaccaauucgcgcuaggccaggggaccacgcucaacaauguccauucaaacaauacugugcgagaccguaccccauauagaacacugcuuaugaacgaacugggaguucccuuucacuugggcacuaaacaggugugcaucgcuuggagcaguuccucuugucaugaugguaaggccuggcuccacgucugcaucaccggggacgauaagaaugcaacagccagcuucauuuacaacggaaaacugguggacuccguaguuucauggaguaaggagauacugaggacccaggaaagcgagugugugugcaucaacggcacguguacugucgugaugacagauggcucugcuuccgggaaagcagacaccaagauucucuuuaucgaggaaggaaagauagugcauacuucaacauuaagcgguagugcccaacacgucgaggaaugcucuugcuauccucgguacccaggcguucgcugugugugcagagauaauuggaaaggguccaacaggccgauuguagacaucaauaucaaggaucacagcauugugucgucuuacgucuguuccggacuggugggcgacacgccccggaaaaacgacucaaguagcuccucucauugccuugauccuaauaacgaggaaggugggcacggaguuaagggcugggcuuucgacgauggcaaugacguguggauggggcgcaccaucaacgagaccagccgauugggauaugagacauuuaaagucauugaagguuggucaaauccaaagaguaaacugcagauaaacagacaggugaucguagauaggggcaaucgguccggguacagcggaauuuucucuguugagggcaagucauguaucaaccguugcuuuuauguggaacuaauccgcgguagaaaggaggaaacugagguccucuggaccaguaauagcauuguggucuucugugggacauccggcacuuacggaaccggcucuuggcccgacggggccgaucugaaccuuaugccuauauga

SEQ ID NO: 146187 - RNA, 1410 nt, Artificial Sequence; identical to SEQ ID NO: 146023
  derived and/or modified sequence opt3 from neuraminidase__InfluenzaA__AHC60746

SEQ ID NO: 146188 - RNA, 1410 nt, Artificial Sequence; identical to SEQ ID NO: 146122
  derived and/or modified sequence opt3 from neuraminidase__InfluenzaA__AHC60770

SEQ ID NO: 146189 - RNA, 1410 nt, Artificial Sequence
  derived and/or modified sequence opt3 from neuraminidase__InfluenzaA__AHC60782
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgggauacgucuguucuggccuggugggugacacgccccgcaagaaugauuccucaaguagcucccauugccuugacccuaacaaugaggaagggggacacggcguuaaaggcugggcuuucgaugacgggaacgauguguggaugggacgaaccauuaaugagacaucuagauuggguuaugagacuuuuaaggucaucgaaggcuggagcaacccaaaaucaaagcugcagauuaauaggcaagugauaguagaccgggggaaccguaguggauacuccggcaucuucagcguugaggguaaaucuuguauuaaucgcugcuuuuauguggaacuaaucagagggaggaaggaggaaaccgagguccucuggacaucaaacaguaucguggucuucuguggcacuagcggaaccuacggcacaggguccuggcccgauggagccgaccugaaucuuaugccuauuuga

SEQ ID NO: 146190 - RNA, 1410 nt, Artificial Sequence; identical to SEQ ID NO: 146034
  derived and/or modified sequence opt3 from neuraminidase__InfluenzaA__AHC60794

SEQ ID NO: 146191 - RNA, 1410 nt, Artificial Sequence
  derived and/or modified sequence opt3 from neuraminidase__InfluenzaA__AHC60806
augaaccccaaucagaagaucauuaccauaggcagcgugucccugacaaucucuacuauuugcuucuuuaugcaaaucgccauucucaucacgaccgucacacuucacuucaaacagugugaguuuaacucaccuccaaauaaccagguuaugcugugcgaaccgacuauaaucgagagaaauauuaccgaaaucguguacuugacaaacaccacuauugagaaggaaaucugucccaaauuagcugaguauaggaauuggaguaagccucagugcgacauaacaggguucgcaccauuuagcaaagauaacuccauucggcugucugccggaggugacaucuggguaacccgcgagcccuacgugucgugugauccuaauaagugcuaucaauucgcgcuaggccaggggacgacucucaacaauguccauucaaacaauaccgugcgagaccguacaccauacagaacucugcuuaugaacgaacugggaguucccuuucacuugggcaccaaacagguguguauugcuuggagcaguuccucuugccaugaugguaaggccuggcuccacgucuguaucacaggggacgauaagaaugcaaccgccagcuucaucuauaacggaaaacugguggacuccguaguuucauggaguaaggagauucugaggacgcaggaaagcgagugcguguguauaaacggcacuugcacagucgugaugaccgauggcucugcuuccgggaaagcagacacuaagauccucuuuauugaggaaggaaagaucgugcauacaucaaccuuaagcgguagugcccaacacgucgaggaaugcucuuguuacccucgguauccaggcguucgcugcguguguagagauaauuggaaaggguccaacaggccgauaguagacauuaauaucaaggaucacagcaucgugucgucuuacgucugcuccggacuggugggcgacacgccccggaaaaacgacucaaguagcuccucucauugucuugauccuaauaacgaggaaggugggcacggaguuaagggcugggcuuucgacgauggcaaugacguguggauggggcgcaccauuaacgagacaagccgauugggauacgagacuuuuaaagucaucgaagguuggucaaauccaaagaguaaacugcagauuaacagacaggugauaguagauaggggcaaucgguccggguauagcggaaucuucucuguugagggcaagucaugcauuaaccguuguuuuuacguggaacuaauccgcgguagaaaggaggaaaccgggguccucuggacaaguaauagcaucguggucuucugcggcacuuccggaaccuauggcacagggucuuggcccgacggagccgaucugaaccuuaugccuauuuga

SEQ ID NO: 146192 - RNA, 1410 nt, Artificial Sequence; identical to SEQ ID NO: 142900
  derived and/or modified sequence opt3 from neuraminidase__InfluenzaA__AHC60818

SEQ ID NO: 146193 - RNA, 1410 nt, Artificial Sequence; identical to SEQ ID NO: 145991
  derived and/or modified sequence opt3 from neuraminidase__InfluenzaA__AHC60830

SEQ ID NO: 146194 - RNA, 1410 nt, Artificial Sequence; identical to SEQ ID NO: 146172
  derived and/or modified sequence opt3 from neuraminidase__InfluenzaA__AHC60842

SEQ ID NO: 146195 - RNA, 1410 nt, Artificial Sequence; identical to SEQ ID NO: 145991
  derived and/or modified sequence opt3 from neuraminidase__InfluenzaA__AHC60854

SEQ ID NO: 146196 - RNA, 1410 nt, Artificial Sequence; identical to SEQ ID NO: 146036
  derived and/or modified sequence opt3 from neuraminidase__InfluenzaA__AHC60866

SEQ ID NO: 146197 - RNA, 1410 nt, Artificial Sequence; identical to SEQ ID NO: 146023
  derived and/or modified sequence opt3 from neuraminidase__InfluenzaA__AHC60878

SEQ ID NO: 146198 - RNA, 1410 nt, Artificial Sequence; identical to SEQ ID NO: 146023
  derived and/or modified sequence opt3 from neuraminidase__InfluenzaA__AHC60890

SEQ ID NO: 146199 - RNA, 1410 nt, Artificial Sequence; identical to SEQ ID NO: 146122
  derived and/or modified sequence opt3 from neuraminidase__InfluenzaA__AHC60902

SEQ ID NO: 146200 - RNA, 1410 nt, Artificial Sequence; identical to SEQ ID NO: 145987
  derived and/or modified sequence opt3 from neuraminidase__InfluenzaA__AHC60914

SEQ ID NO: 146201 - RNA, 1410 nt, Artificial Sequence; identical to SEQ ID NO: 145991
  derived and/or modified sequence opt3 from neuraminidase__InfluenzaA__AHC60926

SEQ ID NO: 146202 - RNA, 1410 nt, Artificial Sequence; identical to SEQ ID NO: 145987
  derived and/or modified sequence opt3 from neuraminidase__InfluenzaA__AHC60938

SEQ ID NO: 146203 - RNA, 1410 nt, Artificial Sequence; identical to SEQ ID NO: 145991
  derived and/or modified sequence opt3 from neuraminidase__InfluenzaA__AHC60950

SEQ ID NO: 146204 - RNA, 1410 nt, Artificial Sequence
  derived and/or modified sequence opt3 from neuraminidase__InfluenzaA__AHC60962
augaaccccaaucagaagaucauuaccauaggcagcgugucccugacaaucucuacuauuugcuucuuuaugcaaaucgccauucucaucacgaccgucacacuucacuucaaacaguacgaguuuuauucaccuccaaacaaucagguuaugcugugugaaccgacuauaaucgagagaaacauuaccgaaaucguguacuugacaaauaccacuauugagaaggaaaucugccccaaauuagcugaguauaggaacuggaguaagccucagugugacauaacaggguucgcaccauuuagcaaagauaauuccauucggcugucugccggaggugacaucuggguaacccgcgagcccuacgugucgugcgauccugacaaguguuaucaauucgcgcuaggccaggggacgacucucaacaauguccauucaaacaauaccgugcgagaucguacaccauacagaacucugcuuaugaacgaacugggaguucccuuucacuugggcaccaaacaggugugcauugcuuggagcaguuccucuugucaugacgguaaggccuggcuccacgucugcgugacaggggaugacaagaaugcaaccgccagcuucaucuauaacggaaggcugguagauuccguugugucauggaguaaagagauccugcggacgcaggaaagcgagugugucugcauuaauggcacuuguacaguggugaugaccgacggcucugcuuccgggaaggcagauacuaaaauacucuuuaucgaggaaggaaagauuguccauacaucaaccuuaagcgguagugcccaacacguugaggaaugcucuugcuacccucgcuacccaggcgugagauguguaugcagggacaacuggaagggguccaaccggccgaucguggauauaaauauuaaagaccacagcaucgucucgucuuauguguguuccggacugguuggcgacacgccccgcaagaacgauucaaguagcuccucucauugccuugacccuaauaacgaggaaggugggcacggagugaaaggcugggcuuucgaugacggcaaugaugucuggauggggcgaaccaucaacgagacaagcagauugggauacgagacuuuuaaggugauugaagguuggucaaauccaaaaaguaagcugcagaucaacaggcagguaauuguugaccggggcaaucguuccggguauagcggaauauucucuguggagggcaaaucauguaucaaccgcugcuuuuacgucgaacuaauuagagguaggaaggaggaaaccgaggugcucuggacaaguaauagcaucgucguguucugugggacuuccggcaccuauggaacaggcucuuggcccgauggggccgaccugaaccuuaugccuaucuga

SEQ ID NO: 146205 - RNA, 1410 nt, Artificial Sequence; identical to SEQ ID NO: 146036
  derived and/or modified sequence opt3 from neuraminidase__InfluenzaA__AHC60974

SEQ ID NO: 146206 - RNA, 1410 nt, Artificial Sequence; identical to SEQ ID NO: 145987
  derived and/or modified sequence opt3 from neuraminidase__InfluenzaA__AHC60986

SEQ ID NO: 146207 - RNA, 1410 nt, Artificial Sequence; identical to SEQ ID NO: 146134
  derived and/or modified sequence opt3 from neuraminidase__InfluenzaA__AHC60998

SEQ ID NO: 146208 - RNA, 1410 nt, Artificial Sequence; identical to SEQ ID NO: 146034
  derived and/or modified sequence opt3 from neuraminidase__InfluenzaA__AHC61010

SEQ ID NO: 146209 - RNA, 1410 nt, Artificial Sequence
  derived and/or modified sequence opt3 from neuraminidase__InfluenzaA__AHC61022
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcauuucccauugccuugacccuaacaaugaggaaggugggcacggaguuaaaggcugggcuuucgaugacggcaacgauguguggauggggcgaaccaucaaugagacaucuagauugggauaugagacuuuuaaggucauugaagguuggagcaacccaaaaucaaagcugcagauaaauaggcaagugaucguagaccggggcaaccguaguggguacuccggaauuuucagcguugagggcaaaucuuguaucaaucgcugcuuuuauguggaacuaaucagagguaggaaggaggaaaccgagguccucuggacaucaaacaguauuguggucuucugugggacuagcggcaccuacggaacaggcuccuggcccgauggggccgaccugaaucuuaugccuauauga

SEQ ID NO: 146210 - RNA, 1410 nt, Artificial Sequence; identical to SEQ ID NO: 141534
  derived and/or modified sequence opt3 from neuraminidase__InfluenzaA__AHC61034

SEQ ID NO: 146211 - RNA, 1410 nt, Artificial Sequence; identical to SEQ ID NO: 145987
  derived and/or modified sequence opt3 from neuraminidase__InfluenzaA__AHC61046

SEQ ID NO: 146212 - RNA, 1410 nt, Artificial Sequence; identical to SEQ ID NO: 146036
  derived and/or modified sequence opt3 from neuraminidase__InfluenzaA__AHC61058

SEQ ID NO: 146213 - RNA, 1410 nt, Artificial Sequence; identical to SEQ ID NO: 145899
  derived and/or modified sequence opt3 from neuraminidase__InfluenzaA__AHC61070

SEQ ID NO: 146214 - RNA, 1410 nt, Artificial Sequence
  derived and/or modified sequence opt3 from neuraminidase__InfluenzaA__AHC61082
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguugugcugugugaaccgacuauaaucgagagaaauauuaccgaaaucguauauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucugggugacccgcgagccuuaugucucgugcgauccagacaaguguuaccaauucgcgcugggccaggggacgacucuaaauaacgugcauucaaauaacaccguucgagaucguacacccuauagaacucuccugaugaaugaacuuggagugccuuuucaccugggcaccaagcaggucugcauugcuuggagcaguuccucuugucaugacgguaaagccugguugcacgugugcaucacaggggaugacaagaacgcaaccgccagcuucaucuacaauggaaggcucguagauuccguugugucauggaguaaagagauucugcggacgcaggaaagcgagugugucugcauaaacggcacuuguacaguggugaugaccgacggcucugcuuccgggaaggcagauacuaaaauccuguuuauugaggaaggaaagaucguccauacaucaacccucagcgguagugcccaacacguugaggaaugcucuugcuauccacgcuacccgggcgugagauguguaugcagggacaacuggaagggguccaaucggcccauaguggauauuaacaucaaagaccacagcaucgucucgucuuacguguguuccggauuaguuggcgacacgccucgcaagaaugauucaaguagcuccucucauugccuggacccaaacaaugaggaaggugggcacggagugaaaggcugggcuuucgaugacggcaacgaugucuggauggggcgaaccauuaaugagacaagcagacuuggauaugagacuuuuaaggugaucgaagguuggucaaaccccaaaaguaaguugcagauuaauaggcagguaauaguugaccggggcgaucguuccggguacagcggaaucuucucuguggagggcaaaucauguauuaaccgcugcuuuuaugucgaacugaucagagguaggaaggaggaaaccggggugcuauggacaaguaauagcaucgucguguucuguggcacuuccggaaccuacggcacagggucuuggccugacggagccgaucucaaccugaugccaauuuga

SEQ ID NO: 146215 - RNA, 1410 nt, Artificial Sequence; identical to SEQ ID NO: 141534
  derived and/or modified sequence opt3 from neuraminidase__InfluenzaA__AHC61094

SEQ ID NO: 146216 - RNA, 1410 nt, Artificial Sequence; identical to SEQ ID NO: 146023
  derived and/or modified sequence opt3 from neuraminidase__InfluenzaA__AHC61106

SEQ ID NO: 146217 - RNA, 1410 nt, Artificial Sequence; identical to SEQ ID NO: 146023
  derived and/or modified sequence opt3 from neuraminidase__InfluenzaA__AHC61118

SEQ ID NO: 146218 - RNA, 1410 nt, Artificial Sequence; identical to SEQ ID NO: 145987
  derived and/or modified sequence opt3 from neuraminidase__InfluenzaA__AHC61130

SEQ ID NO: 146219 - RNA, 1410 nt, Artificial Sequence; identical to SEQ ID NO: 146134
  derived and/or modified sequence opt3 from neuraminidase__InfluenzaA__AHC61142

SEQ ID NO: 146220 - RNA, 1410 nt, Artificial Sequence; identical to SEQ ID NO: 146023
  derived and/or modified sequence opt3 from neuraminidase__InfluenzaA__AHC61154

SEQ ID NO: 146221 - RNA, 1410 nt, Artificial Sequence
  derived and/or modified sequence opt3 from neuraminidase__InfluenzaA__AHC61166
augaaccccaaucagaagaucauuaccauaggcagcgugucccugacaaucucuacuauuugcuucuuuaugcaagucgccauccucauuacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaauuagcugaguacaggaauuggaguaagccucagugugacaucacaggguucgcaccauuuagcaaagauaacuccauacggcugucugccggaggugacauuugggugacccgcgagcccuaugucucgugcgauccugacaaguguuaccaauucgcgcuaggccaggggacgacucucaauaacgugcauucaaauaacaccguucgagaucguacaccauauagaacucugcuuaugaaugaacugggagugcccuuucacuugggcaccaagcaggucugcaucgcuuggagcaguuccucuugucaugacgguaaagccuggcuccacgugugcauuacaggggaugacaagaacgcaaccgccagcuucaucuacaauggaaaacugguagauuccguugugucauggaguaaggagauccugaggacgcaggaaagcgagugugucugcauuaacggcacuuguacaguggugaugaccgacggcucugcuuccgggaaagcagauacuaagauacucuuuaucgaggaaggaaagauuguccauacaucaaccuuaagcgguagugcccaacacguugaggaaugcucuugcuauccucgguacccaggcgugcgcuguguaugcagagacaacuggaaaggguccaauaggccgaucguggauauaaacauuaaggaccacagcaucgucucgucuuacguguguuccggacugguuggcgacacgccccggaaaaaugauucaaguagcuccucucauugccuugacccuaacaaugaggaaggugggcacggagugaagggcugggcuuucgaugacggcaacgaugucuggauggggcgcaccaucaaugagacaagccgauugggauaugagacuuuuaaagugauugaagguuggucaaacccaaagaguaaacugcagaccaauagacagguaaucguugacaggggcaaccgguccggguacagcggaauuuucucuguggagggcaagucauguauaaaucguugcuuuuaugucgaacuaauccgcgguagaaaggaggaaacagaggugcucuggaccaguaacagcauugucguguucugugggacuuccggcacauacggaaccggcucuuggcccgauggggccgaccugaaucuuaugccuaucuga

SEQ ID NO: 146222 - RNA, 1410 nt, Artificial Sequence; identical to SEQ ID NO: 145987
  derived and/or modified sequence opt3 from neuraminidase__InfluenzaA__AHC61178

SEQ ID NO: 146223 - RNA, 1410 nt, Artificial Sequence; identical to SEQ ID NO: 146023
  derived and/or modified sequence opt3 from neuraminidase__InfluenzaA__AHC61190

SEQ ID NO: 146224 - RNA, 1410 nt, Artificial Sequence; identical to SEQ ID NO: 146036
  derived and/or modified sequence opt3 from neuraminidase__InfluenzaA__AHC61202

SEQ ID NO: 146225 - RNA, 1410 nt, Artificial Sequence; identical to SEQ ID NO: 145991
  derived and/or modified sequence opt3 from neuraminidase__InfluenzaA__AHC61214

SEQ ID NO: 146226 - RNA, 1410 nt, Artificial Sequence; identical to SEQ ID NO: 146036
  derived and/or modified sequence opt3 from neuraminidase__InfluenzaA__AHC61226

SEQ ID NO: 146227 - RNA, 1410 nt, Artificial Sequence; identical to SEQ ID NO: 146023
  derived and/or modified sequence opt3 from neuraminidase__InfluenzaA__AHC61238

SEQ ID NO: 146228 - RNA, 1410 nt, Artificial Sequence; identical to SEQ ID NO: 146204
  derived and/or modified sequence opt3 from neuraminidase__InfluenzaA__AHC61250

SEQ ID NO: 146229 - RNA, 1410 nt, Artificial Sequence; identical to SEQ ID NO: 145987
  derived and/or modified sequence opt3 from neuraminidase__InfluenzaA__AHC61262

SEQ ID NO: 146230 - RNA, 1410 nt, Artificial Sequence; identical to SEQ ID NO: 145991
  derived and/or modified sequence opt3 from neuraminidase__InfluenzaA__AHC61274

SEQ ID NO: 146231 - RNA, 1410 nt, Artificial Sequence; identical to SEQ ID NO: 141534
  derived and/or modified sequence opt3 from neuraminidase__InfluenzaA__AHC61286

SEQ ID NO: 146232 - RNA, 1410 nt, Artificial Sequence; identical to SEQ ID NO: 146035
  derived and/or modified sequence opt3 from neuraminidase__InfluenzaA__AHC61298

SEQ ID NO: 146233 - RNA, 1410 nt, Artificial Sequence
  derived and/or modified sequence opt3 from neuraminidase__InfluenzaA__AHC61310
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaaacugguggacuccguaguuucauggaguaaggagauucugaggacgcaggaaagcgagugugugugcauaaacggcacuuguacagucgugaugaccgauggcucugcuuccgggaaagcagacacuaagauccucuuuauugaggaaggaaagaucgugcauacaucaaccuuaagcgguagugcccaacacgucgaggaaugcucuugcuauccucgguacccaggcguucgcugugugugcagagauaauuggaaaggguccaacaggccgauaguagacauuaauaucaaggaucacagcaucgugucgucuuacgucuguuccggacuggugggcgacacgccccggaaaaacgacucaaguagcuccucucauugccuugauccuaauaacgaggaaggugggcacggaguuaagggcugggcuuucgacgauggcaaugacguguggauggggcgcaccauuaacgagacaagccgauugggauaugagacuuuuaaagucaucgaagguuggucaaauccaaagaguaaacugcagauuaacagacaggugauaaucgauaggggcaaucgguccggguacagcggaauuuucucuguagagggcaagucauguaucaaccguugcuuuuauguugaacuaauccgcgguagaaaggaggaaaccgaggugcucuggacaaguagcuccauugucguguucugugggacuucuggcaccuacggaacaggcucguggcccgacggggccgaucugaaucuuaugccuauauga

SEQ ID NO: 146234 - RNA, 1410 nt, Artificial Sequence; identical to SEQ ID NO: 146064
  derived and/or modified sequence opt3 from neuraminidase__InfluenzaA__AHC61322

SEQ ID NO: 146235 - RNA, 1410 nt, Artificial Sequence; identical to SEQ ID NO: 146023
  derived and/or modified sequence opt3 from neuraminidase__InfluenzaA__AHC61334

SEQ ID NO: 146236 - RNA, 1410 nt, Artificial Sequence; identical to SEQ ID NO: 145991
  derived and/or modified sequence opt3 from neuraminidase__InfluenzaA__AHC61346

SEQ ID NO: 146237 - RNA, 1410 nt, Artificial Sequence
  derived and/or modified sequence opt3 from neuraminidase__InfluenzaA__AHC61358
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauauuucaaguagcucccauugccuugacccuaacaaugaggaaggugggcacggaguuaaaggcugggcuuucgaugacggcaacgauguguggauggggcgaaccaucaaugagacaucuagauugggauaugagacuuuuaaggucauuaaagguuggagcaacccaaagucaaaacugcagauaaauaggcaagugaucguagaccggggcaaccguaguggguacuccggaauuuucagcguugaaggcaagucuuguaucaaucgcugcuuuuauguggagcuaaucagagguaggaaggaagagaccgaaguccucuggacaucaaacaguauuguggucuucugugggacuagcggcaccuacggaacaggcuccuggcccgauggggccgaccugaaucuuaugccuauauga

SEQ ID NO: 146238 - RNA, 1410 nt, Artificial Sequence; identical to SEQ ID NO: 146036
  derived and/or modified sequence opt3 from neuraminidase__InfluenzaA__AHC61370

SEQ ID NO: 146239 - RNA, 1410 nt, Artificial Sequence; identical to SEQ ID NO: 146064
  derived and/or modified sequence opt3 from neuraminidase__InfluenzaA__AHC61382

SEQ ID NO: 146240 - RNA, 1410 nt, Artificial Sequence; identical to SEQ ID NO: 146036
  derived and/or modified sequence opt3 from neuraminidase__InfluenzaA__AHC61394

SEQ ID NO: 146241 - RNA, 1410 nt, Artificial Sequence; identical to SEQ ID NO: 146064
  derived and/or modified sequence opt3 from neuraminidase__InfluenzaA__AHC61406

SEQ ID NO: 146242 - RNA, 1410 nt, Artificial Sequence; identical to SEQ ID NO: 146023
  derived and/or modified sequence opt3 from neuraminidase__InfluenzaA__AHC61418

SEQ ID NO: 146243 - RNA, 1410 nt, Artificial Sequence; identical to SEQ ID NO: 141534
  derived and/or modified sequence opt3 from neuraminidase__InfluenzaA__AHC61430

SEQ ID NO: 146244 - RNA, 1410 nt, Artificial Sequence; identical to SEQ ID NO: 146036
  derived and/or modified sequence opt3 from neuraminidase__InfluenzaA__AHC61442

SEQ ID NO: 146245 - RNA, 1410 nt, Artificial Sequence; identical to SEQ ID NO: 146036
  derived and/or modified sequence opt3 from neuraminidase__InfluenzaA__AHC61454

SEQ ID NO: 146246 - RNA, 1410 nt, Artificial Sequence
  derived and/or modified sequence opt3 from neuraminidase__InfluenzaA__AHC61466
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauaccacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaauaacacagugcgagaucguacuccauauagaacccugcuuaugaaugaacugggaguucccuuucacuugggcacaaaacaggugugcaucgcuuggagcaguuccucuugucaugacgguaaggccuggcuccacgucugcauuaccggggaugacaagaacgcaacggccagcuucaucuacaauggaaggcugguggauuccguaguuucauggaguaaagagauccugcggacucaggaaagcgagugugugugcauuaacggcacauguaccgucgugaugacugacggcucugcuuccgggaaggcagauacaaaaauacucuuuaucgaggaaggaaagauugugcauaccucaacguuaagcgguagugcccaacacgucgaggaaugcucuugcuauccucgcuacccaggcguuagaugugugugcagggacaacuggaagggguccaaucggccgaucguagauauaaacauuaaagaccacagcaucgugucgucuuacgucuguuccggacuggugggcgacacccccaggaagaaugauucaaguagcuccucucauugccuugacccuaacaaugaggaaggugggcacggaguuaaaggcugggcuuucgaugacggcaacgauguguggauggggcgaacaaucaaugagacuagcagauugggauaugagaccuuuaaggucauugaagguuggucaaacccaaaaaguaagcugcagaucaaucgccaggugauuguagacaaaggcaaccgguccggguacagcggaauauucucuguugagggcaagucauguaucaaucguugcuuuuauguggaacuaauucgcgguagaaaggaggaaacagagguccucuggaccaguaacagcaucguggucuucugugggacuuccggcacauacggaaccggcucuuggcccgauggggccgaccugaaucuuaugccuaucuga

SEQ ID NO: 146247 - RNA, 1410 nt, Artificial Sequence; identical to SEQ ID NO: 145987
  derived and/or modified sequence opt3 from neuraminidase__InfluenzaA__AHC61478

SEQ ID NO: 146248 - RNA, 1410 nt, Artificial Sequence; identical to SEQ ID NO: 146023
  derived and/or modified sequence opt3 from neuraminidase__InfluenzaA__AHC61490

SEQ ID NO: 146249 - RNA, 1410 nt, Artificial Sequence; identical to SEQ ID NO: 145987
  derived and/or modified sequence opt3 from neuraminidase__InfluenzaA__AHC61502

SEQ ID NO: 146250 - RNA, 1410 nt, Artificial Sequence; identical to SEQ ID NO: 146036
  derived and/or modified sequence opt3 from neuraminidase__InfluenzaA__AHC61514

SEQ ID NO: 146251 - RNA, 1410 nt, Artificial Sequence; identical to SEQ ID NO: 144938
  derived and/or modified sequence opt3 from neuraminidase__InfluenzaA__AHC61526

SEQ ID NO: 146252 - RNA, 1410 nt, Artificial Sequence
  derived and/or modified sequence opt3 from neuraminidase__InfluenzaA__AHC61538
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaaacugguggacuccguaguuucauggaguaaggagauucugaggacgcaggaaagcgagugugugugcauaaacggcacuuguacagucgugaugaccgauggcucugcuuccgggaaagcagacacuaagauccucuuuauugaggaaggaaagaucgugcauacaucaaccuuaagcgguagugcccaacacgucgaggaaugcucuugcuauccucgguacccaggcguucgcugugugugcagagauaauuggaaaggguccaacaggccgauaguagacauuaauaucaaggaucacagcaucgugucgucuuacgucuguuccggacuggugggcgacacgccccggaaaaacgacucaaguagcuccucucauugccuugauccuaauaacgaggaagguagccacgggguuaagggaugggcuuucgacgauggcaaugacguguggaugggccgcaccauuaacgagacaucacgauugggguaugagacuuuuaaagucaucgaaggauggaguaauccaaaguccaaacugcagauuaacagacaggugauaguagauagggguaaucggagcggcuacucugggaucuucucaguugagggaaagaguuguauuaaccguugcuuuuauguggaacuaauccgcggcagaaaggaggaaaccgagguccucuggacaagcaauuccaucguggucuucugugguacuucugggaccuacggcacaggaucguggcccgacggcgccgaucugaaccuuaugccuauuuga

SEQ ID NO: 146253 - RNA, 1410 nt, Artificial Sequence; identical to SEQ ID NO: 146036
  derived and/or modified sequence opt3 from neuraminidase__InfluenzaA__AHC61550

SEQ ID NO: 146254 - RNA, 1410 nt, Artificial Sequence
  derived and/or modified sequence opt3 from neuraminidase__InfluenzaA__AHC61562
augaaccccaaucagaagaucauuaccauaggcagcgugucccugacaaucucuacuauuugcuucuuuaugcagaucgccauucucaucacgaccgucacacuucacuucaaacaguacgaguuuuauucaccuccaaacaaucagguuaugcugugugaaccgacuaugauagagagaaacaucaccgaaauuguguacuugacaaauaccacuaucgagaaggaaauuugccccaaauuagcugaguauaggaacuggaguaagccucagugugacaucacaggguucgcaccauuuagcaaagauaauuccauacggcugucugccggaggugacauuuggguaacccgcgagcccuacgugucgugcgauccugacaaguguuaucaauucgcgcuaggccaggggacgacucucaacaauguccauucaaacaauaccgugcgagaucguacaccauacagaacucugcuuaugaacgaacugggaguucccuuucacuugggcaccaaacaggugugcaucgcuuggagcaguuccucuugucaugacgguaaggccuggcuccacgucugcauuacaggggaugacaagaaugcaaccgccagcuucaucuauaacggaaggcugguggauuccguaguuucauggaguaaagagauccugcggacgcaggaaagcgagugugugugcauuaauggcacuuguacagucgugaugaccgacggcucugcuuccgggaaggcagauacuaaaauacucuuuaucgaggaaggaaagauugugcauacaucaaccuuaagcgguagugcccaacacgucgaggaaugcucuugcuacccucgcuacccaggcguuagaugugugugcagggacaacuggaagggguccaaccggccgaucguagauauaaauauuaaagaccacagcaucgugucgucuuaugucuguuccggacuggugggcgacacgccccgcaagaacgauucaaguagcuccucucauugccuugacccuaauaacgaggaaggugggcacggaguuaaaggcugggcuuucgaugacggcaaugauguguggauggggcgaaccaucaacgagacaagcagauugggauacgagacuuuuaaggucauugaagguuggucaaauccaaaaaguaagcugcagaucaacaggcaagugauuguagaccggggcaaucguuccggguauagcggaauauucucuguugagucaaaaaguuguaucaaccgcugcuuuuacguggaacuaauuagaggcaggaaggaggaaaccgagguccucuggacaagcaauuccaucguggucuucugugguacuucugggaccuauggcacaggaaccuggcccgauggcgccgaccugaaccuuaugccuaucuga

SEQ ID NO: 146255 - RNA, 1410 nt, Artificial Sequence; identical to SEQ ID NO: 146035
  derived and/or modified sequence opt3 from neuraminidase__InfluenzaA__AHC61574

SEQ ID NO: 146256 - RNA, 1410 nt, Artificial Sequence; identical to SEQ ID NO: 146036
  derived and/or modified sequence opt3 from neuraminidase__InfluenzaA__AHC61586

SEQ ID NO: 146257 - RNA, 1410 nt, Artificial Sequence; identical to SEQ ID NO: 144938
  derived and/or modified sequence opt3 from neuraminidase__InfluenzaA__AHC61598

SEQ ID NO: 146258 - RNA, 1410 nt, Artificial Sequence; identical to SEQ ID NO: 145987
  derived and/or modified sequence opt3 from neuraminidase__InfluenzaA__AHC61610

SEQ ID NO: 146259 - RNA, 1410 nt, Artificial Sequence; identical to SEQ ID NO: 146035
  derived and/or modified sequence opt3 from neuraminidase__InfluenzaA__AHC61622

SEQ ID NO: 146260 - RNA, 1410 nt, Artificial Sequence; identical to SEQ ID NO: 141534
  derived and/or modified sequence opt3 from neuraminidase__InfluenzaA__AHC61634

SEQ ID NO: 146261 - RNA, 1410 nt, Artificial Sequence; identical to SEQ ID NO: 141534
  derived and/or modified sequence opt3 from neuraminidase__InfluenzaA__AHC61646

SEQ ID NO: 146262 - RNA, 1410 nt, Artificial Sequence; identical to SEQ ID NO: 141534
  derived and/or modified sequence opt3 from neuraminidase__InfluenzaA__AHC61658

SEQ ID NO: 146263 - RNA, 1410 nt, Artificial Sequence; identical to SEQ ID NO: 144938
  derived and/or modified sequence opt3 from neuraminidase__InfluenzaA__AHC61670

SEQ ID NO: 146264 - RNA, 1410 nt, Artificial Sequence; identical to SEQ ID NO: 145991
  derived and/or modified sequence opt3 from neuraminidase__InfluenzaA__AHC61682

SEQ ID NO: 146265 - RNA, 1410 nt, Artificial Sequence; identical to SEQ ID NO: 144938
  derived and/or modified sequence opt3 from neuraminidase__InfluenzaA__AHC61694

SEQ ID NO: 146266 - RNA, 1410 nt, Artificial Sequence
  derived and/or modified sequence opt3 from neuraminidase__InfluenzaA__AHC61706
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagagcacagcaucgugucgucuuacgucuguuccggacuggugggcgacacgccccgcaagaaugacucaaguagcuccucucauugccuugauccuaacaaugaagagggugggcacggaguuaaaggcugggcuuucgacgauggcaacgacguguggauggggcgaaccauuaaugagacaagcagauugggauaugaaacuuuuaaggucaucgaggguuggucaaacccaaaaaguaagcugcagauuaauaggcaagugauaguagaucggggcaaccguuccggguacagcggaaucuucucuguugaaggcaaaucauguauuaaucgcugcuuuuauguggagcuaaucagagguaggaaggaagagaccgagguccucuggacaaguaacagcaucguggucuucugugggacuuccggcaccuacggaacaggcucuuggcccgacggggccgaucugaaucuuaugccuauuuga

SEQ ID NO: 146267 - RNA, 1410 nt, Artificial Sequence
  derived and/or modified sequence opt3 from neuraminidase__InfluenzaA__AHC61718
augaaccccaaucagaagaucauuaccauaggcagcgugucccugacaaucucuacuauuugcuucuuuaugcaaaucgccauucucaucacgaccgucacacuucacuucaaacagugugaguuuaacucaccuccaaauaaccagguuaugcugugcgaaccgacuauaaucgagagaaauauuaccgaaaucguguacuugacaaacaccacuauugagaaggaaaucugucccaaauuaacagaguauaggaauuggaguaagccucagugcgacauaaccggguucgcuccauuuagcaaagauaacuccauucggcugucugcaggaggugacaucuggguaacgcgcgagcccuacgugucgugugauccuaauaagugcuaucaauucgcccuaggccaggggacuacccucaacaauguccauucaaacaauacagugcgagaccguacuccauacagaacccugcuuaugaacgaacugggaguucccuuucacuugggcacaaaacagguguguauugcguggagcaguuccucuugccaugaugguaaggcuuggcuccacgucuguaucaccggggacgauaagaaugccacggccagcuucaucuauaacggaaaacugguggacuccguaguuucauggaguaaggagauucugaggacucaggaaagcgagugcguguguauaaacggcacaugcaccgucgugaugacugauggcucugcauccgggaaagcugacacaaagauccucuuuauugaggaaggaaagaucgugcauaccucaacguuaagcgguagugcacaacacgucgaggaaugcucuuguuacccucgguauccaggcguucgcugcguguguagagauaauuggaaaggguccaacaggccgauaguagacauuaauaucaaggaucacagcaucgugucgucuuacgucugcuccggacuggugggcgacacuccccggaaaaacgacucaaguagcuccucucauugucuugauccuaauaacgaggaaggugggcacggaguuaagggcugggccuucgacgauggcaaugacguguggauggggcgcacaauuaacgagacuagccgauugggauacgagaccuuuaaagucaucgaagguuggucaaauccaaagaguaaacugcagauuaacagacaggugauaguagauaggggcaaucgguccggguauagcggaaucuucucuguugagggcaagucaugcauuaaccguuguuuuuacguggaacuaauccgcgguagaaaggaggaaacagggguccucuggaccaguaauagcaucguggucuucugcggcaccuccggaacauauggcaccgggucuuggcccgacggagcugaucugaaccuuaugccuauuuga

SEQ ID NO: 146268 - RNA, 1410 nt, Artificial Sequence; identical to SEQ ID NO: 145987
  derived and/or modified sequence opt3 from neuraminidase__InfluenzaA__AHC61730

SEQ ID NO: 146269 - RNA, 1410 nt, Artificial Sequence; identical to SEQ ID NO: 146036
  derived and/or modified sequence opt3 from neuraminidase__InfluenzaA__AHC61742

SEQ ID NO: 146270 - RNA, 1410 nt, Artificial Sequence; identical to SEQ ID NO: 145987
  derived and/or modified sequence opt3 from neuraminidase__InfluenzaA__AHC61754

SEQ ID NO: 146271 - RNA, 1410 nt, Artificial Sequence; identical to SEQ ID NO: 141534
  derived and/or modified sequence opt3 from neuraminidase__InfluenzaA__AHC61766

SEQ ID NO: 146272 - RNA, 1410 nt, Artificial Sequence; identical to SEQ ID NO: 146023
  derived and/or modified sequence opt3 from neuraminidase__InfluenzaA__AHC61778

SEQ ID NO: 146273 - RNA, 1410 nt, Artificial Sequence; identical to SEQ ID NO: 146061
  derived and/or modified sequence opt3 from neuraminidase__InfluenzaA__AHC61790

SEQ ID NO: 146274 - RNA, 1410 nt, Artificial Sequence; identical to SEQ ID NO: 145991
  derived and/or modified sequence opt3 from neuraminidase__InfluenzaA__AHC61802

SEQ ID NO: 146275 - RNA, 1410 nt, Artificial Sequence; identical to SEQ ID NO: 145987
  derived and/or modified sequence opt3 from neuraminidase__InfluenzaA__AHC61814

SEQ ID NO: 146276 - RNA, 1410 nt, Artificial Sequence
  derived and/or modified sequence opt3 from neuraminidase__InfluenzaA__AHC61826
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguugugcugugugaaccgacuauaaucgagagaaauauuaccgaaaucguauauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucugggugacccgcgagccuuaugucucgugcgauccagacaaguguuaccaauucgcgcugggccaggggacgacucuaaauaacgugcauucaaauaacaccguucgagaucguacacccuauagaacucuccugaugaaugaacuuggagugccuuuucaccugggcaccaagcaggucugcauugcuuggagcaguuccucuugucaugacgguaaagccugguugcacgugugcaucacaggggaugacaagaacgcaaccgccagcuucaucuacaauggaaggcucguagauuccguugugucauggaguaaagagauucugcggacgcaggaaagcgagugugucugcauaaacggcacuuguacaguggugaugaccgacggcucugcuuccgggaaggcagauacuaaaauccuguuuauugaggaaggaaagaucguccauacaucaacccucagcgguagugcccaacacguugaggaaugcucuugcuauccacgcuacccgggcgugagauguguaugcagggacaacuggaagggguccaaucggcccauaguggauauuaacaucaaagaccacagcaucgucucgucuuacguguguuccggauuaguuggcgacacgccucgcaagaaugauucaaguagcuccucucauugccuggacccaaacaaugaggaaggugggcacggagugaaaggcugggcuuucgaugacggcaacgaugucuggauggggcgaaccauuaaugagacaagcagacuuggauaugagacuuuuaaggugaucgaagguuggucaaaccccaaaaguaaguugcagauuaauaggcagguaauaguugaccgguccgaucguagcggcuacucugggaucuucucaguggagggaaaaaguuguauuaaccgcugcuuuuaugucgaacugaucagaggcaggaaggaggaaaccgaggugcuauggacaagcaauuccaucgucguguucugugguacuucugggaccuacggcacaggaucguggccugacggcgccgaucucaaccugaugccaauuuga

SEQ ID NO: 146277 - RNA, 1410 nt, Artificial Sequence; identical to SEQ ID NO: 145987
  derived and/or modified sequence opt3 from neuraminidase__InfluenzaA__AHC61838

SEQ ID NO: 146278 - RNA, 1410 nt, Artificial Sequence; identical to SEQ ID NO: 146023
  derived and/or modified sequence opt3 from neuraminidase__InfluenzaA__AHC61850

SEQ ID NO: 146279 - RNA, 1410 nt, Artificial Sequence; identical to SEQ ID NO: 146036
  derived and/or modified sequence opt3 from neuraminidase__InfluenzaA__AHC61862

SEQ ID NO: 146280 - RNA, 1410 nt, Artificial Sequence; identical to SEQ ID NO: 145987
  derived and/or modified sequence opt3 from neuraminidase__InfluenzaA__AHC61874

SEQ ID NO: 146281 - RNA, 1410 nt, Artificial Sequence
  derived and/or modified sequence opt3 from neuraminidase__InfluenzaA__AHC61886
augaaccccaaucagaagaucauuaccauaggcagcgugucccugacaaucucuacuauuugcuucuuuaugcaaaucgccauucucaucacgaccgucacacuucacuucaaacaguacgaguuuaacccuccaccgaauaaccagguugugcugugugaacccacuauaaucgagagaaauauuaccgaaaucguauauuugacaaacaccacuauugagaaggaaaucugcccuaaaccagcugaguacaggcauuggucaaagccccagugugacauaacaggguucgcaccuuuuaguaaagauaauagcauucgguuauccgccggaggugacaucugggugacccgcgagccauaugucucuugcgaucccgacaaguguuaccaauucgcgcugggccaggggacgacucuaaacaaugugcacucgaacaauaccguucgagaucguacaccuuauagaacucuccugaugaacgaacuuggagugccauuucaucugggcaccaagcaggucugcauugcuuggucaagcaguuccugucacgacgguaaagccugguugcaugugugcaucacaggggaugacaagaaugcaaccgccucuuucaucuacaacggaaggcucguagauagcguuguguccuggucaaaagagauucugcggacgcaggaaagugagugugucugcauaaauggcacuuguacaguggugaugaccgacggcagcgcuucugggaaggcagauacuaaaauccuguuuauugaggaaggaaagaucguccacacauccacccucucagguagcgcccaacacguugaggaaugcaguugcuauccgcgcuaccccggcgugagauguguaugcagggacaacuggaaggggucuaaccggccuauaguggauauuaauaucaaagaccauuccaucgucagcucguacguguguucuggauuaguuggcgacacgccacgcaagaacgauuccucaaguagcucccacugccuggaccccaauaacgaggaaggugggcauggagugaaaggcugggcuuucgaugacggcaaugaugucuggauggggcgaaccauuaacgagacaucuagacuuggauaugagacuuuuaaggugaucgaagguuggagcaauccuaaaucaaaguugcagauuaacaggcagguaauaguugaccggggcgaucguaguggguacuccggaaucuucagcguggagggcaaaucuuguauuaaucgcugcuuuuaugucgaacugaucagagguaggaaggaggaaaccgaggugcuauggacaucaaacaguaucgucguguucugugggacuagcggcaccuacggaacaggcuccuggccagacggggccgaucucaaucugaugcccauuuga

SEQ ID NO: 146282 - RNA, 1410 nt, Artificial Sequence; identical to SEQ ID NO: 145991
  derived and/or modified sequence opt3 from neuraminidase__InfluenzaA__AHC61898

SEQ ID NO: 146283 - RNA, 1410 nt, Artificial Sequence; identical to SEQ ID NO: 146023
  derived and/or modified sequence opt3 from neuraminidase__InfluenzaA__AHC61910

SEQ ID NO: 146284 - RNA, 1410 nt, Artificial Sequence; identical to SEQ ID NO: 141534
  derived and/or modified sequence opt3 from neuraminidase__InfluenzaA__AHC61934

SEQ ID NO: 146285 - RNA, 1410 nt, Artificial Sequence
  derived and/or modified sequence opt3 from neuraminidase__InfluenzaA__AHC61946
augaaccccaaucagaagaucauuaccauaggcagcgugucccugacaaucucuacuauuugcuucuuuaugcagaucgccauucucaucacgaccgucacacuucacuucaaacaguacgagucauauaguccuccaaacaaucagguuaugcugugugaaccgacuauaaucgagagaaacauuaccgaaaucguguacuugacaaauaccacuauugagaaggaaaucugccccaaauuagcugaguauaggaacuggagcaagccucagugugacauaacaggguuugcaccauucuccaaagauaauucuauucggcugucggccggaggugacaucuggguaacccgcgagcccuacgugucaugcgauccugacaaguguuaucaauuugcgcuaggccaggggacgacucucaacaauguccauagcaacaauaccgugcgagaucguacaccauacagaacucugcuuaugaacgaacugggaguucccuuccacuugggcaccaaacaggugugcauugcuuggaguuccucuagcugucaugacgguaaggccuggcuccacgucugcaucacaggggaugacaagaaugcaaccgccuccuuuaucuauaacggaaggcugguggauucaguaguuaguuggagcaaagagauucugcggacgcaggaaucugagugugugugcauaaauggcacuuguacagucgugaugaccgacggcuccgcuucagggaaggcagauacuaaaauccucuucauugaggaaggaaagaucgugcauacaagcaccuuaagugguucugcccaacacgucgaggaaugcuccugcuacccucgcaacccaggcguuagaugugugugcagggacaacuggaaggggagcaaucggccgauaguagauauuaacaucaaagaccacucgaucgugucuuccuacgucuguucaggacuggugggcgacacgccccgcaagaaugauaguagcuccucuagccauugccuugacccuaacaaugaggaaggugggcacggaguuaaaggcugggcuuuugaugacggcaacgauguguggauggggcgaaccauuaaugagacaucaagauugggauaugagacuuucaaggucaucgaagguuggaguaacccaaaauccaagcugcagauuaauaggcaagugauaguagaccggggcaaccguagcggguacucuggaaucuuuucaguugagggcaaaaguuguauuaaucgcugcuucuauguggaacuaaucagagguaggaaggaggaaaccgagguccucuggacaagcaacuccaucguggucuuuugugggacuucuggcaccuacggaacaggcucguggcccgauggggccgaccugaaucuuaugccuauuuga

SEQ ID NO: 146286 - RNA, 1410 nt, Artificial Sequence; identical to SEQ ID NO: 144938
  derived and/or modified sequence opt3 from neuraminidase__InfluenzaA__AHC61958

SEQ ID NO: 146287 - RNA, 1410 nt, Artificial Sequence; identical to SEQ ID NO: 145987
  derived and/or modified sequence opt3 from neuraminidase__InfluenzaA__AHC61970

SEQ ID NO: 146288 - RNA, 1410 nt, Artificial Sequence
  derived and/or modified sequence opt3 from neuraminidase__InfluenzaA__AHC61982
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuugugcugucgugaugacagacggcucugcauccgggaaggccgauaccaaaauccucuuuauugaggaaggaaagaucgugcauacuucaacauuaagcgguagugcucaacacgucgaggaaugcucuugcuauccucgcuacccaggcguuagaugugugugcagggacaacuggaagggguccaaucggccgauaguagauauuaacaucaaagaccacggaaucgugagcucguacgucuguucuggccuggugggugacacccccaggaagaaugauuccucaaguagcucccauugccuugacccuaacaaugaggaagggggacacggcguuaaaggcugggccuucgaugacgggaacgauguguggaugggacgaacgauuaaugagaccucuagauuggguuaugagacauuuaaggucaucgaaggcuggagcaacccaaaaucaaagcugcagauuaaucgccaggugauaguagaccgggggaaccguaguggauacuccggcaucuucagcguugaggguaaaucuuguauuaaucgcugcuuuuauguggaacuaaucagagggaggaaggaggaaacugagguccucuggaccucaaacaguaucguggucuucuguggcacaagcggaacuuacggcaccggguccuggcccgauggagcggaccugaaucuuaugccuauuuga

SEQ ID NO: 146289 - RNA, 1410 nt, Artificial Sequence; identical to SEQ ID NO: 145991
  derived and/or modified sequence opt3 from neuraminidase__InfluenzaA__AHC61994

SEQ ID NO: 146290 - RNA, 1410 nt, Artificial Sequence; identical to SEQ ID NO: 146023
  derived and/or modified sequence opt3 from neuraminidase__InfluenzaA__AHC62006

SEQ ID NO: 146291 - RNA, 1410 nt, Artificial Sequence; identical to SEQ ID NO: 145987
  derived and/or modified sequence opt3 from neuraminidase__InfluenzaA__AHC62018

SEQ ID NO: 146292 - RNA, 1410 nt, Artificial Sequence; identical to SEQ ID NO: 144938
  derived and/or modified sequence opt3 from neuraminidase__InfluenzaA__AHC62030

SEQ ID NO: 146293 - RNA, 1410 nt, Artificial Sequence; identical to SEQ ID NO: 145991
  derived and/or modified sequence opt3 from neuraminidase__InfluenzaA__AHC62042

SEQ ID NO: 146294 - RNA, 1410 nt, Artificial Sequence; identical to SEQ ID NO: 146064
  derived and/or modified sequence opt3 from neuraminidase__InfluenzaA__AHC62053

SEQ ID NO: 146295 - RNA, 1410 nt, Artificial Sequence
  derived and/or modified sequence opt3 from neuraminidase__InfluenzaA__AHC62065
augaaccccaaucagaagaucauuaccauaggcagcgugucccugacaaucucuacuauuugcuucuuuaugcaaaucgccauucucgucacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaaccugcugaguacaggaauuggaguaagccacagugugacaucacaggguucgcacccuuuagcaaagauaacuccauacgguuaucugccggaggugacauuugggugacccgcgagccuuaugucucgugcgauccagacaaguguuaccaauucgcgcugggccaggggacgacucuaaauaacgugcauucaaauaacaccguucgagaucguacacccuauagaacucuccugaugaaugaacuuggagugccuuuucaccugggcaccaagcaggucugcaucgcuuggagcaguuccucuugucaugacgguaaagccugguugcacgugugcauuacaggggaugacaagaacgcaaccgccagcuucaucuacaauggaaggcucguagauuccguugugucauggaguaaagagauccugcggacgcaggaaagcgagugugucugcauuaacggcacuuguacaguggugaugaccgacggcucugcuuccgggaaggcagauacuaaaauacuguuuaucgaggaaggaaagauuguccauacaucaacccucagcgguagugcccaacacguugaggaaugcucuugcuauccacgcuacccgggcgugagauguguaugcagggacaacuggaagggguccaaucggcccaucguggauauaaacauuaaagaccacagcaucgucucgucuuacguguguuccggauuaguuggcgacacgccucgcaagaaugauucaaguagcuccucucauugccuggacccaaacaaugaggaaggugggcacggagugaaaggcugggcuuucgaugacggcaacgaugucuggauggggcgaaccaucaaugagacaagcagacuuggauaugagacuuuuaaggugauugaagguuggucaaaccccaaaaguaaguugcagaucaauaggcagguaauuguugaccggggcgaucguuccggguacagcggaauauucucuguggagggcaaaucauguaucaaccgcugcuuuuaugucgaacugauuagagguaggaaggaggaaaccgaggugcuauggacaaguaauagcaucgucguguucugugggacuuccggcaccuacggaacaggcucuuggccugacggggccgaucucaaccugaugccaaucuga

SEQ ID NO: 146296 - RNA, 1410 nt, Artificial Sequence; identical to SEQ ID NO: 146122
  derived and/or modified sequence opt3 from neuraminidase__InfluenzaA__AHC62077

SEQ ID NO: 146297 - RNA, 1410 nt, Artificial Sequence; identical to SEQ ID NO: 146036
  derived and/or modified sequence opt3 from neuraminidase__InfluenzaA__AHC62089

SEQ ID NO: 146298 - RNA, 1410 nt, Artificial Sequence; identical to SEQ ID NO: 145987
  derived and/or modified sequence opt3 from neuraminidase__InfluenzaA__AHC62101

SEQ ID NO: 146299 - RNA, 1410 nt, Artificial Sequence; identical to SEQ ID NO: 146036
  derived and/or modified sequence opt3 from neuraminidase__InfluenzaA__AHC62113

SEQ ID NO: 146300 - RNA, 1410 nt, Artificial Sequence
  derived and/or modified sequence opt3 from neuraminidase__InfluenzaA__AHC62125
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaaacugguggacuccguaguuucauggaguaaggagauucugaggacgcaggaaagcgagugugugugcauaaacggcacuuguacagucgugaugaccgauggcucugcuuccgggaaagcagacacuaagauccucuuuauugaggaaggaaagaucgugcauacaucaaccuuaagcgguagugcccaacacgucgaggaaugcucuugcuauccucgguacccaggcguucgcugugugugcagagauaauuggaaaggguccaacaggccgauaguagacauuaauaucaaggaucacagcaucgugucgucuuacgucuguuccggacuggugggcgacacgccccggaaaaacgacucaaguagcuccucucauugccuugauccuaauaacgaggaaggugggcacggaguuaagggcugggcuuucgacgauggcaaugacguguggauggggcgcaccauuaacgagacaagccgauugggauaugagacuuuuaaagucaucgaagguuggucaaauccaaagaguaaacugcagauuaacagacaggugauaguagauaggggcaauaaguccggguacagcggaaucuucucuguugagggcaagucauguauuaaccggugcuuuuauguggaacuaauccguggucgcaaagaggaaaccgagguccucuggacaaguaauagcaucguggucuucugugggacuuccggcaccuacggaacaggcucuuggcccgacggggccgaucugaaccuuaugccuauuuga

SEQ ID NO: 146301 - RNA, 1410 nt, Artificial Sequence
  derived and/or modified sequence opt3 from neuraminidase__InfluenzaA__AHC62137
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuaaugagacaagcagauugggauaugagacuuuuaaggucaucgaagguuggucaaacccaaaaaguaagcugcagauuaauaggcaagugauaguagaccggggcgaucguuccggguacagcggaaucuucucuguugagggcaaaucauguauuaaccgcugcuuuuauguggaacuaaucagagguaggaaggaggaaaccgagguccucuggacaaguaauagcaucguggucuucugugggacuuccggcaccuacggaacaggcucuuggcccgacggggccgaucugaaccuuaugccuauuuga

SEQ ID NO: 146302 - RNA, 1410 nt, Artificial Sequence
  derived and/or modified sequence opt3 from neuraminidase__InfluenzaA__AHC62149
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacauccgcgaccacagcaucgugucgucuuacgucuguuccggauuagugggcgacacgccucggaaaaaugauucaaguagcuccucucauugccuggacccaaacaaugaggaaggugggcacggaguuaagggcugggcuuucgaugacggcaacgauguguggauggggagaaccauuaaugagacaagcaggcuuggauaugagacuuuuaaagucaucgaagguuggucaaaccccaagaguaaauugcagauuaaucgacaggugauaguagaccguggcgaucgcuccggguacagcggaaucuucucuguugagggcaagucauguauuaacagaugcuuuuauguggaacugaucaggggucggaaagaggaaaccgagguccuauggacaaguaauagcaucguggucuucugugggacuuccggcaccuacggaacaggcucuuggccugacggggccgaucucaaccugaugccaauuuga

SEQ ID NO: 146303 - RNA, 1410 nt, Artificial Sequence; identical to SEQ ID NO: 146023
  derived and/or modified sequence opt3 from neuraminidase__InfluenzaA__AHC62161

SEQ ID NO: 146304 - RNA, 1410 nt, Artificial Sequence
  derived and/or modified sequence opt3 from neuraminidase__InfluenzaA__AHC62173
augaaccccaaucagaagaucauuaccauaggcagcgugucccugacaaucucuacuauuugcuucuuuaugcaaaucgccauucucaucacgaccgucacacuucacuucaaacagugugaguuuaacucaccuccaaauaaccagguuaugcugugcgaaccgacuauaaucgagagaaauauuaccgaaaucguguacuugacaaacaccacuauugagaaggaaaucugucccaaauuagcugaguauaggaauuggaguaagccucagugcgacauaacaggguucgcaccauuuagcaaagauaacuccauucggcugucugccggaggugacaucuggguaacccgcgagcccuacgugucgugugauccuaauaagugcuaucaauucgcgcuaggccaggggacgacucucaacaauguccauucaaacaauaccgugcgagaccguacaccauacagaacucugcuuaugaacgaacugggaguucccuuucacuugggcaccaaacagguguguauugcuuggagcaguuccucuugccaugaugguaaggccuggcuccacgucuguaucacaggggacgauaagaaugcaaccgccagcuucaucuauaacggaaaacugguggacuccguaguuucauggaguaaggagauucugaggacgcaggaaagcgagugcguguguauaaacggcacuugcacagucgugaugaccgauggcucugcuuccgggaaagcagacacuaagauccucuuuauugaggaaggaaagaucgugcauacaucaaccuuaagcgguagugcccaacacgucgaggaaugcucuuguuacccucgguauccaggcguucgcugcguguguagagauaauuggaaaggguccaacaggccgauaguagacauuaauaucaaggaucacagcaucgugucgucuuacgucugcuccggacuggugggcgacacgccccggaaaaacgacucaaguagcuccucucauugucuugauccuaauaacgaggaaggugggcacggaguuaagggcugggcuuucgacgauggcaaugacguguggauggggcgcaccauuaacgagacaagccgauugggauacgagacuuuuaaagucaucgaagguuggucaaauccaaagaguaaacugcagauuaacagacaggugauaguagauaggggcaaucgguccggguauagcggaaucuucucuguugagggcaagucaugcauuaaccguuguuuuuacguggaacuaauccgcgguagaaaggaggaaaccgagguccucuggacaaguaauagcaucguggucuucugcgggacuuccggcaccuauggaacaggcucuuggcccgacggggccgaucugaaccuuaugccuauuuga

SEQ ID NO: 146305 - RNA, 1410 nt, Artificial Sequence; identical to SEQ ID NO: 146036
  derived and/or modified sequence opt3 from neuraminidase__InfluenzaA__AHC62185

SEQ ID NO: 146306 - RNA, 1410 nt, Artificial Sequence; identical to SEQ ID NO: 144938
  derived and/or modified sequence opt3 from neuraminidase__InfluenzaA__AHC62197

SEQ ID NO: 146307 - RNA, 1410 nt, Artificial Sequence
  derived and/or modified sequence opt3 from neuraminidase__InfluenzaA__AHC62209
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaaaaucacagcaucgugucgucuuacgucuguuccggauuagugggcgacacgccucgcaagaacgacucaaguagcuccucucauugccuggauccaaauaacgaggaaggugggcacggaguuaaaggcugggcuuucgacgauggcaaugacguguggauggggcgaaccauuaacgagacaagcagacuuggauaugagacuuuuaaggucaucgaagguuggucaaaucccaaaaguaaguugcagauuaacaggcaagugauaguagaucggggcgaccguuccggguacagcggaaucuucucuguugagggcaaaucauguauuaaucgcugcuuuuauguggaacugaucagagguaggaaggaggaaaccgagguccuauggacaaguaacagcaucguggucuucugugggacuuccggcaccuacggaacaggcucuuggccugauggggccgaccucaaucugaugccaauuuga

SEQ ID NO: 146308 - RNA, 1410 nt, Artificial Sequence; identical to SEQ ID NO: 145991
  derived and/or modified sequence opt3 from neuraminidase__InfluenzaA__AHC62221

SEQ ID NO: 146309 - RNA, 1410 nt, Artificial Sequence; identical to SEQ ID NO: 141534
  derived and/or modified sequence opt3 from neuraminidase__InfluenzaA__AHC62233

SEQ ID NO: 146310 - RNA, 1410 nt, Artificial Sequence; identical to SEQ ID NO: 145987
  derived and/or modified sequence opt3 from neuraminidase__InfluenzaA__AHC62245

SEQ ID NO: 146311 - RNA, 1410 nt, Artificial Sequence
  derived and/or modified sequence opt3 from neuraminidase__InfluenzaA__AHC62257
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccauuaaugagacaagcagacuuggauaugagacuuuuaaggucaucgaagguuggucaaaccccaaaaguaaguugcagauuaauaggcaagugauaguaggccguggggaccgguccggauacagcggcaucuucucuguugaggguaaaucauguauuaaccgcugcuuuuauguggaacugaucagagggaggaaggaggaaaccgagguccuauggacaaguaauagcaucguggucuucuguggcacuuccggaaccuacggcacagggucuuggccugauggagccgaccucaaccugaugccaauuuga

SEQ ID NO: 146312 - RNA, 1410 nt, Artificial Sequence; identical to SEQ ID NO: 146064
  derived and/or modified sequence opt3 from neuraminidase__InfluenzaA__AHC62269

SEQ ID NO: 146313 - RNA, 1410 nt, Artificial Sequence; identical to SEQ ID NO: 146036
  derived and/or modified sequence opt3 from neuraminidase__InfluenzaA__AHC62281

SEQ ID NO: 146314 - RNA, 1410 nt, Artificial Sequence; identical to SEQ ID NO: 145991
  derived and/or modified sequence opt3 from neuraminidase__InfluenzaA__AHC62293

SEQ ID NO: 146315 - RNA, 1410 nt, Artificial Sequence; identical to SEQ ID NO: 141534
  derived and/or modified sequence opt3 from neuraminidase__InfluenzaA__AHC62305

SEQ ID NO: 146316 - RNA, 1410 nt, Artificial Sequence; identical to SEQ ID NO: 145987
  derived and/or modified sequence opt3 from neuraminidase__InfluenzaA__AHC62317

SEQ ID NO: 146317 - RNA, 1410 nt, Artificial Sequence
  derived and/or modified sequence opt3 from neuraminidase__InfluenzaA__AHC62329
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccauuaaugagacaagcagacuuggauaugagacuuuuaaggucaucgaagguuggucaaaccccaaaaguaaguugcagauuaauaggcaagugauagccgaccggggcgaucguuccggguacagcggaaucuucucuguagagggcaaaucauguauuaaccgcugcuuuuauguugaacugaucagagguaggaaggaggaaaccgaggugcuauggacaaguaauagcaucgucguguucugugggacuuccggcaccuacggaacaggcucuuggccugacggggcggaucucaaccugaugccaauuuga

SEQ ID NO: 146318 - RNA, 1410 nt, Artificial Sequence; identical to SEQ ID NO: 145987
  derived and/or modified sequence opt3 from neuraminidase__InfluenzaA__AHC62341

SEQ ID NO: 146319 - RNA, 1410 nt, Artificial Sequence
  derived and/or modified sequence opt3 from neuraminidase__InfluenzaA__AHC62353
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaccgauucaaguagcuccucucauugccuugacccuaauaacgaggaaggugggcacggaguuaaaggcugggcuuucgaugacggcaaugauguguggauggggcgaacaauuaacgagacuagcagauugggauaugagaccuuuaaggucaucgaagguuggucaaauccaaaaaguaagcugcagauuaacaggcaagugauaguagaccggggcaaucguuccggguacagcggaaucuucucuguugagggcaaaucauguauuaaccgcugcuuuuauguggaacuaaucagagguaggaaggaggaaacagagguccucuggaccaguaauagcaucguggucuucugugggacuuccggcacauacggaaccggcucuuggcccgauggggccgaccugaaccuuaugccuauuuga

SEQ ID NO: 146320 - RNA, 1410 nt, Artificial Sequence; identical to SEQ ID NO: 145987
  derived and/or modified sequence opt3 from neuraminidase__InfluenzaA__AHC62365

SEQ ID NO: 146321 - RNA, 1410 nt, Artificial Sequence; identical to SEQ ID NO: 146204
  derived and/or modified sequence opt3 from neuraminidase__InfluenzaA__AHC62377

SEQ ID NO: 146322 - RNA, 1410 nt, Artificial Sequence; identical to SEQ ID NO: 146036
  derived and/or modified sequence opt3 from neuraminidase__InfluenzaA__AHC62389

SEQ ID NO: 146323 - RNA, 1410 nt, Artificial Sequence; identical to SEQ ID NO: 146036
  derived and/or modified sequence opt3 from neuraminidase__InfluenzaA__AHC62401

SEQ ID NO: 146324 - RNA, 1410 nt, Artificial Sequence; identical to SEQ ID NO: 146064
  derived and/or modified sequence opt3 from neuraminidase__InfluenzaA__AHC62413

SEQ ID NO: 146325 - RNA, 1410 nt, Artificial Sequence; identical to SEQ ID NO: 146122
  derived and/or modified sequence opt3 from neuraminidase__InfluenzaA__AHC62425

SEQ ID NO: 146326 - RNA, 1410 nt, Artificial Sequence; identical to SEQ ID NO: 141534
  derived and/or modified sequence opt3 from neuraminidase__InfluenzaA__AHC62437

SEQ ID NO: 146327 - RNA, 1410 nt, Artificial Sequence; identical to SEQ ID NO: 146036
  derived and/or modified sequence opt3 from neuraminidase__InfluenzaA__AHC62449

SEQ ID NO: 146328 - RNA, 1410 nt, Artificial Sequence; identical to SEQ ID NO: 145991
  derived and/or modified sequence opt3 from neuraminidase__InfluenzaA__AHC62461

SEQ ID NO: 146329 - RNA, 1410 nt, Artificial Sequence; identical to SEQ ID NO: 145987
  derived and/or modified sequence opt3 from neuraminidase__InfluenzaA__AHC62473

SEQ ID NO: 146330 - RNA, 1410 nt, Artificial Sequence; identical to SEQ ID NO: 144162
  derived and/or modified sequence opt3 from neuraminidase__InfluenzaA__AHC62485

SEQ ID NO: 146331 - RNA, 1410 nt, Artificial Sequence; identical to SEQ ID NO: 146036
  derived and/or modified sequence opt3 from neuraminidase__InfluenzaA__AHC62509

SEQ ID NO: 146332 - RNA, 1410 nt, Artificial Sequence
  derived and/or modified sequence opt3 from neuraminidase__InfluenzaA__AHC62521
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaaacugguggacuccguaguuucauggaguaaggagauucugaggacgcaggaaagcgagugugugugcauaaacggcacuuguacagucgugaugaccgauggcucugcuuccgggaaagcagacacuaagauccucuuuauugaggaaggaaagaucgugcauacaucaaccuuaagcgguagugcccaacacgucgaggaaugcucuugcuauccucgguacccaggcguucgcugugugugcagagauaauuggaaaggguccaacaggccgauaguagacauuaauaucaaggaucacagcaucgugucgucuuacgucuguuccggacuggugggcgacacgccccggaaaaacgacucaaguagcuccucucauugccuugauccuaauaacgaggaaggugggcacggaguuaagggcugggcuuucgacgauggcaaugacguguggauggggcgcaccauuaacgagacaagccgauugggauaugagacuuuuaaagucaucgaagguuggucaaauccaaagaguaaacugcagauuaacagacaggugauaguagauaggggcaaucgguccggguacagcggaaucuucucuguugagggcaagucauguauuaaccguugcuuuuauguggaacuaauccgcgguagaaaggaggaaaccgagguccucuggacaaguaauagcaucauuguguucugugggacuuccggcaccuacggaacaggcucuuggcccgacggggccgaucugaaccuuaugccuauauga

SEQ ID NO: 146333 - RNA, 1410 nt, Artificial Sequence
  derived and/or modified sequence opt3 from neuraminidase__InfluenzaA__AHC62533
augaaccccaaucagaagaucauuaccauaggcagcgugucccugacaaucucuacuauuugcuucuuuaugcaagucgccauccucauuacgaccguuacacuucacuucaaacaguacgaguuuaacucaccuccaaauaaccaggugaugcugugugaaccgacuaucauagagagaaauaucaccgaaauuuuguauuuaacaaacaccacuaucgagaaggaaauuugccccaaacuggcugaguacaggaauuggaguaagccucagugugacaucacaggguucgcaccauuuagcaaagauaacuccauacggcuaucugccggaggugacauuuggguaacccgcgagcccuaugugucgugcgauccugacaaguguuaccaauucgcgcucggccaggggacgacucugaauaacguccauucaaauaacaccgugcgagaucguacaccauauagaacucuucugaugaaugaauugggaguucccuuucaccucggcaccaaacaggugugcaucgcuuggagcaguuccucuugucaugacgguaaggccuggcugcacgucugcauuacaggggaugacaagaacgcaaccgccagcuucaucuacaauggaaaacugguggauuccguaguuucauggaguaaggagauccucaggacgcaggaaagcgagugugugugcauuaacggcacuuguacagucgugaugaccgacggcucugcuuccgggaaagcagauacuaagauauuauuuaucgaggaaggaaagauugugcauacaucaacccugagcgguagugcccaacacgucgaggaaugcucuugcuauccucgguacccaggcguucgcugugugugcagagacaacuggaaaggguccaauaggccgaucguagauauaaacauuaaggaccacagcaucgugucgucuuacgucuguuccggacuugugggcgacacgccccggaaaaaugauucaaguagcuccucucauugcuuggacccuaacaaugaggaaggugggaacggaguuaagggcugggcuuucgaugacggcaaugauguguggauggggcgcaccaucaacgagacaagccgacugggauaugagacuuuuaaagucauugaagguuggucaaauccaaagaguaaacuacagaucaacagacaggugauuguagacaggggcaaucgguccggguacagcggaauauucucuguugagggcaagucauguaucaaccguugcuuuuauguggaacucauucgcgguagaaaggaggaaaccgagguccuguggacaaguaauagcaucguggucuucugugggacuuccggcaccuacggaacaggcucuuggcccgauggggccgaccuuaaccugaugccuaucuga

SEQ ID NO: 146334 - RNA, 1410 nt, Artificial Sequence; identical to SEQ ID NO: 146191
  derived and/or modified sequence opt3 from neuraminidase__InfluenzaA__AHC62545

SEQ ID NO: 146335 - RNA, 1410 nt, Artificial Sequence; identical to SEQ ID NO: 146036
  derived and/or modified sequence opt3 from neuraminidase__InfluenzaA__AHC62557

SEQ ID NO: 146336 - RNA, 1410 nt, Artificial Sequence; identical to SEQ ID NO: 145987
  derived and/or modified sequence opt3 from neuraminidase__InfluenzaA__AHC62569

SEQ ID NO: 146337 - RNA, 1410 nt, Artificial Sequence; identical to SEQ ID NO: 146036
  derived and/or modified sequence opt3 from neuraminidase__InfluenzaA__AHC62581

SEQ ID NO: 146338 - RNA, 1410 nt, Artificial Sequence
  derived and/or modified sequence opt3 from neuraminidase__InfluenzaA__AHC62593
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggagguaauaucuggguaacccgcgagcccuaugugucgugcgacccugauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaacggcacuuguacagucgugaugaccgauggcucugcuuccgggaaggcagacacuaaaauccucuuuauugaggaaggaaagaucgugcauacaucaaccuuaagcgguagugcccaacacgucgaggaaugcucuugcuauccucgcuacccaggcguuagaugugugugcagggauaauuggaagggguccaaccggccgauaguagacauuaauaucaaagaucacagcaucgugucgucuuacgucuguuccggacuggugggcgacacgccccgcaagaacgacucaaguagcuccucucauugccuugauccuaauaacgaggaaggugggcacggaguuaaaggcugggcuuucgacgauggcaaugacguguggauggggcgaaccauuaacgagacaagcagauugggauaugagacuuuuaaggucaucgaagguuggucaaauccaaaaaguaagcugcagauuaacaggcaagugauaguagaucggggcaaucguuccggguacagcggaaucuucucuguugagggcaaaucauguauuaaccgcugcuuuuauguggaacuaaucagagguaggaaggaggaaaccgagguccucuggacaaguaauagcaucguggucuucugugggacuuccggcaccuacggaacaggcucuuggcccgacggggccgaucugaaccuuaugccuauuuga

SEQ ID NO: 146339 - RNA, 1410 nt, Artificial Sequence; identical to SEQ ID NO: 146023
  derived and/or modified sequence opt3 from neuraminidase__InfluenzaA__AHC62605

SEQ ID NO: 146340 - RNA, 1410 nt, Artificial Sequence
  derived and/or modified sequence opt3 from neuraminidase__InfluenzaA__AHC62617
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugagaugugaaccgacuauaaucgagaggaauauuaccgaaaucguguaucugacaaacaccacuauugagaaggaaaucugccccaaauuggcugaguaccggaauuggaguaagccucagugugacauaacaggguucgcaccauuuagcaaagauaacuccauucgcuuaucugccggaggugacaucuggguaacccgagagcccuaugugucgugcgauccuaauaaguguuaccaauucgcgcugggccaggggacgacucuaaacaauguccauucaaacaauaccgugcgugacagaacaccauauaggacucuccugaugaacgaacuuggaguucccuuucaccugggcaccaaacaggugugcauugcuuggagcaguuccucuugucaugaugguaaggccugguugcacgucugcaucacaggggacgauaagaaugcaaccgccagcuucaucuacaacggaaaacucguggacuccguaguuucauggaguaaggagauucugcggacgcaggaaagcgagugugugugcauaaacggcacuuguacagucgugaugaccgauggcucugcuuccgggaaagcagacacuaagauccuguuuauugaggaaggaaagaucgugcauacaucaacccucagcgguagugcccaacacgucgaggaaugcucuugcuauccucgcuacccaggcguuagaugugugugcagggauaauuggaaaggguccaaccggccgauaguagacauuaauaucaaggaucacagcaucgugucgucuuacgucuguuccggauuagugggcgacacgccccgcaaaaacgacucaaguagcuccucucauugccuggauccuaauaacgaggaaggugggcacggaguuaagggcugggcuuucgacgauggcaaugacguguggauggggcgaaccauuaacgagacaagcagacuuggauaugagacuuuuaaagucaucgaagguuggucaaauccaaagaguaaauugcagauuaacaggcaagugauaguagaucggggcaaucguuccggguacagcggaaucuucucuguugagggcaagucauguauuaaccgcugcuuuuauguggaacugaucagagguaggaaggaggaaaccgagguccuauggacaaguaauagcaucguggucuucugugggacuuccggcaccuacggaacaggcucuuggcccgacggggccgaucucaaccugaugccuauuuga

SEQ ID NO: 146341 - RNA, 1410 nt, Artificial Sequence; identical to SEQ ID NO: 145991
  derived and/or modified sequence opt3 from neuraminidase__InfluenzaA__AHC62629

SEQ ID NO: 146342 - RNA, 1410 nt, Artificial Sequence
  derived and/or modified sequence opt3 from neuraminidase__InfluenzaA__AHC62641
augaaccccaaucagaagaucauuaccauaggcagcgugucccugacaaucucuacugucugcuucuuuaugcaaguugccauucucaucacgaccgugacacuucacuucaaacaguacgaguuuaacucaccuccaaauaaccagguaaugcugugugaaccgacuauuaucgagagaaauauaaccgaaaucuuguauuuaacaaacaccacuauugagaaggaaaucugccccaaacuggcugaguacaggaauuggaguaagccucagugugacauuacaggguucgcaccauuuagcaaagauaacuccauccggcuaucugccggaggugacauaugggugacccgcgagcccuaugucucgugcgauccugacaaguguuaccaauucgcgcucggccaggggacgacucugaauaacgugcauucaaauaacaccguucgagaucguacaccauauagaacucuucugaugaaugaauugggagugcccuuucaccucggcaccaagcaggucugcauugcuuggagcaguuccucuugucaugacgguaaagccuggcugcacgugugcaucacaggggaugacaagaacgcaaccgccagcuucauuuacaauggaaaacugguagauuccguugugucauggaguaaggagauccucaggacgcaggaaagcgagugugucugcaucaacggcacuuguacaguggugaugaccgacggcucugcuuccgggaaagcagauacuaagauuuuauuuauagaggaaggaaagaucguccauacaucaacccugagcgguagugcccaacacguugaggaaugcucuugcuauccucgguacccaggcgugcgcuguguaugcagagacaacuggaaaggguccaauaggccgauuguggauaucaacauaaaggaccacagcauugucucgucuuacguguguuccggacuuguuggcgacacgccccggaaaaaugauucaaguagcuccucucauugcuuggacccuaacaaugaggaaggugggcacggagugaagggcugggcuuucgaugacggcaacgaugucuggauggggcgcaccaucaaugagacaagccgacugggauaugagacuuuuaaagugaucgaagguuggucaaacccaaagaguaaacuacagauuaauagacagguaaucguugacaggggcaaccgguccggguacagcggaauuuucucuguggagggcaagucauguauaaaucguugcuuuuaugucgaacucauccgcgguagaaaggaggaaaccgaggugcuguggacaaguaacagcauugucguguucugugggacuuccggcaccuacggaacaggcucuuggcccgauggggccgaccuuaaucugaugccuaucuga

SEQ ID NO: 146343 - RNA, 1410 nt, Artificial Sequence; identical to SEQ ID NO: 145991
  derived and/or modified sequence opt3 from neuraminidase__InfluenzaA__AHC62653

SEQ ID NO: 146344 - RNA, 1410 nt, Artificial Sequence; identical to SEQ ID NO: 145991
  derived and/or modified sequence opt3 from neuraminidase__InfluenzaA__AHC62665

SEQ ID NO: 146345 - RNA, 1410 nt, Artificial Sequence
  derived and/or modified sequence opt3 from neuraminidase__InfluenzaA__AHC62677
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacaauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaaacugguggacuccguaguuucauggaguaaggagauucugaggacgcaggaaagcgagugugugugcauaaacggcacuuguacagucgugaugaccgauggcucugcuuccgggaaagcagacacuaagauccucuuuauugaggaaggaaagaucgugcauacaucaaccuuaagcgguagugcccaacacgucgaggaaugcucuugcuauccucgguacccaggcguucgcugugugugcagagauaauuggaaaggguccaacaggccgauaguagacauuaauaucaaggaucacagcaucgugucgucuuacgucuguuccggacuggugggcgacacgccccggaaaaacgacauuucaaguagcucccauugccuugauccuaauaacgaggaaggugggcacggaguuaagggcugggcuuucgacgauggcaaugacguguggauggggcgcaccaucaacgagacaucucgauugggauaugagacuuuuaaagucauugaagguuggagcaauccaaagucaaaacugcagauaaacagacaggugaucguagauaggggcaaucggaguggguacuccggaauuuucagcguugagggcaagucuuguaucaaccguugcuuuuauguggaacuaauccgcgguagaaaggaggaaaccgagguccucuggacaucaaauaguauuguggucuucugugggacuagcggcaccuacggaacaggcuccuggcccgacggggccgaucugaaccuuaugccuauauga

SEQ ID NO: 146346 - RNA, 1398 nt, Artificial Sequence
  derived and/or modified sequence opt3 from neuraminidase__InfluenzaA__AHF20560
augaaccccaaucagaagauccugugcaccagcgccacagcuauuauaaucggcgcaauuacugugcucaucgggauugccaaccuuggacugaauaucgguuugcacuuaaaaccuggcuguaacugcucccauucucaaccagagacgaccaauacaucacagacuauaaucaacaauuacuauaacgaaaccaauacaaccaacauucagauggaggaaagaacaaguaggaauuucaacaaucugacuaaggggcuauguaccaucaacagcuggcacauuuacggaaaagacaaugcgguccggaucggcgaguccucugauguucucgugacgcgcgaaccguauguaucgugcgaccccgaugagugucgauuuuacgcucugucacaggguacuaccauacgugggaagcauagcaacggaacaauucacgacagaagucaauauagggcccuuaucuccuggccucugucuagcccacccacuguguacaacucccgggucgagugcauuggcuggucaaguaccagcugucaugauggcaaaucucgcauguccaucugcaucucagggccuaauaacaaugcaagcgccgugguuugguauaacagaaggccaguggcugaaauuaauacaugggcacggaacauauugcgcacccaggagagugaaugugucugccacaauggagugugucccguaguuuucacggacgguucugccacuggcccugcugauacacgaaucuacuacuuuaaggaggggaagauucucaaaugggagucccugaccggaacugccaagcacaucgaagagugcagcugcuauggcgaaagaacagguauaaccuguacgugcagggacaacuggcaggggucgaaucggccagugauucagaucgauccggucgcgaugacccauacaucucaauacaucuguucccccgugcugacugacaacccucguccaaaugaucccaacauuggaaaaugcaaugacccuuauccaggcaacaauaacaacggcgugaagggguucucauaccucgauggagcaaauaccugguuaggucgcacaaucaguacugccagcagauccggcuaugagaugcugaaaguccccaacgcucuuaccgacgacaggucuaagccgauucaggggcagacaauaguuuugaaugccgauuggagcggauacucaggcaguuuuauggacuauugggcagaaggugauuguuaccgggcuugcuucuacguggagcugauccgagggcgcccuaaggaggacaaaguaugguggaccuccaacagcauugugucuauguguucaaguacugaauuucuagagcaguggaauuggcccgauggcgccaagaucgaauauuuccucuga

SEQ ID NO: 146347 - RNA, 1398 nt, Artificial Sequence; identical to SEQ ID NO: 145470
  derived and/or modified sequence opt3 from neuraminidase__InfluenzaA__AHF20570

SEQ ID NO: 146348 - RNA, 1413 nt, Artificial Sequence; identical to SEQ ID NO: 138648
  derived and/or modified sequence opt3 from neuraminidase__InfluenzaA__AHG96111

SEQ ID NO: 146349 - RNA, 1413 nt, Artificial Sequence; identical to SEQ ID NO: 138648
  derived and/or modified sequence opt3 from neuraminidase__InfluenzaA__AHG96123

SEQ ID NO: 146350 - RNA, 1413 nt, Artificial Sequence; identical to SEQ ID NO: 138648
  derived and/or modified sequence opt3 from neuraminidase__InfluenzaA__AHG96135

SEQ ID NO: 146351 - RNA, 1413 nt, Artificial Sequence; identical to SEQ ID NO: 138648
  derived and/or modified sequence opt3 from neuraminidase__InfluenzaA__AHG96147

SEQ ID NO: 146352 - RNA, 1413 nt, Artificial Sequence; identical to SEQ ID NO: 138648
  derived and/or modified sequence opt3 from neuraminidase__InfluenzaA__AHG96159

SEQ ID NO: 146353 - RNA, 1413 nt, Artificial Sequence; identical to SEQ ID NO: 138648
  derived and/or modified sequence opt3 from neuraminidase__InfluenzaA__AHG96171

SEQ ID NO: 146354 - RNA, 1413 nt, Artificial Sequence; identical to SEQ ID NO: 138648
  derived and/or modified sequence opt3 from neuraminidase__InfluenzaA__AHG96183

SEQ ID NO: 146355 - RNA, 1413 nt, Artificial Sequence; identical to SEQ ID NO: 138648
  derived and/or modified sequence opt3 from neuraminidase__InfluenzaA__AHG96195

SEQ ID NO: 146356 - RNA, 1413 nt, Artificial Sequence; identical to SEQ ID NO: 138648
  derived and/or modified sequence opt3 from neuraminidase__InfluenzaA__AHG96207

SEQ ID NO: 146357 - RNA, 1413 nt, Artificial Sequence; identical to SEQ ID NO: 138648
  derived and/or modified sequence opt3 from neuraminidase__InfluenzaA__AHG96219

SEQ ID NO: 146358 - RNA, 1413 nt, Artificial Sequence; identical to SEQ ID NO: 138648
  derived and/or modified sequence opt3 from neuraminidase__InfluenzaA__AHG96231

SEQ ID NO: 146359 - RNA, 1413 nt, Artificial Sequence; identical to SEQ ID NO: 138648
  derived and/or modified sequence opt3 from neuraminidase__InfluenzaA__AHG96243

SEQ ID NO: 146360 - RNA, 1413 nt, Artificial Sequence; identical to SEQ ID NO: 138648
  derived and/or modified sequence opt3 from neuraminidase__InfluenzaA__AHG96255

SEQ ID NO: 146361 - RNA, 1413 nt, Artificial Sequence; identical to SEQ ID NO: 138648
  derived and/or modified sequence opt3 from neuraminidase__InfluenzaA__AHG96267

SEQ ID NO: 146362 - RNA, 1413 nt, Artificial Sequence; identical to SEQ ID NO: 138648
  derived and/or modified sequence opt3 from neuraminidase__InfluenzaA__AHG96279

SEQ ID NO: 146363 - RNA, 1413 nt, Artificial Sequence; identical to SEQ ID NO: 138648
  derived and/or modified sequence opt3 from neuraminidase__InfluenzaA__AHG96291

SEQ ID NO: 146364 - RNA, 1413 nt, Artificial Sequence; identical to SEQ ID NO: 138648
  derived and/or modified sequence opt3 from neuraminidase__InfluenzaA__AHG96303

SEQ ID NO: 146365 - RNA, 1410 nt, Artificial Sequence; identical to SEQ ID NO: 138472
  derived and/or modified sequence opt3 from neuraminidase__InfluenzaA__AHG96362

SEQ ID NO: 146366 - RNA, 1410 nt, Artificial Sequence; identical to SEQ ID NO: 138472
  derived and/or modified sequence opt3 from neuraminidase__InfluenzaA__AHG96374

SEQ ID NO: 146367 - RNA, 1410 nt, Artificial Sequence; identical to SEQ ID NO: 138472
  derived and/or modified sequence opt3 from neuraminidase__InfluenzaA__AHG96386

SEQ ID NO: 146368 - RNA, 1413 nt, Artificial Sequence; identical to SEQ ID NO: 138648
  derived and/or modified sequence opt3 from neuraminidase__InfluenzaA__AHG96398

SEQ ID NO: 146369 - RNA, 1410 nt, Artificial Sequence; identical to SEQ ID NO: 138472
  derived and/or modified sequence opt3 from neuraminidase__InfluenzaA__AHG96410

SEQ ID NO: 146370 - RNA, 1410 nt, Artificial Sequence; identical to SEQ ID NO: 138472
  derived and/or modified sequence opt3 from neuraminidase__InfluenzaA__AHG96422

SEQ ID NO: 146371 - RNA, 1410 nt, Artificial Sequence; identical to SEQ ID NO: 138472
  derived and/or modified sequence opt3 from neuraminidase__InfluenzaA__AHG96434

SEQ ID NO: 146372 - RNA, 1410 nt, Artificial Sequence; identical to SEQ ID NO: 138472
  derived and/or modified sequence opt3 from neuraminidase__InfluenzaA__AHG96446

SEQ ID NO: 146373 - RNA, 1410 nt, Artificial Sequence; identical to SEQ ID NO: 138472
  derived and/or modified sequence opt3 from neuraminidase__InfluenzaA__AHG96458

SEQ ID NO: 146374 - RNA, 1410 nt, Artificial Sequence; identical to SEQ ID NO: 138472
  derived and/or modified sequence opt3 from neuraminidase__InfluenzaA__AHG96470

SEQ ID NO: 146375 - RNA, 1410 nt, Artificial Sequence; identical to SEQ ID NO: 138472
  derived and/or modified sequence opt3 from neuraminidase__InfluenzaA__AHG96482

SEQ ID NO: 146376 - RNA, 1410 nt, Artificial Sequence; identical to SEQ ID NO: 138472
  derived and/or modified sequence opt3 from neuraminidase__InfluenzaA__AHG96494

SEQ ID NO: 146377 - RNA, 1410 nt, Artificial Sequence; identical to SEQ ID NO: 138472
  derived and/or modified sequence opt3 from neuraminidase__InfluenzaA__AHG96506

SEQ ID NO: 146378 - RNA, 1413 nt, Artificial Sequence; identical to SEQ ID NO: 138648
  derived and/or modified sequence opt3 from neuraminidase__InfluenzaA__AHG96518

SEQ ID NO: 146379 - RNA, 1413 nt, Artificial Sequence; identical to SEQ ID NO: 138648
  derived and/or modified sequence opt3 from neuraminidase__InfluenzaA__AHG96530

SEQ ID NO: 146380 - RNA, 1413 nt, Artificial Sequence; identical to SEQ ID NO: 138648
  derived and/or modified sequence opt3 from neuraminidase__InfluenzaA__AHG96542

SEQ ID NO: 146381 - RNA, 1413 nt, Artificial Sequence; identical to SEQ ID NO: 138648
  derived and/or modified sequence opt3 from neuraminidase__InfluenzaA__AHG96554

SEQ ID NO: 146382 - RNA, 1413 nt, Artificial Sequence; identical to SEQ ID NO: 138648
  derived and/or modified sequence opt3 from neuraminidase__InfluenzaA__AHG96566

SEQ ID NO: 146383 - RNA, 1413 nt, Artificial Sequence; identical to SEQ ID NO: 138648
  derived and/or modified sequence opt3 from neuraminidase__InfluenzaA__AHG96578

SEQ ID NO: 146384 - RNA, 1413 nt, Artificial Sequence; identical to SEQ ID NO: 138648
  derived and/or modified sequence opt3 from neuraminidase__InfluenzaA__AHG96590

SEQ ID NO: 146385 - RNA, 1413 nt, Artificial Sequence; identical to SEQ ID NO: 138648
  derived and/or modified sequence opt3 from neuraminidase__InfluenzaA__AHG96602

SEQ ID NO: 146386 - RNA, 1413 nt, Artificial Sequence; identical to SEQ ID NO: 138648
  derived and/or modified sequence opt3 from neuraminidase__InfluenzaA__AHG96614

SEQ ID NO: 146387 - RNA, 1413 nt, Artificial Sequence; identical to SEQ ID NO: 138648
  derived and/or modified sequence opt3 from neuraminidase__InfluenzaA__AHG96626

SEQ ID NO: 146388 - RNA, 1413 nt, Artificial Sequence; identical to SEQ ID NO: 138648
  derived and/or modified sequence opt3 from neuraminidase__InfluenzaA__AHG96638

SEQ ID NO: 146389 - RNA, 1413 nt, Artificial Sequence; identical to SEQ ID NO: 138648
  derived and/or modified sequence opt3 from neuraminidase__InfluenzaA__AHG96650

SEQ ID NO: 146390 - RNA, 1413 nt, Artificial Sequence; identical to SEQ ID NO: 138648
  derived and/or modified sequence opt3 from neuraminidase__InfluenzaA__AHG96662

SEQ ID NO: 146391 - RNA, 1413 nt, Artificial Sequence; identical to SEQ ID NO: 138648
  derived and/or modified sequence opt3 from neuraminidase__InfluenzaA__AHG96674

SEQ ID NO: 146392 - RNA, 1413 nt, Artificial Sequence; identical to SEQ ID NO: 138648
  derived and/or modified sequence opt3 from neuraminidase__InfluenzaA__AHG96686

SEQ ID NO: 146393 - RNA, 1410 nt, Artificial Sequence; identical to SEQ ID NO: 138472
  derived and/or modified sequence opt3 from neuraminidase__InfluenzaA__AHG96698

SEQ ID NO: 146394 - RNA, 1410 nt, Artificial Sequence; identical to SEQ ID NO: 138472
  derived and/or modified sequence opt3 from neuraminidase__InfluenzaA__AHG96710

SEQ ID NO: 146395 - RNA, 1410 nt, Artificial Sequence; identical to SEQ ID NO: 138472
  derived and/or modified sequence opt3 from neuraminidase__InfluenzaA__AHG96722

SEQ ID NO: 146396 - RNA, 1410 nt, Artificial Sequence; identical to SEQ ID NO: 138472
  derived and/or modified sequence opt3 from neuraminidase__InfluenzaA__AHG96734

SEQ ID NO: 146397 - RNA, 1410 nt, Artificial Sequence; identical to SEQ ID NO: 138472
  derived and/or modified sequence opt3 from neuraminidase__InfluenzaA__AHG96746

SEQ ID NO: 146398 - RNA, 1410 nt, Artificial Sequence; identical to SEQ ID NO: 138472
  derived and/or modified sequence opt3 from neuraminidase__InfluenzaA__AHG96758

SEQ ID NO: 146399 - RNA, 1410 nt, Artificial Sequence; identical to SEQ ID NO: 138472
  derived and/or modified sequence opt3 from neuraminidase__InfluenzaA__AHG96770

SEQ ID NO: 146400 - RNA, 1410 nt, Artificial Sequence; identical to SEQ ID NO: 138472
  derived and/or modified sequence opt3 from neuraminidase__InfluenzaA__AHG96782

SEQ ID NO: 146401 - RNA, 1410 nt, Artificial Sequence; identical to SEQ ID NO: 138472
  derived and/or modified sequence opt3 from neuraminidase__InfluenzaA__AHG96794

SEQ ID NO: 146402 - RNA, 1410 nt, Artificial Sequence; identical to SEQ ID NO: 138472
  derived and/or modified sequence opt3 from neuraminidase__InfluenzaA__AHG96806

SEQ ID NO: 146403 - RNA, 1410 nt, Artificial Sequence; identical to SEQ ID NO: 138472
  derived and/or modified sequence opt3 from neuraminidase__InfluenzaA__AHG96818

SEQ ID NO: 146404 - RNA, 1410 nt, Artificial Sequence; identical to SEQ ID NO: 138472
  derived and/or modified sequence opt3 from neuraminidase__InfluenzaA__AHG96830

SEQ ID NO: 146405 - RNA, 1410 nt, Artificial Sequence; identical to SEQ ID NO: 138472
  derived and/or modified sequence opt3 from neuraminidase__InfluenzaA__AHG96842

SEQ ID NO: 146406 - RNA, 1410 nt, Artificial Sequence; identical to SEQ ID NO: 138472
  derived and/or modified sequence opt3 from neuraminidase__InfluenzaA__AHG96854

SEQ ID NO: 146407 - RNA, 1410 nt, Artificial Sequence; identical to SEQ ID NO: 138472
  derived and/or modified sequence opt3 from neuraminidase__InfluenzaA__AHG96866

SEQ ID NO: 146408 - RNA, 1410 nt, Artificial Sequence; identical to SEQ ID NO: 138472
  derived and/or modified sequence opt3 from neuraminidase__InfluenzaA__AHG96878

SEQ ID NO: 146409 - RNA, 1410 nt, Artificial Sequence; identical to SEQ ID NO: 138472
  derived and/or modified sequence opt3 from neuraminidase__InfluenzaA__AHG96890

SEQ ID NO: 146410 - RNA, 1410 nt, Artificial Sequence; identical to SEQ ID NO: 138472
  derived and/or modified sequence opt3 from neuraminidase__InfluenzaA__AHG96902

SEQ ID NO: 146411 - RNA, 1410 nt, Artificial Sequence; identical to SEQ ID NO: 138472
  derived and/or modified sequence opt3 from neuraminidase__InfluenzaA__AHG96914

SEQ ID NO: 146412 - RNA, 1410 nt, Artificial Sequence; identical to SEQ ID NO: 138472
  derived and/or modified sequence opt3 from neuraminidase__InfluenzaA__AHG96926

SEQ ID NO: 146413 - RNA, 1410 nt, Artificial Sequence; identical to SEQ ID NO: 138472
  derived and/or modified sequence opt3 from neuraminidase__InfluenzaA__AHG96938

SEQ ID NO: 146414 - RNA, 1410 nt, Artificial Sequence; identical to SEQ ID NO: 138472
  derived and/or modified sequence opt3 from neuraminidase__InfluenzaA__AHG96950

SEQ ID NO: 146415 - RNA, 1410 nt, Artificial Sequence; identical to SEQ ID NO: 138472
  derived and/or modified sequence opt3 from neuraminidase__InfluenzaA__AHG96962

SEQ ID NO: 146416 - RNA, 1410 nt, Artificial Sequence; identical to SEQ ID NO: 138472
  derived and/or modified sequence opt3 from neuraminidase__InfluenzaA__AHG96974

SEQ ID NO: 146417 - RNA, 1410 nt, Artificial Sequence; identical to SEQ ID NO: 138472
  derived and/or modified sequence opt3 from neuraminidase__InfluenzaA__AHG96986

SEQ ID NO: 146418 - RNA, 1410 nt, Artificial Sequence; identical to SEQ ID NO: 138472
  derived and/or modified sequence opt3 from neuraminidase__InfluenzaA__AHG96998

SEQ ID NO: 146419 - RNA, 1410 nt, Artificial Sequence; identical to SEQ ID NO: 138472
  derived and/or modified sequence opt3 from neuraminidase__InfluenzaA__AHG97010

SEQ ID NO: 146420 - RNA, 1410 nt, Artificial Sequence; identical to SEQ ID NO: 138472
  derived and/or modified sequence opt3 from neuraminidase__InfluenzaA__AHG97022

SEQ ID NO: 146421 - RNA, 1410 nt, Artificial Sequence; identical to SEQ ID NO: 138472
  derived and/or modified sequence opt3 from neuraminidase__InfluenzaA__AHG97034

SEQ ID NO: 146422 - RNA, 1410 nt, Artificial Sequence; identical to SEQ ID NO: 138472
  derived and/or modified sequence opt3 from neuraminidase__InfluenzaA__AHG97046

SEQ ID NO: 146423 - RNA, 1410 nt, Artificial Sequence
  derived and/or modified sequence opt3 from neuraminidase__InfluenzaA__AHH00872
augaaccccaaucagaagaucauuaccauaggcagcgugucccugacaaucgccacuauuugcuuccucaugcaaaucgcuauucuugucacgaccguuacacugcacuuuaaacaguacgaguguaacccuccaccgaauaaccaggugauguugugcgaacccacuaucauagagagaaauaucaccgaaauuguauauuuaacaaacaccacuaucgagaaggaaauuuguccuaaacuggcagaguacaggaauuggucuaagccacagugcaacaucacaggguucgcccccuuuucaaaagacaauaguauacggcuaagcgcgggaggugauauuugggugacccgcgagccuuaugucuccugugacccagauaagugcuaccaauucgcucucggccaggggacgacucugaacaauggacauucuaacgacaccgugcacgaucgaacacccuaucguacucuucugaugaaugaauugggcguuccuuuucaucucgguaccaaacagguguguaucgccuggucgucaagcaguugccacgacgggaaggcauggcugcaugucugugugacaggagaugacgagaacgccaccgcuuccuucauuuacaauggcagacugguagauucuaucggcagcugguccaagaaaauccucaggacgcaggaaucagagugcguuuguauuaacgggacuugcacagugauaaugaccgacggaagugcaagcgguaaggccgauacuaaaaucuuauuuauugaggaaggcaagaucguccacacaucuccacuguccgggucagcucaacacguggaggaaugcagcuguuauccgcgguaccccggagugcgcugcgucuguagagacaacuggaagggcaguaauaggccuauaguugauauuaacgugaaagacuacucuaucguauccagcuaugugugcucgggucuugucggggacaccccacggaagaaugauucuuccucaaguagccauuguuuggaccccaacaaugaggaaggaggccacggcgugaaagggugggccuucgaugacggaaacgauguuuggaugggucgcacgaucuccgagaagucucgaagcggcuacgagaccuuuaaagugauugaaggguggucaaagccuaauaguaaacugcagaucaacagacaggucauuauagacaggggaaaucgguccggcuauagcgguaucuucucuguggaggggaagucaugcauuaaccguuguuuuuacguagaacuaauccgcggcagaaagcaggagacagaaguucucuggaccaguaauagcaucguggucuucugcggaacuuccggcacauaugggacuggaucuuggccagauggugcggaccugaaccuuaugcccauuuga

SEQ ID NO: 146424 - RNA, 1416 nt, Artificial Sequence
  derived and/or modified sequence opt3 from neuraminidase__InfluenzaA__AHI43497
augaaccccaaucagaagcuguucgcccucagcggcguggcuaucgcacuuuccauucugaacuuguuaauagggaucucuaaugucggacugaacauuucacuacaccucaaagguaagggcccuaaacaagaggaaaaucugaccugcacaacuaucaaccagaauaacacgaccguuguggagaauacauacguaaacaauacuaccauuaucacaaaggaaaccgacuggaacacuccaaguuaucuucuguugaauaaaagccucuguaacguggaggggugggucgugauagccaaggauaaugcgaucagauuuggagaauccgagcagauuaucguuacaagggagccguacgugucuugcgaccccaccggcuguaagauguaugcucugcaucaggguacgacuauucggaacaaacacucgaacgggaccauccaugaucgcacagccuuccgaggacugauaucaacuccucucggcaccccacccacagucagcaauaguggcuuuaugugcguggggugguccucuaccacgugucacgacggaauuggucguaugacuaucugcauucaaggcaacaaugauaacgcaacagccaccguauacuauaaugggagauuaacuacaaccaucaagacgugggcuaggaacauccugcggacccaggaaagcgaguguguuugccauaauggaacaugugcaguggucaugacugacggcuccgccucaagucaggcuuacaccaaagugauguauuuccacaagggucuugugauuaaagaagaggccuugcgcgggagcgcgagacacauagaggaaugcucuuguuacggacauucccagagggucacaugcguuugccgggauaacuggcaaggcgcaaaucgcccuaucauugagaucgacaugaacacucuggaacacaccucacgauacguguguacaggcauacuaaccgauacuagcagaccaggggacaagaguucuggagauugcuccaaucccauuacggguagcccuggcgcccaggggguaaagggauuuggcuuccucaacggugacaauacauggcuggggaggaccaucucgccacggucucguuccggcuuugagaugcuuaaaaucccgaacgcuggaacugaucccaauucacgcauugccgaaagacaggagaucguggacaacaacaauuggaguggcuauagcggguccuucauugacuacuggaacaauaacucugaguguuauaauccuugcuuuuacgucgaacugauaaggggacggccagaggaagcaaaguaugugugguggaccagcaacucauugaucgcucucugugguagucccuucccuguuggcuccgggagcuuuccagauggagcccagauucaauacuucucuuga

SEQ ID NO: 146425 - RNA, 1410 nt, Artificial Sequence
  derived and/or modified sequence opt3 from neuraminidase__InfluenzaA__AHJ57439
augaaccccaaucagaagaucauuaccauaggcagcgugucccugaucauuucuacaaucugcuucuuuaugcaagucgccauucuccuuacuacgguuacccugcacuucaaacaguacgaguuuaacucaccuccaaauaaccaggugauguugugugaaccgacaaucauagagagaaauaucacugaaauuguauauuuaaccaacacaaccaucgagaaggaaauuugccccaaaccugcugaguacaggaauuggaguaagccacagugugacaucacuggguucgcacccuuuagcaaagauaacuccauacggcugucugccggaggugacauuugggugacacgcgagccuuaugucucgugcgauccagacaaguguuaccaauucgcgcuaggccaggggaccacgcucaauaacgugcauucaaauaacacuguucgagaucguacccccuauagaacacugcuuaugaaugaacugggagugccuuuucacuugggcacuaagcaggucugcaucgcuuggagcaguuccucuugucaugacgguaaagccuggcuccacgugugcauuaccggggaugacaagaacgcaacagccagcuucaucuacaauggaaggcugguagauuccguugugucauggaguaaagacauccugcggacccaggagagcgaaugugucugcauuaacggcacguguacuguggugaugacagauggcucugcuuccgggaaggcagacaccaaaauacucuuuaucgaggagggaaagauuguccauacuucaacauuaagcgguagugcccaacacguugaagagugcucuugcuauccacgcuacccgggcgugagauguguaugcagggauaacuggaagggguccaaucggcccaucguggacauaaacauuaaagaccacagcaucgucucgucuuacguguguuccggacugguuggcgauaccccucgcaagaaugacucaaguagcuccucucauugccuugauccaaacaaugaagagggugggcacggagugaaaggcugggcuuucgacgauggcaacgacgucuggauggggcgaacgaucaaugaaaccagcagauugggauaugagacauuuaaggugauugaggguuggucaaaccccaaaaguaagcugcagaucaauaggcagguaauuguugaucggggcaaccguuccggguacagcggaauauucucuguggaaggcaaaucauguaucaaucgcugcuuuuaugucgagcuaauuagagguaggaaggaagagacugaagugcucuggaccaguaacagcaucgucguguucugugggacauccggcacuuacggaaccggcucuuggccugacggggccgauaucaaucugaugccaauuuga
